United States Patent 11,596,699 (RNA ENCODING AN ANTIBODY) - sequence listing, part 5

SEQ ID NO: 24316 - RNA, 333 nt, Artificial Sequence
  derived and/or modified sequence opt3 from anti-HIV_V3_LightChain
cagagcgugcugacccaacccccuuccgccucuggcacaccagggcagagagucacuaucucaugcaguggaagcuccucuaacauugguucgaauacgguuaacugguaccagcaccucccgggcaccgcucccaaacuucugauauauucaaaugaccagaggccuagcggggugccagaucgguucaguggauccucuagcggcacauccgcaucauuggccaucagugguuuacaaagcgaggacgaagcggauuacuauugugcugccugggacgauucucugaacgggcccuuuguauucggaacuggcaccaaggugacaguccua

SEQ ID NO: 24317 - RNA, 318 nt, Artificial Sequence
  derived and/or modified sequence opt3 from anti-HIV_V3_LightChain
gacauccagaugacccaaagccccuccucucugucagccagugugggcgauagaauuacaauaacuugcaggacgagccaguccaucgacaaccaccucaauugguaccagcauaagccugggaaagcuccaaaacuucugauuucugcagccucgcgguugcagucaggagucccgagccgcuucaccgguaguggcuccgggacagaguuuacuuuaaccaucucuagccugcaacccgaagauuucgcgguuuauuacugucagcaguccuauauuacaaucaccuuuggaccuggcacuaagguggacauaaag

SEQ ID NO: 24318 - RNA, 321 nt, Artificial Sequence
  derived and/or modified sequence opt3 from anti-HIV_V3_LightChain
gagaucgugaugacccagagccccgccacacuguccgucucuccuggcgaagggguuacucucucaugcagagcuagucaaagcguguccucuaacauucuuugguaccagcagaggccaggacaggcaccgcggcuguuguuauauggugccucgacgcgcgcgaccggcauacccgcucgauucucagggagcggaaguggcacagaguuuacucugaccaucaauuccaugcaaucugaagacuucgccauuuacuauugucagcaguaccacgauuggcuauggacacucggucaggggacccaaguagagaucaag

SEQ ID NO: 24319 - RNA, 327 nt, Artificial Sequence
  derived and/or modified sequence opt3 from anti-HIV_V3_LightChain
agcuacgagcugacccagcccccuuccgugucugucucaccaggccaaacagccaguaucacuugcagcggggacaagaugggagaaagauauacguccugguaccagcagaaaccgggucagucucccguucucgugaugucggagaacauuaagaggccugcuggcauaccagaacgguucucagggagcaguuccggaaauaccgcaauccuuacaauuucuggcacucaagccguagaugaggcggacuauuacugucaggugugggauaccacaaccacuagcuaugucaucuuuggugggggaacaaaacugaccguguug

SEQ ID NO: 24320 - RNA, 321 nt, Artificial Sequence
  derived and/or modified sequence opt3 from anti-HIV_V3_LightChain
gacauccagaugacccaaagccccuccucucugucagccagugugggcgauagagucacaauuacuugccaggcuagccaggacauagggaacuaccucaauugguaucaccagaagccuggaaaagcaccaaaacuucugaucuacgaugccuccaacguugagacggguguggcgucuagguucucgggcucagggagcggaaccgacuuuacauugacuauuaguuccuuacaaccggaagauaucggcaccuauuucugucagcaguacgagucucugcccugggcuuuuggugggggaacaaagguagaaauucgg

SEQ ID NO: 24321 - RNA, 333 nt, Artificial Sequence
  derived and/or modified sequence opt3 from anti-HIV_V3_LightChain
aacuucaagcugacccagccccacagcguguccgagucuccuggcaaaacagucacuaucucaugcacgagaaccagugggacaauugccacuaauuacguucaaugguuucagcagaggccaggaagcuccccgaccacaaugauauaugaaaacgacaagcggcccucuggugugccugaucgcuucucgggcucaaucgacaccagcaguaauuccgcuucucucacuauuagcgggcuuaaaacagaggaugaagcagacuacuauugucaguccuacaacucaaccgauaucguaguguuuggaggcgguacgaagcugacugucuug

SEQ ID NO: 24322 - RNA, 327 nt, Artificial Sequence
  derived and/or modified sequence opt3 from anti-HIV_V3_LightChain
cagagcgugcugacccaacccccuuccgucucugccgcuccaggccagaagguuacaaucucaugcagugggagcuccucuaacauuggaaauaacauggugucgugguaccagcagcacccggguacugcacccaaacuccuuauauaugaaaauucaaagagaccuagcggcaucccagacagguucagugggucccggucuggaacgagcgccacccugggcauuaucgguuugcaaacaggggaugaggcggaguacuauugugcuacuugggacggauccuuacgcaccguauuuggcggcgggacaaaacugaccgugcua

SEQ ID NO: 24323 - RNA, 324 nt, Artificial Sequence
  derived and/or modified sequence opt3 from anti-HIV_V3_LightChain
agcuacgagcugacccagcccccuuccgugucugucucaccaggccaaacagccagaaucacuugcaguggggacgcucucccgaaccaguauggauacugguaucagcagaagcccggucaagcaccuguucuugugauuuucaaagauagcgaaaggccauccggcauacccgagcgguuuucugggucgucaagcggaacgaccguaacacugacuaucaguggcgugcaggccgaagacgaggcggauuacuauugucaguccgcugacucuagcgguaauuacgaagucuucgggggaggcaccaaguugacaguguua

SEQ ID NO: 24324 - RNA, 330 nt, Artificial Sequence
  derived and/or modified sequence opt3 from anti-HIV_V3_LightChain
cagagcgugcugacccaacccccuuccgucucugaggccccaagacagaggguuacaaucucaugcaguggcagcuccucuaacauugggaauaacgcugugaauugguaccagcagguaccgggaaaggcacccaaacuccuuauauauuacgacgaucuguugccuucgggugugucagaccgguucagcggcaguaaguccgggucuagcgccuccuuagcgaucucaggacugcaaagugaagaugaggcugacuauuacugugccgcaugggaugacagccuaaaagucuauguguuuggcacugguacgucuguuaccgugcuc

SEQ ID NO: 24325 - RNA, 333 nt, Artificial Sequence
  derived and/or modified sequence opt3 from anti-HIV_V3_LightChain
gacaucgugaugaaccagagcccucccucccuggccgucaccccaggcgagccggcuucuauuucaugcagagcaagucaaagccuccuuuacuccgaugggcacaauuaucuggacugguacuugcagaagcccggacaggccccucaguuacugauauaucuagguucuacaagggcgucgggcguuccagaucgguucucagggagcggaaguggcacugacuuuacgcucaaaaucucccgcguggaagcugaggauguagguguguacuauuguaugcaaccccugcagucuuacaccuucgggcagggaacaaaacuugaaauuaag

SEQ ID NO: 24326 - RNA, 321 nt, Artificial Sequence
  derived and/or modified sequence opt3 from anti-HIV_V3_LightChain
gccuacgagcugacccagcccccuagcguguccgucucuccaggccaaacagcuagaaucacuugcucaggggacgcacucccgaaccaguaugccuacugguaucaccagaggcccggacaggcgccuguucuugugauucauaaggauacggaacggccaagugguauacccgcucgcuucagcggcuccucuucggggaccacaguaacucugaccaucucagaggugcaagccgaagacgagggagauuacuauugucagagcgcagacacaagugccuacgucguguuuggcggugggaccaaauugacuguuuua

SEQ ID NO: 24327 - RNA, 330 nt, Artificial Sequence
  derived and/or modified sequence opt3 from anti-HIV_V3_LightChain
cagagcgugcugacccaagcccccuccucuucaggcacaccugggcagagugucacuaucagcugcuccggaucuucgucaaacauggagauuaauuacguuuauugguacagacaguucccagguacggcuccgcagcuccuuauauauaacgacaaucaaaggcccagcggcgugccugaucgguuuagugcauccaagucugggaccagcgccucccuggcgaucggaggcuugcgcucagaagacgaggcugauuacuucugugccguauggcacggugaccgagggggaccaguguuuggcggcgggacaaaauuaacuguccug

SEQ ID NO: 24328 - RNA, 327 nt, Artificial Sequence
  derived and/or modified sequence opt3 from anti-HIV_V3_LightChain
agcuacgagcugaagcagcccagauccgugucugucucaccuggccaaaccgccaggaucacaugcaguggggacgcuaugccaaaccaguaugcauacugguaucagcagcggccgggacgcgcccccguucuccuuauuuucaaagauaaugaacgagcgagcgguauaccugagcguaucuccgggucuucgucaggcacuacggcuacccugacaauuaacagagugcaagccgaagacgaggcagauuacuugugucagagcgccgacaguuccggagcuuuuccauggguauucggcggugggacuaccuuaacagugcug

SEQ ID NO: 24329 - RNA, 324 nt, Artificial Sequence
  derived and/or modified sequence opt3 from anti-HIV_V3_LightChain
agcuacgagcugacccagcccccuuccgugucugucucaccaggccaaacagccagaaucacuugcaguggggacgcucucccgaaggaauaugcauacugguaucagcagaaaagcggacaggcccccguucuugugauuuacgaggauacgaggcggccuuccgguauaccagaacgcuucucuggcucgucaagcgggaccauggcgacacugacuguaaguggagcucacguggacgaugaggccgacuauuacuguuauucccgagauaccucugcaaaccaaugggucuuuggcggugggacaaaguugaccguguua

SEQ ID NO: 24330 - RNA, 318 nt, Artificial Sequence
  derived and/or modified sequence opt3 from anti-HIV_V3_LightChain
gagaucgugcugacccagagccccgccacacucucccuuucuccuggcgaaagagcuacucugucaugcagggcaagucaaagcauuuccacguacuuggggugguaucagcagaagccaggacaggccccgcgguuacugauauacgacgcgucuaaccgcgcuaccgguauccccgcccgauucucgggcucagggagcggaacagauuuuacucuaaccauuaguucccucgagccugaagacuucgcagucuauuacugucaacagcguuauacauggaucaccuuuggccaggguacuagacuggagauuaaa

SEQ ID NO: 24331 - RNA, 327 nt, Artificial Sequence
  derived and/or modified sequence opt3 from anti-HIV_V3_LightChain
agcuacgagcugacccagcccccuuccgugucugucucaccaggccaaacagccagaaucacuugcaguggggacgcucucccgaaccaguauguuuacugguaucagcagaggcccggacaagcaccugugguagugcuuuacaaggauacggaacggccaagcgguauucccgagcgcuucuccgggucuucgucaggcaccacagucacucugaccauaagcggagugcaggccgaagacgaggcggauuauuacugucagagugcugacaauuccggcgccuauccuuuguuuuucggugggggaacaaaauuaaccguucug

SEQ ID NO: 24332 - RNA, 333 nt, Artificial Sequence
  derived and/or modified sequence opt3 from anti-HIV_V3_LightChain
cagagcgugcugacccaacccccuuccgucucugccgcuccaggccagaagguuacaaucucaugcagugggagcuccucuaacauuggaaauaacuacgugcucugguaucagcaguucccggguacugcacccaaacuucugauauacggcaauaacaagagaccuucggggaucccagacagguuuucaggaagcaaaaguggcacguccgccaccuuggguauuacaggguuacaaacuggagaugaggcggacuauuucugugcuaccugggauucuggccugagcgccgacuggguauuuggcgggggaacaaagcuaaccgugcuc

SEQ ID NO: 24333 - RNA, 321 nt, Artificial Sequence
  derived and/or modified sequence opt3 from anti-HIV_V3_LightChain
gacauccagaugacccaaagccccuccucucugucagccagugugggcgauagagucacaauuacuugcagggcuagccaggagauagacaacuaccucgcaugguaucagcagcggccugggaaggccccaaaaucccuuaucuacgcggcuucuucgcugcaaggagguguuccgcccaaguucucaggcagcgggaguggaacggaauuuaccuugacaauuuccucuuuacaggccgaggauuucgcaacuuauuacugucagcaguauaaugccuacccucugaccuuuggccaagguacacgccuagacaucaac

SEQ ID NO: 24334 - RNA, 324 nt, Artificial Sequence
  derived and/or modified sequence opt3 from anti-HIV_V3_LightChain
agcuacgagcugacccagcccccuucccucucugugucaccaggccaaacagccaguaucacuugcagcggggacggacuuccgaagcaguaugguuacugguaucagcagaaacccggccaagcuccucuguuggucauuuuaaaggauacggaaagaccauccgggauacccgagagguucucuggaucgucaagcggcaccacaguuacucugaccaucaguggugugcaggcagaagacgaggccgauuacuauugucaguccguagacucuacagggagcuacuauguguuuggaccuggcaccaaagucacugugcua

SEQ ID NO: 24335 - RNA, 324 nt, Artificial Sequence
  derived and/or modified sequence opt3 from anti-HIV_V3_LightChain
agcuacgagcugacccagcccccuuccgugucugucucaccaggccagacagcgagaaucacuugcaguggggacguucucccgaagaaauaugcuuacugguaucagcaaaagagcggacuugcacccgugcugguaauuuacgaagauaacaggcggccuuccgguauaccagagcgcuucucuggcucgucaagcgggacgauggccaccuugacaaucaguggagcccagguggaagacgagggcgauuauuacuguuccucuacugacagcuccggugaucacuaugucuuugggaccggaacaaaagugaccguuuua

SEQ ID NO: 24336 - RNA, 321 nt, Artificial Sequence
  derived and/or modified sequence opt3 from anti-HIV_V3_LightChain
gccuacgagcugacccagcccccuagcguguccgucucuccaggccaaacagcuagaaucacuugcucagcagaagcccucaguaaccaguaugcguacugguauaggcagcggccggggcaggcuccccuucugauuauauacaaggacacgaaacgcccuagcggaaucccagagcgauucuccgguucuaccucgggcacaacuguuaccuugacaauuucaggggugcaagccgaagaugaggcagacuauuacugucagagcgccgauaguuccggagacuauguauuuggcggugggaccaaggugacugucuua

SEQ ID NO: 24337 - RNA, 333 nt, Artificial Sequence
  derived and/or modified sequence opt3 from anti-HIV_CD4bs_LightChain
cagcccgugcugacccaaagcuccucugccucagcuagucucggcagcuccgucaaacuuacaugcacucuggggucuggacacucggguucaaucauugcauggcaucagcagcagccuggcaaggccccaagauacuugaugaagguucaaagcaguggguccuauaacaaaggaucuggcgugccggacagguucagcgguuccucaaguggggcggaucgguacuuaacgauaagcaaucugcaguuugaggacgaaggagauuauuacugugagaccugggacacaaacaaguauguauucggcacuggcaccaaagugacaguccua

SEQ ID NO: 24338 - RNA, 324 nt, Artificial Sequence
  derived and/or modified sequence opt3 from anti-HIV_CD4bs_LightChain
gagcuggugcucacccagagccccggcacacuuucccugucuccuggggaaagagccacuuugucaugcagggcuagucaaagcgucgcauccuacuauuuagccugguaccagcagaagccaggacaggcgccgcggcugcuaaucuauggugcuucuucgcgcgccacgggcauucccgaccgauucucagggagcguuaguggaaccgauuuuacacucacuauaucccgucuggagccugaagacuucgcacuuuacuauugucaacaguacggcucuagcccacuguccuuuggugggggaaccaaaguggagaucaga

SEQ ID NO: 24339 - RNA, 333 nt, Artificial Sequence
  derived and/or modified sequence opt3 from anti-HIV_CD4bs_LightChain
cagagcgcccugacccaacccccuuccaugucuggcucaccagggcagaguaucacaauuagcugcacuggauccgguucugacgugggcucgcacaacuucgucucaugguaccagcagcauccggcuagaguucccaagcuccuuauauaugcaguggggaauaggccuagcggaguaagugagcgguuuuccggcucuaaaagcgguaacacggccuaccugaccaucuccggguugcaagcggaugacgaagcugauuauuacuguucaagucacacaacuggaaccacauuagagguguucggcggcgggacccgccugacuguccua

SEQ ID NO: 24340 - RNA, 333 nt, Artificial Sequence
  derived and/or modified sequence opt3 from anti-HIV_CD4bs_LightChain
gacaucgugaugacccagagcccccugucccucccugucacaccaggcgagccggccucuauuucaugcagaaguagcgaaucccuucugcacucuaacggguucauauacuuggauugguauuuacaaaagcccggacagucgccucagcugcuaaucuaccucgguucaaaaagggcuagcggcguuagugaccgguuuuccgggucuggaagcggcacugcauucacgcugaagauuucccgcguggaggccgaagauguagguguguauuacuguaugcaggcgcuugagucacgaaccuuugggcaaggaacaaaacuggaaaucaag

SEQ ID NO: 24341 - RNA, 327 nt, Artificial Sequence
  derived and/or modified sequence opt3 from anti-HIV_CD4bs_LightChain
gagaucgugcugacccagagccccggcacacucucccuuucuccuggggaaagagccacucugucaugcagggcuagucaaagcgucuccucuucguacuuggcaugguaucagcagaagccaggacagucaccgcgguuacugauuuacggugccagcagucgcgcgacgggcauacccgaccgauucuccgggucuggaagcggcaccgauuuuacacuaacuaucucccgucucgagccugaagacuucgcuguuuauuacugucaacacuaugguucaaguagcauuuuuaccuucgggccaggaacaaaaguggauaucaga

SEQ ID NO: 24342 - RNA, 330 nt, Artificial Sequence
  derived and/or modified sequence opt3 from anti-HIV_CD4bs_LightChain
aacuucaugcugacccagccccacagcguguccggcucuccugggaagacagucacuaucucaugcacgagaaguagcggauccauugccgguaauuacguucaaugguaucagcagaggccaggcaccucuccgacaacugugauauacgagaacgaccagcggucgucagggguacccgaucgcuuuagcggaaguaucgacuccucuagcaauuccgcuucacucaccauuaguggccuuaaaacagaagaugaggcagacuauuacugucauagcuaugaugccaccaaccaaguguucggugggggaacuaagcugacagucuug

SEQ ID NO: 24343 - RNA, 333 nt, Artificial Sequence
  derived and/or modified sequence opt3 from anti-HIV_CD4bs_LightChain
gacguggucguuacccagagcccccugucccucccugugacacuuggccaaccagccucuaucucaugcagaaguagccagucccugguauacucugaugggacuacgcacuugaacugguaucaucagaggccgggacagcccccucggcgcuuaauuuaccgagugucgaaucgugacucaggugucccagauagauucagcggcaguggguccggaaccgacuuuacacugaggauaucucggguggaggcugaagauguuggccuauauuacuguaugcucgcaacucaccccuucaccuuugguccugggacaaagguggagaucaaa

SEQ ID NO: 24344 - RNA, 336 nt, Artificial Sequence
  derived and/or modified sequence opt3 from anti-HIV_CD4bs_LightChain
cagagcgugcugacccaacccccuuccgucucuggcgccccagggcagacaguuacuaucucaugcacgggaaguagcuccaacauugguccgucuuacgacgugcagugguaucagcaauuccccggcagagcuccuaagcuccuuauaucggggaauaacaauagggcaucaggaguaccagaucgguuuagcggcaguaaauccgguaccucugccagccuggcgaucacaggguugcaguccgaggacgaagcugauuacuauugucagacuuacgacucaaguuuaagcggacacguggucuucggcggcgggacccgccugacagugcua

SEQ ID NO: 24345 - RNA, 321 nt, Artificial Sequence
  derived and/or modified sequence opt3 from anti-HIV_CD4bs_LightChain
gacauccagaugacccaaagccccuccacacugucugccucagugggcgauagagucacuauuacgugcagggcuagugcaagcauauacaccuggcucgccugguaucagcagcggccugggaaggcgccagagguucuuaucuacaaggcuuccacacugaaaucuggagugccgucgcgcuucucagguagcggcagugggacugaauuuaccuugacaauuuccucuuuacagcccggagacuucgccaccuauuacugucaacaguauacuacauacccucugaccuuuggcggugggacgacuguagagaucaaa

SEQ ID NO: 24346 - RNA, 330 nt, Artificial Sequence
  derived and/or modified sequence opt3 from anti-HIV_CD4bs_LightChain
cagagcgcccugacccaacccgcuuccgugucuggcucaccugggcagaguaucacaauuagcugcacuggaacguccaacgacauagguaccuacaaucucgucucuugguaucagcaccauccaaacaaggcaccgaaaguugugguauacgagaauaacaagagacccucgggcaucucaaauagguucagcgggaguaaauccggaaacacagccucucuuacuauuagcggccugcaggcggaagaugaggcugacuauuacuguugcuccuaugccgguucaaguaccuggguguuugggggaggcacaaaguugaccgucuua

SEQ ID NO: 24347 - RNA, 321 nt, Artificial Sequence
  derived and/or modified sequence opt3 from anti-HIV_V2_LightChain
gacauccagaugacccaaagccccuccacacugucugccucagugggcgauagagucacuauuacgugcagggcuagucagaccauaagcuccuggcucgcaugguaccagcagaagucugggacagccccuaaacuucugaucuauaaggcgucgucaauuguuagcggagugccaagucgguucuccgguucuggcagcgggacugaguuuaccuugacaaucaccuccuuacaaccggacgauuucgcuacuuacuauugucagcaguacaacucaagucccgaaacauuuggacagggcaccaaaguagagauuaag

SEQ ID NO: 24348 - RNA, 318 nt, Artificial Sequence
  derived and/or modified sequence opt3 from anti-HIV_V2_LightChain
gagaucgugcugacccagagccccggcacacucucccuuucuccuggggaaagagccacucugucaugcagggcuagucaaagcgucuccucuuacuuggcaugguaucagcagaagccaggacaggccccgcgguuacugauuuacgacgcgucgucacgcgcuacggguauacccgaucgauucagcggcaguggguccggaaccgacuuuacacuaacuaucucucgucucgagccugaagauuucgccguuuauuacugucaacacuaugcaggcagcagaaccuuuggucaggggacaaaaguggagauuaag

SEQ ID NO: 24349 - RNA, 333 nt, Artificial Sequence
  derived and/or modified sequence opt3 from anti-HIV_V2_LightChain
cagagcgugcugacccaacccccuuccgucucuggcgccccagggcagagaguuacaaucucaugcacuggaaguagcuccaacauuggugcucacuacgacgugcauugguaucagcagcucccgggcacggcacccaaacuucugauauacggaaauucuaacaggccuucggggguaccagaucgguucucaggcagcaagagugguaccuccgccucuuuggcgaucacaggguuacaagcugaggacgaagccgauuauuacugucagagcuaugacuccucacugaguggauacguguuuggcacuggcaccaaggucacagugcua

SEQ ID NO: 24350 - RNA, 324 nt, Artificial Sequence
  derived and/or modified sequence opt3 from anti-HIV_V2_LightChain
gacaccgugaugacacagagccccgccacucuguccgucucuccuggcgagagaguuacgcucucaugcagggcuagucaaaucauuaacaccaaucuugcaugguaccagaagcggccagggcaggccccgcgccuguugauauaugcggcuagcgcccgagcaacaggaauccccgcccguuucuccgguucuggcucggggacugaauuuaccuuaacaauuucaggacugcagagcgaggauagugcuguguacuauugucaacaguacaaacacuggccuccauauaccuucggcagagguacuaagcuagaaaucagg

SEQ ID NO: 24351 - RNA, 321 nt, Artificial Sequence
  derived and/or modified sequence opt3 from anti-HIV_V2_LightChain
gagaucgugcugacccagagccccggcacacucucccuuucuccuggggaaagagccacucugucaugcagggcuagucaaagcgucuccucuucguacuuggcaugguaucagcagaagccaggacaggccccgcgguuacugauuuacggugcgucaagccgcgcuacgggcauacccgaccgauucaguggguccggaucuggcaccgauuuuacacuaacuaucagccgucucgagccugaagacuucgccguuuauuacugucaacaguaugguuccucaagaaccuuugggcagggaacaaaaguggagauuaag

SEQ ID NO: 24352 - RNA, 321 nt, Artificial Sequence
  derived and/or modified sequence opt3 from anti-HIV_V2_LightChain
gacauccagaugacccaaagccccuccucucugucagccagugugggcgauagagucacaauuacuugcagggcuagccaguccauaucugggaaccucaauugguaccagcagaagccuggaaaagcaccaaaccuucugaucuauggugccucgucauugcaaagcggcguuccgagucgguucuccgggucuggaagcggcacggacuuuaccuuaacaauuuccucacugcagcccgaggauuucgcgacuuaccacugucagcagagucauagcaccucuuggacauuuggucaagggaccaaggugguaaucaaa

SEQ ID NO: 24353 - RNA, 327 nt, Artificial Sequence
  derived and/or modified sequence opt3 from anti-HIV_10E8
gccagcgagcugacccaggaccccacaguguccgucgcucucggccaaacuguuacgauuaccugcagaggggauucucuuaggaaccacuacacaucaugguaucagcagaagacuggacaggcaccugugcuguugaucuacccaaaacauaaucggaguccggguauaagcgaccgcuucuccgccucuucgucaggcaacaccgcgagcuuaacaaucaccggggcucaaacugaagaugagggagacuauuacuguaguucccgagauaagucuggcagccgucugguaacauuuggugggggaaccgaagugacgggccua

SEQ ID NO: 24354 - RNA, 327 nt, Artificial Sequence
  derived and/or modified sequence opt3 from anti-HIV_10E8
gccagcgagcugacccaggaccccacaguguccgucgcucucggccaaacuguuacgauuaccugcagaggggauucucuuaggaaccacuacacaucaugguaucagcagaagacuggacaggcaccugugcuguugaucuacccaaaacauaaucggaguccggguauaagcgaccgcuucuccgccucuucgucaggcaacaccgcgagcuuaacaaucaccggggcucaaacugaagaugagggagacuauuacuguaguucccgagauaagucuggcagccgucugguaacauuuggugggggaaccaaagugacggucgug

SEQ ID NO: 24355 - RNA, 327 nt, Artificial Sequence
  derived and/or modified sequence opt3 from anti-HIV_10E8
gccagcgagcugacccaggaccccacaguguccgucgcucucggccaaacuguuacgauuaccugcagaggggauucucuuaggaacuacuauacaucaugguaccagcagaagccuggacaggcaccagugcuguugaucuauccgaaacacaaucggcccccugguauaagugaccgcuucagcgccuccucuucgggcaacacugcgucauuaaccaucacaggggcucaaaccgaagaugagggagacuacuauuguagcagucgagauaaguccggcucucgucugguaacuuuuggugggggaacaaaagugaccggccua

SEQ ID NO: 24356 - RNA, 327 nt, Artificial Sequence
  derived and/or modified sequence opt3 from anti-HIV_10E8
gccagcgagcugacccaggaccccacaguguccgucgcucucggccaaacuguuacgauuaccugcagaggggauucucuuaggaacuacuauacaucaugguaccagcagaagccuggacaggcaccagugcuguugaucuauccgaaacacaaucggcccccugguauaagugaccgcuucagcgccuccucuucgggcaacacugcgucauuaaccaucacaggggcucaaaccgaagaugagggagacuacuauuguagcagucgagauaaguccggcucucgucugguaacuuuugguagagggacaaaacuaaccgugguc

SEQ ID NO: 24357 - RNA, 327 nt, Artificial Sequence
  derived and/or modified sequence opt3 from anti-HIV_10E8
gccagcgagcugacccaggaccccacaguguccgucgcucucggccaaacuguuacgauuaccugcagaggggauucucuuaggaaccacuacacaucaugguaucagcagaagacuggacaggcaccugugcuguugaucuacccaaaacauaaucggaguccggguauaagcgaccgcuucuccgccucuucgucaggcaacaccgcgagcuuaacaaucaccggggcucaaacugaagaugagggagacuauuacuguaguucccgagauaagucuggcagccgucugguaacauuuggugggggaaccaaagugacgguccua

SEQ ID NO: 24358 - RNA, 327 nt, Artificial Sequence
  derived and/or modified sequence opt3 from anti-HIV_10E8
gccagcgagcugacccaggaccccacaguguccgucgcucucggccaaacuguuacgauuaccugcagaggggauucucuuaggaacuacuauacaucaugguaccagcagaagccucggcaggcaccagugcuguugaucuauccgaaacacaaucgacccccuggaauaagugaccgcuucagcgccuccucuucggguaacacugcgucauuaaccaucacaggcgcucaaaccgaagaugagggggacuacuauuguagcagucgugauaaguccggaucuagacugguaacuuuuggcggugggacaaaacuaaccgugcuc

SEQ ID NO: 24359 - RNA, 327 nt, Artificial Sequence
  derived and/or modified sequence opt3 from anti-HIV_10E8
gccagcgagcugacccaggaccccacaguguccgucgcucucggccaaacuguuacgauuaccugcagaggggauucucuuaggaacuacuauacaucaugguaccagcagaagccuggacaggcaccagugcuguugaucuauccgaaacacaaucggcccccugguauaagugaccgcuucagcgccuccucuucgggcaacacugcgucauuaaccaucacaggggcucaaaccgaagaugagggagacuacuauuguagcagucgagauaaguccggcucucgucugguaacuuuuggugggggaacaaaacuaaccgugcuc

SEQ ID NO: 24360 - RNA, 327 nt, Artificial Sequence
  derived and/or modified sequence opt3 from anti-HIV_10E8
gccagcgagcugacccaggaccccacaguguccgucgcucucggccaaacuguuacgauuaccugcagaggggauucucuuaggaaccacuacacaucaugguaucagcagaagacuggacaggcaccuauccuguugauauacccaaaacauaaucggccgcccgguaucagugaccgcuucagcgccuccucuucgggcaacaccgcgucauuaacaauuaccggggcucaaacugaagaugagggagacuauuacuguagcagucgagauaaguccggcucucgucuggugacauuuggugggggaaccaaacuaacgguacuc

SEQ ID NO: 24361 - RNA, 327 nt, Artificial Sequence
  derived and/or modified sequence opt3 from anti-HIV_10E8
agcuccgaccugacccaggaucccgccgugucugucgcucucggccaaacaguuagaaucacuugccagggggacucacuuaggcgguacuaugcaggaugguaccagcagaagccuggucaagccccagugcugguaguguauggccgcgauaaccgaccgagugggauucccgaccguuucagcggauccacgucuggcaauaccgcgucguugacaauagcuggugcccaggcagaggaugacgccgauuacuauuguucaagcagagacaaaaguggguccagguuaucugucuuuggaggcggcacuaagcugaccgugcua

SEQ ID NO: 24362 - RNA, 327 nt, Artificial Sequence
  derived and/or modified sequence opt3 from anti-HIV_10E8
gccagcgagcugacccaggaccccgcuguguccgucgcauucgaaaagacaguuacuaucacgugccaaggcgauucucucagaucacacuacgugaguugguaucagaaaaggccugggcaggccccaguacuuguguuuuacggaaagaacaaucggccgagcgguauucccgaccgcuucuccggcucuaccucggggaacacagcgucacugacuauagcuggagcccaggcagaggaugacgccgauuauuacuguagcagucgagacaaauccggcucucguuugagcgucuuuggugggggaaccaaguuaacagugccu

SEQ ID NO: 24363 - RNA, 327 nt, Artificial Sequence
  derived and/or modified sequence opt3 from anti-HIV_10E8
gccagcgagcugacccaggaccccgcuguguccgucgcacucaagcaaacaguuacuaucacgugcagaggcgauucucuuaggucacacuacgugaguugguaucagcagaaaccugggcaggccccaguacugguguucuacggaaagaacaaucggccgagcgguauucccgaccgcuuuuccgggucuucgucaggcaacaccgcgagcuugacaauagcuggagcccaagcagaagaugacgccgauuauuacuguaguucccgagacaaaucuggcagccguuuauccgucuucggugggggaacuaagcugaccgugcua

SEQ ID NO: 24364 - RNA, 327 nt, Artificial Sequence
  derived and/or modified sequence opt3 from anti-HIV_10E8
agcuccgagcugacccaggaccccggcgugucugucgcccucaagcaaacaguuacuaucacgugcagaggggauucacuuaggagucacuacgugagcugguaucagaaaaagccuggacaggcuccaguacugguguucuacgguaaaaacauuggcccguccgggauacccgaccgguuuucuggaucgaccucaggcaauacagcaaguuugacuaucgccggugcgcaggcugaagaugacgccgauuauuacuguagcucccgcgacaagucugggagccgauuauccgucuucggaggcggcaccaaacugacagugcua

SEQ ID NO: 24365 - RNA, 327 nt, Artificial Sequence
  derived and/or modified sequence opt3 from anti-HIV_10E8
gccagcgagcugacccaggaccccgcuguguccgucgcacucaagcaaacaguuacuaucacgugcagaggcgauucucuuaggucacacuacgugaguugguaucagaaaaagccugggcaggccccaguacugguguucuacggcaaaaacaaucggccgagcgguauucccgaccgcuuuuccggaucuucgucagggaacaccgcgagcuugacaauagcuggagcccaggcagaagaugacgccgauuauuacuguaguucccgagacaagucuggcagccguuuauccgucuucggugggggaacuaaacugaccgugcua

SEQ ID NO: 24366 - RNA, 327 nt, Artificial Sequence
  derived and/or modified sequence opt3 from anti-HIV_10E8
gccagcgagcugacccaggaccccggcguguccgucgcucucaagcaaacaguuacuaucacgugcagaggggauucucuuaggucacacuacgugaguugguaucagaaacggccuggacaggcaccaguacugguguucuacgguaagaacaaucgcccgagcggcauucccgaccgauuuuccgggucuaccucgggaaacacagccucauugacuauagcgggcgcucaggccgaagaugacgcagauuauuacuguagcagucgugacaaauccgguucuagauuaagcgucuucgggggaggcaccaagcugacagugcua

SEQ ID NO: 24367 - RNA, 327 nt, Artificial Sequence
  derived and/or modified sequence opt3 from anti-HIV_10E8
gccagcgagcugacccaggaccccggcguguccgucgcucucgaacaaacaguuacuaucacgugcagaggggauucucuuaggucacacuacgugaguugguaucagaagaaaccuggacaggcaccaguacugguguucuacgguaagaacaaucggccgagcggcauucccgaccgcuuuuccgggucuaccucgggaaacacagccucauugacuauagcgggcgcucaggccgaggaugacgcagauuauuacuguagcagucgagacaaauccgguucucguuuaagcgucuucgggggaggcaccaagcugacagugcua

SEQ ID NO: 24368 - RNA, 327 nt, Artificial Sequence
  derived and/or modified sequence opt3 from anti-HIV_10E8
gccagcgagcugacccaggaccccggcguguccgucgcucucaagcaaacaguuacuaucacgugcagaggggauucucuuaggucacacuacgugaguugguaucagaaaaagccuggacaggcaccaguacugguguucuacgguaaaaacaaucggccgagcggcauucccgaccgcuuuuccgggucuaccucgggaaacacagccucauugacuauagcgggcgcucaggccgaagaugacgcagauuauuacuguagcagucgagacaaguccgguucucguuuaagcgucuucgggggaggcaccaaacugacagugcua

SEQ ID NO: 24369 - RNA, 327 nt, Artificial Sequence
  derived and/or modified sequence opt3 from anti-HIV_10E8
agcuccgagcugacccaggaccccggcgugucugucgcccucaagcaaacaguuacuaucacgugcagaggggauucacuuaggagucacuacgugagcugguaucagaaaaagccuggacaggcuccaguacugguguucuacgguaaaaacaaucggccguccggcauucccgaccgcuuuucugggucgaccucaggaaacacagccagcuugacuauagcaggcgcgcaggcugaagaugacgccgauuauuacuguaguucccgagacaagucugguagccguuuauccgucuucgggggaggcaccaaacugacagugcua

SEQ ID NO: 24370 - RNA, 327 nt, Artificial Sequence
  derived and/or modified sequence opt3 from anti-HIV_10E8
agcuccgagcugacccaggaaacaggcgugucugucgcccucgggagaacuguuacgauuaccugcaggggagacucacuucggagucacuacgcuagcugguaucaagagaagcccggucaggcaccuaaacuguuguucuacggcaagaacaaucgcccauccgggaucccggaucgauuuucuggaucggccucaggcaaccgugcgagcuuaacaauaaguggugcucaggccgaagacgaugcagaguauuacuguuccucuagagacaaaagcggguccaggcugucaguguucggaggcggcacuaagcuagccguacuc

SEQ ID NO: 24371 - RNA, 327 nt, Artificial Sequence
  derived and/or modified sequence opt3 from anti-HIV_10E8
agcuccgagcugacccaggaaacaggcgugucugucgcccucgggagaacuguuacgauuaccugcaggggagacucacuucggagucacuacgcuagcugguaucaaaagaaacccggucaggcaccuaagcuguuguucuacggcaaaaacaaucgcccauccgggaucccggaucgauuuucuggauucgccucgggcaaccgugcgucauuaacaauaagcggugcucaggccgaggacgaugcagaauauuacuguaguuccagagacaagucugggagcaggcuguccguguuuggaggcggcacuaaacuaaccguacuc

SEQ ID NO: 24372 - RNA, 327 nt, Artificial Sequence
  derived and/or modified sequence opt3 from anti-HIV_10E8
agcuccgagcugacccaggaaacaggcgugucugucgcccucgggagaacuguuacgauuaccugcaggggagacucacuucggagucacuacgcuagcugguaucaaaagaaacccggucaggcaccuaagcuguuguucuacggcaaaaacaaucgcccauccgggaucccggaucgauuuucuggaucggccucaggcaaccgugcgagcuuaacaauaaguggugcucaggccgaggacgaugcagaauauaucuguuccucuagagacaagagcggguccaggcugucaguguucggaggcggcacuaaacuaaccguacuc

SEQ ID NO: 24373 - RNA, 327 nt, Artificial Sequence
  derived and/or modified sequence opt3 from anti-HIV_10E8
agcuccgagcugacccaggaaacaggcgugucugucgcccucgggagaacuguuacgauuaccugcaggggagacucacuucggagucacuacgcuagcugguaucaaaagaaacccggucaggcaccuaagcuguuguucuacggcaaaaacaaucgcccauccgggaucccggaucgauuuucuggaucggccucaggcaaccgugcgagcuuaacaauaaguggugcucaggccgaggacgaugcagaauauuacuguuccucuagagacaagagcggguccaggcugucaguguucggaggcggcacuaaacuaaccguacuc

SEQ ID NO: 24374 - RNA, 327 nt, Artificial Sequence
  derived and/or modified sequence opt3 from anti-HIV_10E8
agcuccgagcugacccaggaaacaggcgugucugucgcccucgggagaacuguuacgauuaccugcaggggagacucacuucggagucacuacgcuagcugguaucaaaagaaacccggucaggcaccuauccuguuguucuacggcaagaacaaucgcccauccgggauacaugaucgauuuucuggaucggccucaggcaaccgugcgagcuuaacaaucaguggugcucaggccgaggacgaugcagaauauuacuguuccucuagagacaaaagcggguccaggcugucaguguucggaggcggcacuaagcuaaccguacuc

SEQ ID NO: 24375 - RNA, 393 nt, Artificial Sequence
  derived and/or modified sequence opt3 from anti-HIV_10E8
gaggugcagcuggucgaaagcggcggggaccucguuaagcccggagguucccuuagacugucuugcucagccaguggcuucagcuuuaaaaacaccuggaugacaugggugaggcaagcuccugggaagggauuggaguggguaggccggaucacugguccaggggaaggauggacguccgauuacgcagccaccgugcagggccgcuucacaauuucucgaaauaacaugauagacauguuauaucuggagaugaaucgucuaagaacugaugacaccggccucuacuauuguguccacacagaaaaauacuauaacuuuuggggaggguacccgcccggugaggaguauuuccagcauuggggcagggggacccuggugaucguuucguca

SEQ ID NO: 24376 - RNA, 393 nt, Artificial Sequence
  derived and/or modified sequence opt3 from anti-HIV_10E8
gagaucagacugguggaaagcggcgggggacucgucaagcccgguggcucccuuaggcugucuugcucagccaguggguucaacuuugacagcgcuuggaugaccuggguucggcagccuccaggaaaaggcuuggagugggugggucgcauuacagggccgggagaaggcugguccguaggcuacgcagagucugugaaggggcgauucauaaucucgcguauuaauucaaucaacuuuuuauaucuggaaaugaauaaccuaagacccgaggauacuggaagcuacuucugugcccacacggguaaacauuaugacuuuuggaggggcuacccuccaggggaggaauauuuccaagauuggggacagggcacccaggucauugugaguucc

SEQ ID NO: 24377 - RNA, 393 nt, Artificial Sequence
  derived and/or modified sequence opt3 from anti-HIV_10E8
gagaucagacugguggaaagcggcgggggacucgucaagcccgguggcucccuuaggcugucuugcucagccaguggguucaacuuugacagcgcuuggaugaccuggguucggcagccuccaggaaaaggcuuggagugggugggucgcauuacagggccgggagaaggcugguccguagauuacgcagagucugugaagggccgauucauaaucucgcguauuaauucaaucaacuuuuuauaucuggaaaugaauaaccuaagacccgaggacacugggagcuacuucugugcccacacgggaaaacauuaugauuuuuggagggguuacccuccaggcgaggaauauuuccaagacugggggcagggaacccaggucauugugaguucc

SEQ ID NO: 24378 - RNA, 393 nt, Artificial Sequence
  derived and/or modified sequence opt3 from anti-HIV_10E8
gaggugagacuggucgaaagcggcgggaggcucguucggcccggagguucccuucgccugucuugcucagccaguggcuucaacuuugacaaugcuuggaugaccugggugcgacagccuccagggaagggauuggaguggguaggccguaucacagguccgggggaaggauggagcguggauuacgcagccuccgucaaaggcagauucacuauuucuaggaugaacucgauaaacuuuuucuauuuagagaugaauaaucugaagaucgaagacacgggccuauacuuuugugcgcggaccgggaaacacuaugcuuucuggggagguuaucccccuggcgaggaguaccucgaagauugggggcaaggaacacuggugauuguuucaagc

SEQ ID NO: 24379 - RNA, 393 nt, Artificial Sequence
  derived and/or modified sequence opt3 from anti-HIV_10E8
gaggugagacuggucgaaagcggcgggggacucguuaagcccgguggcucccuuaggcugucuugcucagccaguggguucaacuuugacgaugcuuggaugaccugggugcggcagccuccaggaaaaggcuuggaguggguaggucgcaucagcgggccgggagaaggcugguccguggacuacgcagagucugucaagggccgauucacaauuucgcguuuaaauucaauaaacuuucuguaucuagaaaugaauaacgugagaacugaggauacgggguacuauuucugugccaggaccggaaaacacuacgacuuuuggagcgguuaucccccuggcgaggaauacuuccaagauugggggcagggaacacucguuaucgugaguucc

SEQ ID NO: 24380 - RNA, 393 nt, Artificial Sequence
  derived and/or modified sequence opt3 from anti-HIV_10E8
gaggugagacuggccgaaagcggcgggggacucgucaagcccgguggcucccuuaggcugucuugcucagcuaguggguucgacuuugauaacgcauggaugaccuggguucggcagccuccaggaaaaggcuuggagugggugggucgcaucacagggccgggagaaggcuggagcguagacuacgccgcgcccguggagggccgauucacuauuucccguuuaaauucuauaaacuuucuguaucuagaaaugaauaaccucagaauggaggauucggggcuguacuucugugcuaggacgggaaaguauuacgacuuuuggucagguuauccuccaggcgaggaauacuuccaagauugggggcagggaacccuugucaucgugcccagc

SEQ ID NO: 24381 - RNA, 393 nt, Artificial Sequence
  derived and/or modified sequence opt3 from anti-HIV_10E8
gaggugagacuggucgaaagcggcgggggacucguuaagcccgguggcucccuuaggcugucuugcucagccaguggguucgacuuugauaacgcuuggaugaccugggugcggcagccuccaggaaaaggcuuggaguggguaggucgcaucacagggccgggagaaggcuggagcguggacuacgcagcccccgucgagggccgauucacuauuucccguuuaaauucuauaaacuuucuguaucuagaaaugaauaaccucagaauggaggauucggggcuguacuucugugcgaggacgggaaaguauuacgacuuuuggucagguuauccuccaggcgaggaauacuuccaagauugggggcagggaacccuugugaucguucccagc

SEQ ID NO: 24382 - RNA, 393 nt, Artificial Sequence
  derived and/or modified sequence opt3 from anti-HIV_10E8
gaggugagacuggucgaaagcggcgggggacucguuaagcccgguggcucccuuaggcugucuugcucagccaguggguucgacuuugauaacgcuuggaugaccugggugcggcagccuccaggaaaaggcuuggaguggguaggucgcaucacagggccgggagaaggcuggagcguggacuacgcagcccccgucgagggccgauucacuauuucccguuuaaauucuauaaacuuucuguaucuagaaaugaauaaccucagaauggaggauucggggcuguacuucugugcgaggacgggaaaguauuacgacuuuuggucagguuauccuccaggcgaggaauacuuccaagauugggggcagggaacccuugugaucguuagcagu

SEQ ID NO: 24383 - RNA, 393 nt, Artificial Sequence
  derived and/or modified sequence opt3 from anti-HIV_10E8
gaggugagacuggccgaaagcggcgggggacucgucaagcccgguggcucccuuaggcugucuugcucagcuaguggguucgacuuugauaacgcauggaugaccuggguucggcagccuccaggaaaaggcuuggagugggugggucgcaucacagggccgggagaaggcuggagcguagacuacgccgcgcccguggagggccgauucacuauuucccguuuaaauucuauaaacuuucuguaucuagaaaugaauaaccucagaauggaggauucggggcuguacuucugugcuaggacgggaaaguauuacgacuuuuggucagguuauccuccaggcgaggaauacuuccaagauugggggcggggaacccuugucaucgugagcagu

SEQ ID NO: 24384 - RNA, 393 nt, Artificial Sequence
  derived and/or modified sequence opt3 from anti-HIV_10E8
gaggugagacuggucgaaagcggcgggggacucguuaagcccgguggcucccuuaggcugucuugcucagccaguggguucgacuuugauaacgcuuggaugaccugggugcggcagccuccaggaaaaggcuuggaguggguaggucgcaucacagggccgggagaaggcuggagcguggacuacgcagcccccgucgagggccgauucacuauuucccguuuaaauucuauaaacuuucuguaucuagaaaugaauaaccucagaauggaggauucggggcuguacuucugugcgaggacgggaaaguauuacgacuuuuggucagguuauccuccaggcgaggaauacuuccaagauugggggcggggaacccuugugaucguuagcagu

SEQ ID NO: 24385 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagaagcuccaacauuggaaauaacaauguguucugguaccagcagcucccggguacugcacccaaacuucugauauaugacaacgauaagaggccuucuggcaucccagaccgguuuucggggucaaaaagcggaacgagugccaccuugggcauuacagguuuacaaacuggggaugaggcggacuacuauuguggaaccugggauuccucucugagcgcuggcggcguauucgggacaggaaccaaggugacuguccua

SEQ ID NO: 24386 - RNA, 336 nt, Artificial Sequence
  derived and/or modified sequence opt3 from anti-HIV-1_LightChain
cagagcgugcugacccaacccgccuccgucucuggcucaccugggcagaguaucacaauuagcugcacuggaacgaaguccgacauagguggcuacaaauauguuucuugguaccagcagcacccagggaaggcuccgaaaauccucauuuaugaugugaacaagagacccucgggaaucccugacagguucucaggcagcaaaagugguaccuccgcaacacuugggauuacuggacugcaaaccggcgaugaggccgacuacuauuguggcacaugggauaauucuuugagcaccgggggaguauuugguacuggcacaaaggugaccgucuua

SEQ ID NO: 24387 - RNA, 321 nt, Artificial Sequence
  derived and/or modified sequence opt3 from anti-HIV-1_LightChain
cagagcgugcugacccaacccccuuccgucucugccgcuccaggccagagaguuacaaucucaugcuucgggaguagguuuagcuccgugucuugguaccagcagcucccgggaacugcacccaaacuucugauuuaugagaacacgaagcggccuucggguauaccagaccgcuucucaggcagcaagagugggaccuccgccacauugggaaucacuggcuuacaaaccggugaugaagcggacuacuauugugggacaugggaucgaucucugagcgcuggaggcguauuuggcaccgggacuaaagugacaguccua

SEQ ID NO: 24388 - RNA, 333 nt, Artificial Sequence
  derived and/or modified sequence opt3 from anti-HIV-1_LightChain
cagagcgugcugacccaacccccuuccgccucuggcacaccagggcagacuaucacgauuucaugcaguggaagcuccucuaacauagguucgaaugacgucuacugguaucagcaccucccgggcaccacacccaagguugugaucuacaaaaacaauagaaggccuucagggauuccagaucgguucagcggaaguaaguccggcacuucugcuacccuugguaucacagggcugcagaccggagacgaggcagauuauuacuguggcacuugggaccgcagcuuguccgccggcgggguauuuggaacagguaccaaagugacggucuua

SEQ ID NO: 24389 - RNA, 327 nt, Artificial Sequence
  derived and/or modified sequence opt3 from anti-HIV-1_LightChain
cagagcgugcugacccaacccccuuccaugucugccgcuccaggccagaaggucacaaucucaugcagugggagcacuuccauuauaggaaacaauuacaucucuugguaucagcagcucccggguacggcacccaaacuucugauuuacgaggacaacaagagaccuucgggcaucccagauagguucucagggagcaaaaguggaaccuccgccacauugggcauuacugguuuacaaaccggggacgaagcggauuauuacuguggaacauggcacucuagccuguccgcuggcggcguuuuugggaccggaacuaaggugaca

SEQ ID NO: 24390 - RNA, 333 nt, Artificial Sequence
  derived and/or modified sequence opt3 from anti-HIV-1_LightChain
cagagcgugcugacccaacccccuuccgucucugccgcuccaggccucaagguuacaaucucaugcagugggaacacuagcaaugugggagacaacuucguauccugguacagauaucuuccggguacggcacccaaacuguugucuuacgaggaugacaagaggccuucgggcauuccagaucgguuuucagggagcaaaaguggaaccuccgccacauuaggcauaacuggucugcagaccggggacgaagcggauuauuacuguggaacaugggacucuagccuauccgcuggcggcguguucgggaccggaacuaaggucacagugcuc

SEQ ID NO: 24391 - RNA, 333 nt, Artificial Sequence
  derived and/or modified sequence opt3 from anti-HIV-1_LightChain
cagagcgugcugacccaacccccuuccgccucuggcacaccagggcagagagucacuaucucaugcaguggaagcuccucuaacauugguucgaauacgguuaacugguaccagcaguucccgggcaccgcucccaagcuccuuauauaugagaauaacaggcggccuucaggggugccagcacgcuuuagcggaaguaaauccggcacaucugccacucuggcgaucaccgguuugcaaacaggggacgaagcugauuacuauugugccaccugggacagcuccuuaucagcaggaggcguauucggcacugggacaaaggugaccguccug

SEQ ID NO: 24392 - RNA, 318 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacgagaauaacaagagaccuucaggcaucccagacagguucagcgggaguaaauccggaacgucugccaccuugggcauuacagguuuacaaacuggggaugaagcggacuauuacuguggaaccugggauaauagccuguccacaggcggcguauuugggaccggaacu

SEQ ID NO: 24393 - RNA, 288 nt, Artificial Sequence
  derived and/or modified sequence opt3 from anti-HIV-1_LightChain
ggccugagccccucccucugcucugggucaaguagcaacaucggaaauaacuacguguccugguaucagcaacuuccugguaccgccccaaagcuguugauuuacgagaauacaaaaagaccgucuggcauacccgacagguucucggggucaaagagcggaacgagugcuacuuuaggcaucaccggucugcagacaggggaugaaggagacuauuacuguggcacuugggaucggucccuaucugcaggcggggucuuuggaaccgguacaaaaguuaccgugcuc

SEQ ID NO: 24394 - RNA, 333 nt, Artificial Sequence
  derived and/or modified sequence opt3 from anti-HIV-1_LightChain
caguucgugcugacccaacccccuagcgucuccgccgcuccaggccagagaguuacagugucuugcucagggacuacgagugacaucggagagaacuacguaagcugguaucagaaguuuuccgaagcagccccgaaacuccuucuguacgauaaugacaagaggcccucugguauuccugaucgguucucgggcucaaaaagcgggaccagugcgacauugggaauaacuggcuuacagaccggugacgaggcugauuauuacugugggacaugggacuccucucugagcgccggaggcguguuuggcaccgggacuaaggucacagugcua

SEQ ID NO: 24395 - RNA, 327 nt, Artificial Sequence
  derived and/or modified sequence opt3 from anti-HIV-1_LightChain
cagagcgugcugacccaacccccuuccgucucugccgcuccaggccagaagguuacaaucucaugcagugggggaagcuccaacauugguaauuacuaugugucuugguaccuccagcuuccgggcacugcacccaaacuguugauauaugagaacaauaagagaccuucggggaucccagacagguucucaggaagcaaaaguggcacguccgccaccuuagguauuacagggcugcagacuggagaugaagcggacuacuauuguggcaccuggcacucuagccuauccgcuggcgggguauuuggaacagguaccaaggugacu

SEQ ID NO: 24396 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggaacaugagcaauauuggagacaacgcaguguccugguacagacagguaccggaggcgcccccucagcuccuuauauucgguaaugauaaaaggccaucuggcgugacugaccgguuuucggggucaaagagcggaacgagugccacccugggcaucacagguuugcaaacuggggaugaagcugacuauuacuguggaaccugggaucgcuccuuaucugccggcggcgucuucgggacaggaaccaaagugacuguucug

SEQ ID NO: 24397 - RNA, 336 nt, Artificial Sequence
  derived and/or modified sequence opt3 from anti-HIV-1_LightChain
cagagcgugcugacccaacccccuuccgucucuggcgccccagggcagagaguuacaaucucaugcacuggaaguagcuccaacauuggugcuggcuacgacgugcacugguaucuccagcuuccggggacggcacccaggcuguugauauacgauaaugacaagcggccuucuggaaucccagaucgcuucucgggcucaaaaagcgguaccagugccacauuagggauuacuggacugcagaccggcgacgaggcggauuauuacuguggcacauggcauuccucucuaagcgcugggggaguauuugguaccggcacuaaggugacaguccuc

SEQ ID NO: 24398 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcacuuccaacauuggaaauaacuucgugucuugguaccagcagcucccggguacggcacccaaacuucuguuuuaugacaauuacaagagaccuucgggcauaccagauagguucucagggagcaaaaguggaaccuccgccacauuggcgaucacuggcuuacaaaccggugacgaggcugauuauuacugugccacaugggacucuagccuguccgcagggggaguauuuggcaccggcacuaaggugacaguccua

SEQ ID NO: 24399 - RNA, 336 nt, Artificial Sequence
  derived and/or modified sequence opt3 from anti-HIV-1_LightChain
cagagcgugcugacccaacccccuuccgucucuggcgccccagggcagagaguuacaaucucaugcacuggagguaguagcaacauuggcgcuggguacgacgugcacugguaucagcaucucccgggaacggcaccccagcuucugauauacgagaauaccaagaggccuuccggcaucccagaucgguucucugguucgaaaucagggacaagcgccacuuugggaauuaccggcuuacaaacaggcgacgaagcggauuauuacugugggaccugggaccgcagucuguccgcuggagguguauuuggcacugggacaaaggugaccguccua

SEQ ID NO: 24400 - RNA, 333 nt, Artificial Sequence
  derived and/or modified sequence opt3 from anti-HIV-1_LightChain
cagagcgugcugacccaacccccuucccucucugccgcuccaggccagagagucacaguuucaugcagugggagcuccucuaacaucggagacaauuacgugucgugguaucagcagcuuccgggugcagcccccaggcuguugauuuacgagaacaauaagcggccuucaggcauaccagaucgcuucagcgggaguaaauccggaacuucugcgacguuaggcaucaccggucugcaaacaggggacgaagcugauuauuacuguggaacuugggacaacagccuauccaccggcggcguauuugggacaggaaccaaggugacuguccuc

SEQ ID NO: 24401 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagaagcuccaacauuggaaauuacuucgugucuugguaucagcaguuuccggguacugcacccaaacuccuuauauacgacaacaauaagaggccuucgggcaucccagaucgguucucagggagcaaaaguggaacguccgccacccugggcauuacagguuugcaaacuggggacgaggcggauuauuacuguggaaccugggaccgcucuuuaagcgcuggcggcguauuugggacaggaaccaaggugacuguccug

SEQ ID NO: 24402 - RNA, 333 nt, Artificial Sequence
  derived and/or modified sequence opt3 from anti-HIV-1_LightChain
cagagcgugcugacccaacccccuuccgccucuggcacaccagggcagagagucacuaucucaugcaguggaagcuccucuaacauugguucgaaugcuguucacugguucaggcagcucccgggcacggcacccaaacuucugauauacgagaacaauaagcggccuucagggaucccagaccgcuuuagcggaaguaaguccggcaccucugccacauuggguauuacuggguuacagaccggagaugaagcggacuauuacugugcuacaugggauagcucccugucagccggcggcguguucgggaccggaacuaaaguaacagugcua

SEQ ID NO: 24403 - RNA, 333 nt, Artificial Sequence
  derived and/or modified sequence opt3 from anti-HIV-1_LightChain
cagagcgugcugacccaacccccuuccgucucugccgcuucaggccagaagguuacaaucaguugcagcggguccucuucgaacauuggaaauaacuacgugucaugguaucaccagcucccagguacugcaccgaaacuucugauauacgacacgaauaagagacccagcggcaucccugauagguucaguggguccaccucuggaacaagcgccacuuugggcauuaccgguuuacagacaggggacgaggcggauuauuacuguggaaccugggacaacucccugucaacuggcggcguauuugggacaggaaccaaagugacgguccua

SEQ ID NO: 24404 - RNA, 333 nt, Artificial Sequence
  derived and/or modified sequence opt3 from anti-HIV-1_LightChain
cagcccgugcugacccaaccuccaagcgucuccgccgcuccgggccagacaguuacuaucucuugcucagggaguuucagcaacauugagacgaauuacguguccugguaucagcagcuccccggaaccgcaccuaaacuucugauauacgacaacaauaugagaccaucugguauccccgauagguuuucgggcucaaagagcgggacaagugccacuuugggaauuaccggcuuacaaacaggugacgaagcggauuauuacugugggaccugggacacuucccugucugcuggaggcguauucggcacagggaccaaggugacgguccua

SEQ ID NO: 24405 - RNA, 336 nt, Artificial Sequence
  derived and/or modified sequence opt3 from anti-HIV-1_LightChain
cagcccgugcugacccaaccuccaagcgucuccggcgccccggggcagagaguuacaaucucuugcacuggaucaaguagcaacauuggugcuggcuacgacgugcacugguaucagcagcuccccgggacggcaccuaaacuucugauauacgagaauaacaagaggccauccggaauccccgaucgguucucuggcucgaagucagguaccagcgccacauuggggauuacuggauuacaaaccggcgacgaagcggauuauuacuguggcacaugggacaauagucuguccaccgggggaguauuugguacuggcacaaaagugaccguccua

SEQ ID NO: 24406 - RNA, 333 nt, Artificial Sequence
  derived and/or modified sequence opt3 from anti-HIV-1_LightChain
cagagcgugcugacccaacccccuucccucucugccgcuccaggccagagaaucacaauuucaugcagugggagcuccucuaacauaggaaauaacuacgucucgugguaucagcaguucccggguacugcacccaaacuucugaucuacgagaauaacaagaggccuucaggcauuccagaccgguuuagcgccaguaaguccgggacgucugcgaccuugggaaucacaggcuuacaaacuggugaugaagcuaauuauuacugugggaccuggcacagcucccugucagccggaggcguuuucggcacagggaccaaagugacuguacua

SEQ ID NO: 24407 - RNA, 333 nt, Artificial Sequence
  derived and/or modified sequence opt3 from anti-HIV-1_LightChain
cagagcgugcugacccaacccccuuccgucucugccgcuccaggccagagaguuacaaucucaugcuucgggaguagguuuaacgugggaacuagcuccguaucuugguaccagcagcucccggguacggcacccaaacuucugauugacgccaauggcgagcggccuucggggauaccagaucgcuucucaggaagcaagaguggcaccuccgcgacauuggguaucacuggguuacaaaccggagacgaagcugauuauuacuguggcacaugggacucuagccuguccgccggcgggguguuuggaaccgguacuaaggucacagugcua

SEQ ID NO: 24408 - RNA, 333 nt, Artificial Sequence
  derived and/or modified sequence opt3 from anti-HIV-1_LightChain
cagagcgugcugacccaacccccuuccgucucugccacaccaggccagaagguuacuaucucaugcagugggagcagauccaacauuggaucucacuacgugucgugguaucagcaguucccggguacggcucccaaacuccuuauauacgacaauaacaagaggccuucaggcaucccagaucgguuuagcgggaguaaauccggaaccucugcaacacugggcauuacugguuugcaaaccggggacgaggccgauuauuacuguggaacauggcauagcuccuuaucagcgggcggcguauucgggaccggaacuaaggugacaguccug

SEQ ID NO: 24409 - RNA, 333 nt, Artificial Sequence
  derived and/or modified sequence opt3 from anti-HIV-1_LightChain
cagagcgugcugacccaacccccuuccgccucuggcacaccagggcagagagucacuaucucaugcaguggaagcuccucuaacauugguucgaaucacguuuacugguaucagcagcucccgggcaagacgcccaaacuucugauauacaggaacaaucaacggccuucagggaucccagaccgcuucagcggaaguaaguccggcaccucugcuacauuggguauuacuggguuacagaccggagaugaggcagacuauuacuguggcacaugggauagcucccugucaaccggcgggguguuuggaacugguacaaaaguaaccgugcua

SEQ ID NO: 24410 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcuccgcaaacauuggaaauaacuacgugucuugguaucagcaguucccggguacuggccccagacucauaaucuacgagucgaauaaaaggccuucagggauuagcgaccgguuuaguggaucccaaucugaugccgcggcuacgcuugacaucaccggccugcagacaggugaugaagccgacuauuacugugggacuugggauagcuccuugucagcaggaggcguauucggcaccgggacacgcgugaccgucuua

SEQ ID NO: 24411 - RNA, 336 nt, Artificial Sequence
  derived and/or modified sequence opt3 from anti-HIV-1_LightChain
cagagcgugcugacccaacccccuuccgucucuggcgccccagggcagacaguuacuaucucaugcacgggagacaccaguaacauuggugcugauuacagagugcacugguaucagcagcucccgggcacagcacccaaacuucugauauacgagaauaacaagaggccuagcgggaucccagaccgguucuccggaucuaagucgggcacuucagccaccuuggguauuacaggguuacaaaccggagaugaagcggacuauuacuguggcacuugggauaauagccugaguacaggcgggguauuuggaaccgguacgaaagugacuguccua

SEQ ID NO: 24412 - RNA, 333 nt, Artificial Sequence
  derived and/or modified sequence opt3 from anti-HIV-1_LightChain
cagagcgugcugacccaacccccuucccucucugccgcuccaggccagagagucacaguuucaugcagugggagcuccucuaacaucggaaauaacuacgugucgugguaucagcagcuuccgggugcagcccccaagcuguugauuuacaauaacaauauaaggccuucaggcaucccagagcgguucagcgggaguaaauccggaacuucugcgacguuaggcauuaccggucugcaaacaggggacgaaggagauuauuacuguggcacuugggaccgcagccuauccgcuggcgggguauuuggaaccgguacaaaggugaccguccuc

SEQ ID NO: 24413 - RNA, 333 nt, Artificial Sequence
  derived and/or modified sequence opt3 from anti-HIV-1_LightChain
cagagcgugcugacccaacccccuuccgcgucuggcacaccagggcagagagucacuaucucaugcaguggaagcuccucuaacauugguggcaauuacguuucgugguaucagcagcucccggggacggcucccaaacuucugauaucagagaacaauaagaggccuagcggaaucccagaccgguucaguggcuccaagucugguaccagcgcaacauuggggauuacuggauuacaaaccggcgaugaagccgacuacuauuguggcacaugggauuccucacugagugccgggggaguguuugguaccggcacuaaaguaacagugcua

SEQ ID NO: 24414 - RNA, 333 nt, Artificial Sequence
  derived and/or modified sequence opt3 from anti-HIV-1_LightChain
cagagccugcucacccaacccccuuccgugucugccgcuccaggccagaaggucacaaucucaugcagugggagcuccucuaacauuggaaauaacuucguuucgugguaccagcagcuuccggguacugcacccaaacuguugauauaugagaauaacaugagaccuucaggcaucccagacagguuuagcgggaguaaguccggaacgucugccaccuuaggcauuacaggucugcaaacuggggaugaagcggacuacuauuguggaaccugggauagcucccuaucagcuggcggcguguucgggacaggaaccaaaguaacugugcuc

SEQ ID NO: 24415 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggacuagcuccaacauugcaaauuacuaugugucuugguacagacagcucccgggaacggcccccaaacuucugauauaugagaacaauaagaggccuucggguaucccagaccgguucucaggcagcaaaagugggaccuccgcgacauugggaauuacuggcuuacagaccggugaugaagcugacuacuauugugggacaugggauucuagccuguccgccggaggcguauuuggcaccgggacuaaggugacaguccua

SEQ ID NO: 24416 - RNA, 333 nt, Artificial Sequence
  derived and/or modified sequence opt3 from anti-HIV-1_LightChain
cagcccgugcugacccaaccuccaagcgucuccggcgccccggggcagagaguuacaaucucuugcucaggaaguagcuccaacauugguaauaacgacgugucuugguaccagcagguacccggcacugcuccuaagcuccuuauauaugagaauaacaaaaggccaucggggauccccgaucgguucucaggaagcaagaguggcacguccgcaacccuggguauuacaggguugcaaacuggagacgaagccgauuacuauuguggcaccugggacacaucuuuaagcgcgggcgggguguuuggaaccgguacuaaagucacagugcug

SEQ ID NO: 24417 - RNA, 333 nt, Artificial Sequence
  derived and/or modified sequence opt3 from anti-HIV-1_LightChain
cagcuggugcucacccaacccccuagcgucuccgccgcuccaggccagagaguuacaaucucuugcuucgggucaagguuuaacgugggaacgaguagcguauccugguaccagcagcuuccggguacugcacccaagcuguugauugacgccaauggcgagcggccuucugggauaccagaucgcuucuuuggaucggaaucaggcaccagcgcgacauuagguaucacugggcugcaaaccggagacgaggcugauuauuacuguggcacauggcacaguucccuaucugccggcgggguguucggaaccgguacuaaagucacagugcuc

SEQ ID NO: 24418 - RNA, 333 nt, Artificial Sequence
  derived and/or modified sequence opt3 from anti-HIV-1_LightChain
agcuacgagcugacccagcccccuuccgugucugccgcuccaggccaaaaggucacaaucucaugcagugggagcuccucuaacauuggaaauaacuauguuucgugguaccagcagcucccggguacugcacccaaacuucugauauaugaaaauaacaagagaccuucaggcaucccagacagguucagcgggaguaaauccggaacgucugccaccuugggcauuacagguuuacagacuggggaugaggcggacuacuauuguggaaccugggauacaagccuguccgcuggcggcguguuugggaccggaacuaagguaacagugcua

SEQ ID NO: 24419 - RNA, 333 nt, Artificial Sequence
  derived and/or modified sequence opt3 from anti-HIV-1_LightChain
cagagcgugcugacccaacccccuuccgccucuggcacaccagggcagagagucacuaucucaugcaguggaagcacguccaacauugguaccuacuauguuucuugguaccagcagcucccgggcacagcucccaaacuucugauauaugagaauacuaagaggccuucggggaucccagaccgguucucaggaagcaagaguggcaccuccgcaacauuggguauuaccggguuacaaacuggagaugaaggcgacuacuauuguggcacaugggaucgcucucugagcgccgggggaguguuugguaccggcacgaaaguaacugugcua

SEQ ID NO: 24420 - RNA, 336 nt, Artificial Sequence
  derived and/or modified sequence opt3 from anti-HIV-1_LightChain
cagagcgcccugacccaacccgcuuccgugucugcaucaccuggccagaguaucgccauuagcugcacagggacuuccucugacgucggaucguacaacuauguuucaugguaccagcagcucccagguacggcgccgaaacuucugauauaugagaauaccaagagacccagcggcaucccugauagguucaguggguccaagucuggaacaagcgcuacuuugggcauuaccgguuuacaaacaggggacgaagccgauuacuauuguggaaccugggaccggucccugucagcaggcggcguguuugggacuggaacaaaaguaaccgugcua

SEQ ID NO: 24421 - RNA, 330 nt, Artificial Sequence
  derived and/or modified sequence opt3 from anti-HIV-1_LightChain
cagagcgugcugacccaacccccuuccgucucugccgcuccaggccagagaguuacaaucucaugcagugggggaagcuccaacauugguaauaaccacgugucuugguaccagcaucucccgggcagggcaccccagcuucugauauaugacacuacgcaacggccuucggggaucccagaucgcuucucaggaagcaagaguggcaccuccgccacauuggguauuacuggguuacagaccggagacgaggcggauuacuauuguggcacaugggacucuagccuguccaccggcgggguauuuggaacugguacaaaagugaccguc

SEQ ID NO: 24422 - RNA, 333 nt, Artificial Sequence
  derived and/or modified sequence opt3 from anti-HIV-1_LightChain
cagagcgugcugacccaacccccuuccgccucuggcacaccagggcagagagucacuaucucaugcaguggaagcuccucuaacauugguucgaaguacguuuguugguaucagcagcucccgggcacggcucccaaacuucugauauacaggaauaaccaacggccuucagggaucccagaccgcuucagcggaaguaaguccggcaccucugcaacauuggguauuacuggguuacagaccggagaugaggccgacuauuacugcggcacauggcacagcucccugucagcgggcgggguguuuggaaccgguacuaaaguaacagugcua

SEQ ID NO: 24423 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcaguggggacagcuccacuuucgagaacgauuacguguguugguaucagcagcucccgggaacggcacccaaacuucugauuuacgacaauaacaagagaccuucugguauaccagauagguuuucgggcucaaaaagcgggaccagugccacauugggaaucacuggcuuacaaaccggugacgaagcggauuauuacugcgggacauggcacuccucucugagcgcuggaggcguauucggcaccgggacuaaggugacaguccua

SEQ ID NO: 24424 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacggcaauucaaacagaccuagcgggguaccagacagguucaguggauccaagucuggcacgagcgccuccuuggcgaucaccgguuuacaagcugaggaugaagccgacuauuacugugggacaugggauucaagucugagcgcaggaggcguguuuggcacugggaccaaagucacagugcua

SEQ ID NO: 24425 - RNA, 333 nt, Artificial Sequence
  derived and/or modified sequence opt3 from anti-HIV-1_LightChain
cagagcgugcugacccaacccccuuccgucucugccgcuccaggccagacaguuacuaucucaugcagugggagcuccucuaacauuggaucgaauacggugaacugguaccagcagcucccggguaccgcacccaaacuucugauauaugagaauaacaagagaccuucaggcaucccagacagguucagcgggaguaaguccggaacaucugccacuuugggcauuaccgguuuacaaacaggggaugaagcggacuacuauuguggaaccugggauaauagccuguccacuggcggcguauuugggacaggaaccaaagugacgguccua

SEQ ID NO: 24426 - RNA, 336 nt, Artificial Sequence
  derived and/or modified sequence opt3 from anti-HIV-1_LightChain
cagagcgugcugacccaacccccuuccgucucuggcgccccagggcagagaguuacaaucuucugcacuggaucaaguagcaacguggguggcggguacgacguacacugguaucagcagcucccgggaacggcucccaaacuucugauuuacgagaauaacaagaggccuuccggcauaccagaucgguuuucugguucgaagucagggaccagcgcaacauugggaaucacuggcuuacaaaccggcgacgaagccgauuauuacugugggacaugggacaguucccugucugcgggagguguguucggcaccgggacuaaagucacagugcua

SEQ ID NO: 24427 - RNA, 333 nt, Artificial Sequence
  derived and/or modified sequence opt3 from anti-HIV-1_LightChain
cagagcgugcugacccaacccccuuccgucucugccgcuccaggccagaagguuacacucucaugcagugggagcuccucuaacaucggaaauaacucggugucaugguaccagcaguucccggguacugcacccaaacuucugauuuaugacagcgauaagagaccuaguggcauaccagacagguuuuccgggucuaaaagcggaacguccgccaccuugggcaucacagguuuacaaacuggggaugagggagacuacuauuguggcaccugggaucggucacugagugcgggcgggguauucggaacagguaccaaggugacuguccua

SEQ ID NO: 24428 - RNA, 333 nt, Artificial Sequence
  derived and/or modified sequence opt3 from anti-HIV-1_LightChain
cagagcgugcugacccaacccccuuccgccucuggcacaccagggcagaaggucacuaucucaugcaguggaagcuccucucagauugguucgaacucaguuuacugguaucagcaacucccgggcacgacccccaaacuucugauauacgggaauaaccagagaccuagcggaaucccagacagguucaguggcuccaagucugguacaagcgcuacuuuggggauuaccggauuacagacaggcgaugaggcagacuauuacuguggcaccugggauuccucacugagugccgggggaguguuugguacuggcacaaaaguaaccgugcua

SEQ ID NO: 24429 - RNA, 336 nt, Artificial Sequence
  derived and/or modified sequence opt3 from anti-HIV-1_LightChain
cagagcgcccugacccaacccgcuuccgugucuggcucaccugggcagaguaucacaauuagcugcacuggaacggguuccgacgucggcggguacaaccacguuucuugguaucagcagcauccaggaaaggcaccgaaacuccuuauauacgauaauaacaagagacccucgggcaucccugacagguucucagguagcaaaagugggaccuccgccacacugggaauuacuggcuugcaaaccggcgaugaggcggacuauuacugugggacauggcacucuagcuuauccgcuggagguguguuuggcaccgggacuaagguaacagugcug

SEQ ID NO: 24430 - RNA, 333 nt, Artificial Sequence
  derived and/or modified sequence opt3 from anti-HIV-1_LightChain
cagagcgugcugacccaacccccuuccgucucugccgcuccaggccagagaguuacaaucucaugcagugggagcggauccaacauuggugacagguucgugucuugguaccagcaccucccgggcacuguacccaaacuucugauauaugauaaugagcaucggccuucggggaucccagaccgcuuuucaggaagcaagaguggcacguccgcaaccuuggguauuacaggguuacagacuggagaugaagccgacuacuauuguggcaccugggauucuagccuguccgcgggcgggguguucggaacagguaccaaggucacugugcua

SEQ ID NO: 24431 - RNA, 333 nt, Artificial Sequence
  derived and/or modified sequence opt3 from anti-HIV-1_LightChain
cagagcgugcugacccaacccccuuccgucucugccgcuccaggccagaagaucacaauuucaugcagugggagcuccucuaacauaggaaaaucgguugugucaugguacagacaguucccggguacugcacccaagcuccuuaucuaugacacguacaaaaggccuagcggcauuccagaucgguuuaguggguccaagucuggaaccagcgccacacugggcaucacugguuugcagaccggggacgaggcggauuauuacuguggaacauggcacuccucauuaagugcuggcggcguauucgggaccggaacuaaagugacaguccug

SEQ ID NO: 24432 - RNA, 333 nt, Artificial Sequence
  derived and/or modified sequence opt3 from anti-HIV-1_LightChain
cagcccgugcugacccaaccuccaagcgccuccggcacaccggggcagagagucacuaucucuugcucaggaaguagcuccaacauugguggcaauacgguuaacugguaccagcaguuccccggggcugcaccuaggcuccuuauauaugaggacaauaagcggccaucuggaauccccgaucgcuuuucgggcucaaaaagcgguaccagugccacacuggggauuacuggauugcaaaccggcgacgaagcggauuacuauuguggcacaugggacuccucuuuaagcgcugggggaguguucgguaccggcacuaagguaacagugcug

SEQ ID NO: 24433 - RNA, 333 nt, Artificial Sequence
  derived and/or modified sequence opt3 from anti-HIV-1_LightChain
aacuucaugcugacccagccccacagcguguccgagucuccuggcaagacagucacuaucucaugcacgagaaguagcggguccguugccucuaauuacgugcaaugguaucagcagcucccaggaaccgcuccgaaacuucugauuuacgaaaacaauaagaggcccucggguauaccugaccgguuuucaggcagcaaaagugggacauccgcaacuuugggaaucaccggcuuacagacaggugaugaggccgacuauuacugugggaccuggcauucuagccuguccgcgggaggcguauucggcacugggacaaaggugaccguccua

SEQ ID NO: 24434 - RNA, 333 nt, Artificial Sequence
  derived and/or modified sequence opt3 from anti-HIV-1_LightChain
cagagcaugcugacccaacccccuuccgugucugccgcuccaggccagagagucacaguuucaugcagugggagcuccucuaacaucggaucgcacuucgugucaugguaccagcagcucccggguacugcacccaaacuucugauuuaugacaauagcaacaggccuagugccauaccagaucgguuuuccggcucuaagagcgggacguccgcgaccuugggaaucucaggcuuacauacaggugacgaggcugauuacuauugugccacuugggacaauagucugagcaccgggggaguauucggcacaggcaccaaggugacuguccua

SEQ ID NO: 24435 - RNA, 333 nt, Artificial Sequence
  derived and/or modified sequence opt3 from anti-HIV-1_LightChain
cagagcgugcugacccaacccccuuccgucucugccgcuccaggccagaagguuaucauuucaugcagugggggaagcuccaacauagguaauaacuucgugucuugguaccaccagcucccgggcacagcacccaaacuucugaucuaugagaauacuaagagaccuucgaaaauuccagccagguuuucagggagcaagaguggaacguccgcgaccuugggcaucacagguuuacagacuggggacgaagcugauuacuauuguggaaccugggacucuagccuguccgccggcggcguauucgggacaggaaccaaagugacuguccua

SEQ ID NO: 24436 - RNA, 315 nt, Artificial Sequence
  derived and/or modified sequence opt3 from anti-HIV-1_LightChain
cagagccugcucacccaacccccuuccgugucugccgcuccaggccagaaggucacaaucucaugcagugggagcuccucuaacauuggaaauaacuacguuucgugguaucagcagcuuccggguacugcacccaaacuguugauauacgagaauaacaagagaccuucaggcaucccagacagguucagcgggaguaaauccggaacgucugccaccuuaggcauuacaggucugcaaacuggggaugaagcggacuauuacuguggaaccugggauagcucccuaucagcuggcggcguguuugggacagga

SEQ ID NO: 24437 - RNA, 336 nt, Artificial Sequence
  derived and/or modified sequence opt3 from anti-HIV-1_LightChain
cagagcgcccugacccaacccgcuuccgugucuggcucaccugggcagaguaucacaauuagcugcacuggaacguccucugacauagguucguacucauucgucagcugguaucagcagcacccaggcaaggcaccgaaacucaucauuuacgauguuaacaagagacccagugggaucccugacagguuuuccggaucuaaaagcggcaccuccgccacacuugguauuacugggcugcaaaccggagaugaggcggacuauuacuguggcacaugggaucggucauugagugcuggcgggguguucggaaccgguacuaagguaacaguguua

SEQ ID NO: 24438 - RNA, 336 nt, Artificial Sequence
  derived and/or modified sequence opt3 from anti-HIV-1_LightChain
cagagcgugcugacccaacccccuuccgucucuggcgccccagggcagagaguuacaaucucaugcacuggaaacaguagcaauauuggugcuggcuucgacgugcacugguacaggcaucucccggggacggcacccaaacuucugauauaugagaacaccaagcggccuuccggaaucccagaucgcuuuucuggcucgaagucagguacaagcgccacuuuggggauuaccggauuacagacaggcgacgaagcggauuacuauuguggcaccugggaccgaagucuguccgcugggggaguauucgguacuggcacaaaagugaccguccua

SEQ ID NO: 24439 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggggaagcuccaacauugguaauuacuaugugucuugguaccuccagcuuccgggcgcagcccccaaacuguugauauaugacacugauaagagaccuucggggaucccagacagguucucaggaagcaaaaguggcacguccgcgaccuuagguauuacagggcugcagacuggagaugaggcugacuacuauuguggcaccugggaucggucucuaagcgccggcgggguauuuggaacagguaccaaggugacuguccuc

SEQ ID NO: 24440 - RNA, 333 nt, Artificial Sequence
  derived and/or modified sequence opt3 from anti-HIV-1_LightChain
cagagcgugcugaccagacccccuuccgucucugccgcuccaggccaaaagguuacaaucucaugcagugggaggagcuccaacauuggaaauaacuacgugucuugguaucagcagcucccgggugcagcccccaaacuucugauauacgagaauaacaagcggccuucgggcaucccagaccgcuucucagggagcaaaaguggaacuuccgcgacguugggcauuaccgguuuacagacaggggaugaagcugacuauuacuguggaacuugggauucuagccuguccgccggcggcguauuugggaccggaacaaaggugaccguccua

SEQ ID NO: 24441 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggacuauuagcaacauaggagcaaaucucguguccugguacagacagcuuccggguacgguacccaccgugcugauccacgagaacaauaaaaggccuucuggcauuccagaccgguucucggggucaaagagcggaacaagugccacuuugggcaucaccgguuuacagacaggggaugaagcggacuauuacuguggaaccuggcauuccucucugagcgcuggcggcgucuuugggacuggaacaaaagugaccguucua

SEQ ID NO: 24442 - RNA, 327 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcuccucuaacauuggaaauaacuucgugucgugguaccagcagcucccggguacugcacccaaacuucugauauaugagaauacgaagagaccuucaggcaucccagacagguuuagcgggaguaaauccggaaccucugccacauugggcauuacugguuuacaaaccggggaugaagcggacuacuauuguggaacaugggaucggagccuguccgcuggcggcguauucgggaccggaacuaaggugaca

SEQ ID NO: 24443 - RNA, 333 nt, Artificial Sequence
  derived and/or modified sequence opt3 from anti-HIV-1_LightChain
cagagcgugcugacccaaucccccucugucucagccgcuccuggccagagaguuacaaucaguugcagcgggggauccucuaacauugguucgaaugcagugucaugguaccagcagcucccaggcacugccccgaaacuucugauauauggggacacgaugaggcccagcggaaucccugaucgguucaguggcuccaagucugguaccagcgcgacauuggggauuacuggauuacaaaccggcgacgaggcugauuacuauuguggcacaugggaccgcucccugucagccgggggaguauuugguaccggcacuaaggugacaguccua

SEQ ID NO: 24444 - RNA, 333 nt, Artificial Sequence
  derived and/or modified sequence opt3 from anti-HIV-1_LightChain
cagagcgugcugacccaacccccuuccgucucugccgcuccaggccagcagguuacaaucucaugcagugggacuacgagcaacauuggaaccaauuacguguccugguaucagcaaaugccgcccgcagccccuaagcuccuuauauacgacaacaaaaagagaccaucugauauccccgacagguucucggguucaaaaagcggcacaagugcgacucuggggauuaccggauugcagacaggcgaugaggcugacuauuacugugguaccugggaucgguccuuaucugccgggggaguauuuggcacuggcacaaaggugaccguccug

SEQ ID NO: 24445 - RNA, 333 nt, Artificial Sequence
  derived and/or modified sequence opt3 from anti-HIV-1_LightChain
cagagcguggucacccaaucccccucugccucaggcacaccugggcagagaguuaucauuaguugcagcggauccucuucgaacauagguaauaucuacgugucaugguaucagcagcugccaggcacugcuccgaagcuccuuauuuacgagaacaauaaaaggcccagcgggaucccugaccgguucaguggauccaagucuggcacgagcgcaacccuggguauuacaggguugcaaacuggagaugaagccgacuauuacuguggcaccuggcacuccucauuaagugcgggcgggguauuuggaacagguaccaaagugacuguccug

SEQ ID NO: 24446 - RNA, 333 nt, Artificial Sequence
  derived and/or modified sequence opt3 from anti-HIV-1_LightChain
cagagcgugcugacccaacccccuuccaugucugccgcuccaggccagaaggucacaaucucaugcagugggagcacuuccauuauaggaaacaauuacaucucuugguaucagcagcucccggguacggcacccaaacuucugauuuacgaggacaacaagagaccuucgggcaucccagauagguucucagggagcaaaaguggaaccuccgccacauugggcauuacugguuuacaaaccggggacgaagcggauuauuacuguggaacaugggaccggucucugagcgcuggcggcguuuuugggaccggaacuaaggugacaguacua

SEQ ID NO: 24447 - RNA, 336 nt, Artificial Sequence
  derived and/or modified sequence opt3 from anti-HIV-1_LightChain
cagagcgcccugacccaacccccuuccgcuucuggcucaagagggcagagugugaucauuagcugcacaggaacuuccucugacgucgguguuuacaaccucgugucgugguaucagcagcuuccaggcacggcaccgaagcuguugauauacgagaauaacaaaaggcccucagggaucccugaucgguucagcggaaguaaguccggcaccucugccacauuagguauuacugggcugcaaaccggagacgaagcggauuauuacuguggcacauggcacagcucccuaucagcuggcgggguauuuggaaccgguacuaaagugacaguccuc

SEQ ID NO: 24448 - RNA, 333 nt, Artificial Sequence
  derived and/or modified sequence opt3 from anti-HIV-1_LightChain
cagagcgugcugacccaacccccuuccaugucugccgcuccaggccagucagucaguaucagcugcuccgggucuucggacaacauugagagaaaucagguuauauggcucagacaggugccgggagcagcccccacaguacuuaucauuuucaacaaucggcgcccuucaggugugccagaucgauuuagcggcagucguuccgggacuucugcgacgcugggaaucaccggcuugcaaacaggugacgaagcugauuacuauugugggacuugggacaggagcuuauccgccggaggcgucuucggcaccgggacaaaggugaccguucug

SEQ ID NO: 24449 - RNA, 333 nt, Artificial Sequence
  derived and/or modified sequence opt3 from anti-HIV-1_LightChain
cagagcgugcugacccaacccccuuccgucucugccgcuccaggccagacaguuacuaucucaugcagugggagcuucuccaacauugagacgaauuacgugucuugguaucagcagcucccgggaaccgcacccaaacuucugauauacgaaaacacaaagagaccuucggguaucccagacagguuuucaggcagcaagagugggacuuccgccaccuugggaauuacaggcuuacaaaccggugaugaggcggacuauuacugugggacuugggaucggucucugagcgcuggaggcguauucggcacagggaccaaagugacgguccua

SEQ ID NO: 24450 - RNA, 333 nt, Artificial Sequence
  derived and/or modified sequence opt3 from anti-HIV-1_LightChain
cagagccugcucacccaacccccuuccgugucugccgcuccaggccagaaggucacaaucucaugcagugggagcuccucuaacauuggaucgaaauacguuuguugguaucagcagcuuccggguacugcacccaagcuguugauauacgagaauacgaaaagaccuucaggcaucccagacagguucagcgggaguaaguccggaaccucugccacauuaggcauuacuggucugcaaaccggggaugaagcggacuauuacugcggaacaugggaucggagccuauccgcuggcggcguguuugggaccggaacuaaaguaacagugcuc

SEQ ID NO: 24451 - RNA, 336 nt, Artificial Sequence
  derived and/or modified sequence opt3 from anti-HIV-1_LightChain
cagagcgcccugacccaacccagauccgugucuggcucaccugggcagagugucacaaucagcugcacuggaacgaccuccgacguugguggcuacaacuaugugucuugguaccagcagcucccagggacagcuccgaaacuucugauuuaugagaauaacaagaggcccucgggaauaccugaucgguucucaggcagcaagagugguacuuccgcaaccuuggggaucacaggauuacaaaccggcgacgaagccgauuacuauuguggcacuugggacaauucucugagcacagggggaguauuugguaccggcacgaaagugacuguccua

SEQ ID NO: 24452 - RNA, 333 nt, Artificial Sequence
  derived and/or modified sequence opt3 from anti-HIV-1_LightChain
cagagcgugcugacccaacccccuuccgucucugccgcuccaggccagagaguuacaaucucaugcacuggguucacgaguaacauuggacucaauuacgugagcugguaucagcagguaccggguaccacacccaaacuugugauauuugagaacgacaggcgguuccugggcaucccugaucgcuuuuccgggucuaagucgggagcaucagccacuuugggcauuaccgguuuacaaacaggggacgaagcggauuacuauuguggaaccugggacagcagucuguccgcuggcggcgucuucgggacuggaacaaaggugaccguucua

SEQ ID NO: 24453 - RNA, 333 nt, Artificial Sequence
  derived and/or modified sequence opt3 from anti-HIV-1_LightChain
cagagcgugcuggcccaacccccuuccgucucugcugcaccaggccagaagguuaccaucucaugcagugggagaacaagcaacauuggaaauaacuacguguccugguaucagcagcucccggguacugcccccaaacuucugauauacgagaauaacaagaggccuucuggcaucccagaccgguucucggggucaaaaagcggaacgagugcgaccuugggcauuacagguuuacaaacuggggaugaagcugacuauuacuguggaaccugggauacaucccugucugccggcggcguauuugggaccggaacuaaggugacaguccua

SEQ ID NO: 24454 - RNA, 333 nt, Artificial Sequence
  derived and/or modified sequence opt3 from anti-HIV-1_LightChain
cagagcgugcugacccaacccacauccgucucugccgcuccuggcagauggguuacugugucaugcagugggacgaggagcaacaucggagaccacuccguaucuugguuccagcaucucccaggugcagccccgaaacuucugauuuacgagaauaacaagcggcccucgggcauaccugaucgcuuuucagggagcaagaguggaaccuccgcgacauugggcaucacugguuuacagaccggggacgaagcugauuauuacuguggaacaugggacucuagccuguccaccggcggcguguucgggacuggaacaaaagucaccgugcua

SEQ ID NO: 24455 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcuccucuaacauuggagacaauuacgugucgugguaucagcaguucccggguacugcacccaaacuccuuauaucagagaacaauaagagaccuagcggcaucccagauagguuuaguggguccaaaucuggaacgagcgccacccugggcauuacagguuugcaaacuggggacgaagcggauuacuauuguggaaccugggacuccucauuaagugcuggcggcguauucgggacaggaaccaaggugacuguccug

SEQ ID NO: 24456 - RNA, 333 nt, Artificial Sequence
  derived and/or modified sequence opt3 from anti-HIV-1_LightChain
caggcccugcucacccaacccccuagcguguccgcugcaccaggccagaaggucacaaucucuugcucagggaguagcuccaacauuggaaauaacuacguuucuugguaucagcagcuuccggguacugcccccaaacuguugauaucggagaauaacaagagaccuucaggcaucccagacagguucagcgggaguaaauccggaacgucugcgaccuuaggcauuacaggucugcaaacuggggaugaagcugacuacuauuguggaaccugggauacaagccuauccgccggcggcguguuugggaccggaacuaagguaacagugcuc

SEQ ID NO: 24457 - RNA, 333 nt, Artificial Sequence
  derived and/or modified sequence opt3 from anti-HIV-1_LightChain
cagcuggugcucacccaacccccuagcgccuccggcacaccagggcagagagucacuaucucuugcucaggaaguacgagcaacauugguaccuacuauguuuacugguaucagcuucugccgggcacaacucccaagguguugauauacgcuaaugaccagaggccuuccgggaucccagaucgguucucuggaucgaaaucaggcaccagcgcaacauuagguauuaccgggcugcaaacuggagacgaggccgauuauuacuguggcacaugggacaguucccuaucuaccggcgggguauuuggaacggguacuaaggugaccguccuc

SEQ ID NO: 24458 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggacuagcuccaacauuggaaauaacuucgugucuugguaccagagacucccggguacggcacccaaacuucugauauuugagaaugacaagaggccuucgggcaucccagaucgguucucagggagcaaaaguggaaccuccgccacauugggcauuacugguuuacagaccggggacgaagcggauuauuacuguggaacaugggaccgcucucugagcgcuggcggcguauuugggaccggaacuaaggugacaguccua

SEQ ID NO: 24459 - RNA, 333 nt, Artificial Sequence
  derived and/or modified sequence opt3 from anti-HIV-1_LightChain
cagagcgugcugacccaaucccccucugucucagccacaccuggccagagaguuacuaucaguugcagcgggaacacguccaauauuggaaagaacuucgugucuugguaccagcaguuuccagguaccgcuccgaaacuccuuauauaugacaaugauaagaggcccucgggcaucccugaccgguucucagggagcaaaaguggaacauccgcaacucugggcauuaccgguuugcaaacaggggaugaggccgacuacuauuguggaaccugggauucuagcuuauccgcgggcggcguauuugggacuggaacaaaggugaccguccug

SEQ ID NO: 24460 - RNA, 333 nt, Artificial Sequence
  derived and/or modified sequence opt3 from anti-HIV-1_LightChain
cagagcgugcugacccaacccccuuccgucucugccgcuccaggcagagagguuaucauuucaugcagugggagcuccucuaacauaggaaauaaccacgugucgugguaccagcagcucccggguacagcacccaagguacuuaucuaugaaucaaauaaaaggcauagcggcauuccugaccgguucaguggguccaagucuggaacuagcgccacgcuggcgaucaccggcuugcagacaggugaugaggcugacuacuauuguggggccugggauuccucauuaagugcaggaggcguguuuggcacugggaccaaagucacagugcug

SEQ ID NO: 24461 - RNA, 333 nt, Artificial Sequence
  derived and/or modified sequence opt3 from anti-HIV-1_LightChain
cagagcgugcugacccaacccccuuccgccucuggcacaccagggcagagagucacuaucucaugcaguggaagcuccucuaacauuggugacucgacgguuaauugguaccagcagcucccgggcaccgcucccaaacuucugauauaugagaacacaaagaggccuucagggaucccagaucgguucagcggaaguaaguccggcacuucugcaaccuuggguauuacaggguuacaaaccggagacgaagccgauuacuauuguggcacuugggaccgcagccuguccgcgggcgggguguuuggaacagguaccaaaguaacggugcua

SEQ ID NO: 24462 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcacuuccaacauuggaaauaacuacgugucuugguaucagcagcucccggguacggcacccaaacuucugauauacgagaauaacagacaaccuucgggcaucccagacagguucucagggagcaagaguggaaccuccgccacauugggcauuacugguuuacagaccggggaugaaggagacuauuacuguggcacaugggaucggucucugagcgcgggcgggguauuuggaaccgguacuaaagugacaguccua

SEQ ID NO: 24463 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcuccucuaacauuggaucgaauuacgugucaugguaucagcagcucccggguacugcacccaaacuucugauauacgagaacaauaagagaccuagcggcaucccagacagguucaguggguccaaaucuggaacgagcgccaccuugggcauuacagguuuacaaacuggggaugaagcgguauauuacuguggaaccugggacuccucacugacagcuggcggcguguuugggaguggaaccaaggucacugugcua

SEQ ID NO: 24464 - RNA, 336 nt, Artificial Sequence
  derived and/or modified sequence opt3 from anti-HIV-1_LightChain
cagagcgugcugacccaacccccuuccgucucuggcgccccagggcagagaguuacaaucucaugcauuggaaguagcuccaacauaggugcugacuacagggugcacugguaucagcagcucccgggcacugcacccaaacuucugaucuacgagaauaacaagcggccuucugggauuccagaucgcuucucgggaucaaagagcggcacgagugccaccuuggguaucacaggguuacaaacuggagacgaagcggauuauuacuguggcaccugggacuccucucugagcacaggcgggguauuuggaaccgguacuaaagugacaguccua

SEQ ID NO: 24465 - RNA, 336 nt, Artificial Sequence
  derived and/or modified sequence opt3 from anti-HIV-1_LightChain
cagagcgugcugacccaacccccuuccgucucuggcgccccagggcagagaaucacaguuucaugcacuggaacgaguagcaacauuggugcuccguacgacgugaauugguaucagcagcuccccggcaccgcaccuaaacuucugauauacgagaacacaaagaggccauccgggauccccgaucgguucucuggaucgaagucaggcacuagcgccaccuuggguauuacaggguuacaaaccggagacgaagcggauuauuacuguggcacuugggaccgcagucuguccgcuggcgggguauuuggaacagguaccaaagugacgguccua

SEQ ID NO: 24466 - RNA, 333 nt, Artificial Sequence
  derived and/or modified sequence opt3 from anti-HIV-1_LightChain
cagagcgugcugacccaacccccugccauguccgcugcaccaggccagucugucacaaucucaugcagugggagcgccuucaacauugagagacaccagguuacuuggcucaggcaucuuccgggaacggcgcccaccuccgugauaaucaugaauaaccagcggccuucugguguaccagaccgcuuuucgggcucacgaagcgggacaagugcuacucugggaauuaccggcuugcaaacaggugaugaaggggacuacuauuguggaaccugggaucguuccuuaucugccggcggcguguucgggacuggaacaaaggucaccgugcug

SEQ ID NO: 24467 - RNA, 333 nt, Artificial Sequence
  derived and/or modified sequence opt3 from anti-HIV-1_LightChain
cagagcgugcuggcccaacccccuuccgcuucuggcaccccagggcagagagucacaaucucaugcaguggaagcgcauccaacauugguuucaauucuguuacuugguaccagcagcucccgggcacggcccccaccgugcuuauauaugggaacgaccugaggccuucgggaaucccagaucgguuuucaggcagcaagagugguacauccgcgacuuuggggauuaccggauuacaaacaggcgacgagggcgauuacuauugugggaccugggaccgcucucugagcgcuggagguguauucggcacugggacaaaagugaccguccua

SEQ ID NO: 24468 - RNA, 336 nt, Artificial Sequence
  derived and/or modified sequence opt3 from anti-HIV-1_LightChain
cagagcgcccugacccaacccgcuuccgugucuggcucaccuggggagaguaucacaauuagcugcacuggaacgagauccgacauagguaacuacgcauaugucucuugguaccagcagcucccaggcaccgccccgaaacuucugaucucggaaaauaacaagaggcccucagggauuccugaucgguucagcggaaguaaguccggcacaucugcgacuuuggguaucaccggguuacagacaggagacgaggcugauuauuacuguggcaccugggacagcucccugucagccggcgggguuuuuggaacugguacaaaagugaccguacua

SEQ ID NO: 24469 - RNA, 333 nt, Artificial Sequence
  derived and/or modified sequence opt3 from anti-HIV-1_LightChain
cagagcgugcugacccaacccccuuccgucucugccccaccgggccagaagguuacaaucucaugcagugggacuacgagcaacauuggauccaauuacguggcuugguaucagcagcuccccgguaccgcaccuaaacuucugauauacgacaacgauaagagaccaucuggcauccccgacagguucucggggucaaaaagcggaacaagugccacuuugggcauuaccgguuuacaaacaggggaugaggcggacuauuacuguggaaccugggaucggucccugucugcuggcggcguauuugggacuggaacaaaggugaccguccua

SEQ ID NO: 24470 - RNA, 333 nt, Artificial Sequence
  derived and/or modified sequence opt3 from anti-HIV-1_LightChain
cagagcgugcugacccaaucccccucugucucaggcacaccugggcagagaguuacuaucuucugcaguggaagcgacuccgauauugguauaaacucugugucgugguaccagcagcucccaggcacggccccgaaacuucugaucuaugacaauaacaagaggcccucagggauuccugaucgguuuagcggaaguaaguccggcaccucugcuacauuggguaucacuggguuacaaaccggagacgaggcagauuacuauuguggcacaugggaccgcagccuguccgccggcgggguauucggaaccgguacuaaagugacaguccua

SEQ ID NO: 24471 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggaacagcuccaauauuggaaacaauuacgugucuugguaucagcaccucccggguacugcacccaaacuucugauauacgagaacacgaagagaccuucgggcaucccagacagguucucagggagcaaaaguggaaccuccgccacauugggcauuacugguuuacagaccggggaugaagcggacuauuacuguggaacaugggaucggucucugagcgcuggcggcguauuugggaccggaacuaaggugacaguccua

SEQ ID NO: 24472 - RNA, 333 nt, Artificial Sequence
  derived and/or modified sequence opt3 from anti-HIV-1_LightChain
cagagccugcucacccaacccccuuccgugucugccgcuccaggccagaaggucacaaucucaugcagugggggaaacagcgacauugguaaaaauuucguuuccugguaccagcagcuuccgggcacugcacccaagcuguugauauaugagaacaauaaaagaccuucugggaucccagauagguuuucgggaucaaagagcggcacgagugccaccuuagguauuacagggcugcaaacuggagacgaagcggauuacuauuguggcaccugggacaacucccuaucuacaggcgggguguucggaaccgguacuaaaguaacagugcuc

SEQ ID NO: 24473 - RNA, 333 nt, Artificial Sequence
  derived and/or modified sequence opt3 from anti-HIV-1_LightChain
cagagcgugcugacccaacccccuuccgucucugccgcuccaggccagaagguuaucauuucaugcagugggagcuccucuaacauaggaaagaauuacguggcaugguaucagcagcucccggguacagcccccaaacuucugguauacgagaacacuaauagaccuucgggcaucccagacagguucucagggagcaaaaguggaacguccgcgaccuugggcauuacagguuuacaaacuggggaugaagcugacuauuacuguggaaccugggauucuagccuguccgccggcggcguguuugggacaggaaccaaggucacugugcua

SEQ ID NO: 24474 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcauguccgacauuggacucaacccggugucuugguacagacagcuucccgaggcaccuccacaccuguugauauucgauaaugacgaaaggcccucggguacugccggccgguuuucagcgagcaaaagugggacguccgcuaccuuagauaucacaggacugcagacuggcgacgaggccgauuauuacugugguaccugggacucuagccuauccgcagggggaguauucggcacaggcaccaaggugacuguccuc

SEQ ID NO: 24475 - RNA, 336 nt, Artificial Sequence
  derived and/or modified sequence opt3 from anti-HIV-1_LightChain
cagagcgcccugacccaacccgcuuccgugucuggcucaccugggcagaguaucacaauuagcugcacuggaacguccucugacgucgguucguacaaccucguuucaugguaucagcaguacccaggcagagcaccgaaacuucugauauaugagaauaacaagaggcccagcgggaucccugaucgguucaguggauccaagucuggcaccagcgccacauuggguauuacuggguuacaaaccggagacgaagcggauuacuauuguggcacaugggacaauucccugucaaccggcgggguguuuggaacugguacaaaaguaaccgugcua

SEQ ID NO: 24476 - RNA, 333 nt, Artificial Sequence
  derived and/or modified sequence opt3 from anti-HIV-1_LightChain
cagagccugcucacccaacccccuuccgugucugccucaccaggccagaaggucacaaucaguugcagcgggacuuccucuaacauuggaaauaacuacguuucgugguaucagcaguucccggguacggcucccaaacuucugauauacgagaauaacaagagaucaagcggcaucccugacagguuuaguggguccaaaucugauaccagcgcaacauugggaauuacuggcuuacaaaccggugacgaagccgauuauuacugugggacaugggaccggucccugucagcgggaggcguguucggcaccgggacuaagguaacagugcua

SEQ ID NO: 24477 - RNA, 336 nt, Artificial Sequence
  derived and/or modified sequence opt3 from anti-HIV-1_LightChain
cagagcgugcugacccaacccccuuccgucucuggcgccccagggcagagaguuacaaucucaugcacuggaaggcggaguaacauuggugcuggcuacgacgugcacugguaucagcagcucccggggacggcacccaaacuucugauauacgagaauaacaagcgcccuagcggaaucccagaucgauucuccggcucuaagucggguaccucagccacauuggggauuacuggauuacaaaccggcgacgaagcggauuauuacuguggcacaugggacaccagccugagugcugggggaguauuugguacuggcacaaaagugaccguccua

SEQ ID NO: 24478 - RNA, 333 nt, Artificial Sequence
  derived and/or modified sequence opt3 from anti-HIV-1_LightChain
cagagcgugcugacccaacccccuuccgucucugccgcuccaggccagagaguuacaaucucaugcagugggagcuccucuaacauuggaaauaacuucgugucgugguaccaguuuuucccggguacugcacccaagcucguaauauaugagaaugacaaaaggccuucaggcacgccagaucgguuuagcgggaguaaguccggaaccucugccacacuugcgaucauuggccugcagacuggugacgaaggggauuacuauuguggaaccugggacaacagcuuguccacaggcggcguguucgggaccggaacuaaagucacaguguua

SEQ ID NO: 24479 - RNA, 333 nt, Artificial Sequence
  derived and/or modified sequence opt3 from anti-HIV-1_LightChain
cagagcgugcugacccaacccccuuccgucucugccgcuccaggccagagaguuacaaucucaugcagugggggaagcuccaacauugguaauaaccacgugucuugguaccagcagcucccgggcacugcacccaaacuucugauaucggagaauaacaagaggccuucagggaucccagaccgguucagcggaaguaaguccggcacgucugccaccuuggguauuacaggguuacaaacuggagaugaagcggacuauuacuguggcaccugggauagcucccugucagcuggcgggguauuuggaacagguaccaaagugacuguccua

SEQ ID NO: 24480 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcuccucuaacauuggaagagacuucgugucgugguaccagcagguaccggguacugcacccaaacuccuuauauaugauaaugacaagaggccuucaggcaucccagaucgguuuagcgggaguaaauccggaacgucugccacccugggcauuacagguuugcaaacuggggacgaggcggauuacuauuguggaaccugggacagcuccuuaucagcuggcggcguguucgggacaggaaccaaggucacugugcug

SEQ ID NO: 24481 - RNA, 336 nt, Artificial Sequence
  derived and/or modified sequence opt3 from anti-HIV-1_LightChain
cagaccguggucacacaacccccuagcguuuccggcgccccagggcagacugcuacgaucucuugcaccggaucaaguagcaacauuggugcagacuacgaugugcacugguaucagcagcugccgggcacagcccccaagcuccuuauauacgacaauaacaaaagaccuuccgggaucccagauagguucucuggaucgaagucaggcacuagcgcgacccuggguauuacaggguugcaaaccggagacgaggcugauuauuacuguggcacuugggaccggaguuuauccgccggcgggguauuuggaacagguaccaaagugacgguccug

SEQ ID NO: 24482 - RNA, 333 nt, Artificial Sequence
  derived and/or modified sequence opt3 from anti-HIV-1_LightChain
aacuucaugcugacccagcccccuagcgccuccggcacaccagggcaaagagugacuaucucuugcucaggaaguagcuccaauauugguucuaacuacgucuauugguaccagcagcucccgggcacgacccccaaacuucugauauauaggaauaaccagcggccuucggggaucccagaccgcuuuucaggaagcaagaguggcacauccgcuacuuuggguauuaccggguuacaaacaggagaugaggcagacuacuauuguggcaccugggauucuagccuguccgccggcgggguuuucggaacugguacaaaggugaccguacua

SEQ ID NO: 24483 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcuccccgaacauuggaaauaacuuccucucuugguaccagcagcuucccgguacugcaccuaaacuguugauauaugagaauacgaagagaccaucgggcauccccgacagguuuucagggagcaaaaguggaaccuccgccacauuaggcauuacuggucugcaaaccggggaugaagcggacuacuauuguggaacaugggaucggucucuaagcgcuggcggcguguucgggaccggaacuaagguaacagugcuc

SEQ ID NO: 24484 - RNA, 333 nt, Artificial Sequence
  derived and/or modified sequence opt3 from anti-HIV-1_LightChain
cagagcgugcugacccaaucccccucugucucagccgcuccuggccagaagguuacaaucaguugcagcggguccucuucggacauuggaaacaauuucgugucaugguaccagcagcucccagguacugcaccgaaacuucugauauaugagaacaauaagagacccagcggcaucccugauagguuuaguggguccaaaucuggaacgagcgccaccuugggcauuacagguuuacaaacuggggacgaagcggauuacuauuguggaaccugggacuccucacugagugcuggcggcguauucgggacaggaaccaaggugacuguccua

SEQ ID NO: 24485 - RNA, 333 nt, Artificial Sequence
  derived and/or modified sequence opt3 from anti-HIV-1_LightChain
caguucuuucugacccaacccccuagccucuccgccacaccaggccagagagugucuaucucaugcagugggggagguagcaacauugcuaauaacgacgucuucugguuucagcaguucccgggcgcagggcccaggcuucugauauacgauaauuugaagcggcacuauggaacuccugaccgcuuuuccggcucuaaaucggguacgucagccaccuuagggaucacaggacugcaaacuggcgaugaggcggacuacuauuguggcaccugggauaacagccuaaguacagggggaguuuucgguaccggcacuaaggugacaguacuc

SEQ ID NO: 24486 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcggaccgaacauugguuccaauucugugucgugguaccagcacuuccccggcacugcaccuaaacuccuuauauaugacaacaauaagagaccaucagggauccccgauagguuuagcggaaguaaauccggcacgucugccacccuggguauuacaggguugcagacuggagacgaggcggauuacuauuguggcaccugggaccggagcuuauccgcuggcgggguauucggaacagguaccaaggugacuguccug

SEQ ID NO: 24487 - RNA, 333 nt, Artificial Sequence
  derived and/or modified sequence opt3 from anti-HIV-1_LightChain
cagagcgugcugacccaaucccccucugccucaggcacaccugggcagagagucacuaucaguugcagcggauccucuucgaacauugguucaaauacgguuagcugguuccagcaccucccaggcaccgcuccgaaacuucugauauacgagaacaauaagaggcccagugggaucccugaccgguuuuccggaucuaagagcggcacauccgcaacuuuggguauuaccggguuacagacaggagaugaagccgacuauuacuguggcaccuggcauucaagucugagcgcgggcgggguguucggaacugguacaaaaguaaccgugcua

SEQ ID NO: 24488 - RNA, 333 nt, Artificial Sequence
  derived and/or modified sequence opt3 from anti-HIV-1_LightChain
cagagcgugcugacccaacccccuuccgucucuggcgccccagggcagaacguuaucauuucaugcaguggaagcuccucuaauauagguaagaacuacguggcuugguaucagcagcucccgggcacagcacccaaaaucguaauuuacgagacuacgaauagaccuucggggaucccagccagguucucaggaagcaagaguggcaccuccgcgacacuugguauuacugggcugcaagcuggagacgaagccgauuauuacuguggcaccugggacucuagcuugaacgcaggcgggguguuuggaacagguaccaaagucacuguguua

SEQ ID NO: 24489 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcuccucuaacauuggaaauaacuuccucucgugguaccagcaccuuccggguacugcacccagacuguugauauaugacaaugaucagaggccuucaggcaucccagaccgguuuagcgggaguaaauccggaacgucugccaccuuaggcauuacaggucugcaaacuggggaugaggcggacuacuauuguggaaccuggcauagcucccuaucagcuggcggcguguucgggacaggaaccaagguaacugugcuc

SEQ ID NO: 24490 - RNA, 333 nt, Artificial Sequence
  derived and/or modified sequence opt3 from anti-HIV-1_LightChain
cagagcgugcugacccaacccccuuccgccucuggcacaccagggcagaaggucacuaucucaugcaguggaagcuccucuaacauugguaauaacuacguuucgugguaucagcagcucccgggcacggcucccaaacuucugauauacgagaauaacaagagaccuucagggaucccagacagguucagcggaaguaaauccggcaccucugcaacauuggguauuacuggguuacaaaccggagaugaagccgacuauuacuguggcacaugggauagcucccugucaaccggcgggguguuuggaacugguacaaagguaaccgugcua

SEQ ID NO: 24491 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggacuacgagcaacauuggaaaucacuacguguccugguaucagcaguucccggguaccgcacccaaacucauaaucuacgagacagacagaaggccuucuggcauuccagcccgguuuucggggucaaagagcggaaccagugcgacucuugcuaucgccggccugcaaacaggugaugaagcagacuauuacugugggaccugggauuccucuuugagcacuggaggcguauucggcacagggaccaaagugacggucuua

SEQ ID NO: 24492 - RNA, 333 nt, Artificial Sequence
  derived and/or modified sequence opt3 from anti-HIV-1_LightChain
cagcuggugcucacccaacccccuagcgucuccgccgcuccaggccagaagguuacaaucucuugcucagggaguagcuccaacauuggaaauaacuacgugucuugguaucagcagcuuccggguacugcacccaaacuguugauauacgagaauaacaagagaccuucgggcaucccagacagguucucagggagcaaaaguggaacguccgccaccuuaggcauuacaggucugcaaacuggggaugaagcggacuauuacuguggaaccugggauucuagccuauccacaggcggcguauuugggaccggaacuaaggugacaguccuc

SEQ ID NO: 24493 - RNA, 333 nt, Artificial Sequence
  derived and/or modified sequence opt3 from anti-HIV-1_LightChain
cagagcgugcugacccaacccccuuccgucucugccgcuccaggccagagaguuacaaucucaugcagugggggaagcuccaacauugguaauaaccacgugucuugguaccagcaucucccgggcagggcaccccagcuucugauauaugacacuacgcaacggccuucgcgcaucccagaucgauucucagggagcaagaguggaaccuccgccacauugggcauuacugguuuacagaccggggacgaggcggauuacuauuguggaacaugggacaauucucugagcaccggcggcguauuugggacuggaacaaaagugaccguccua

SEQ ID NO: 24494 - RNA, 333 nt, Artificial Sequence
  derived and/or modified sequence opt3 from anti-HIV-1_LightChain
cagagcgugcugacccaacccccuuccgucucugccgcuccaggccagaagaucacaauuucaugcagugggagcagauccaacauaggaaauaacuacguuucuugguaucagcaguucccggguacugcacccaaacuccuuaucuacgacaauaaccaaaggccuucgcggauuccagaucgcuuuucaggcagcaagagugggacguccgccacccugggaaucacaggcuugcagacuggugacgaggcggauuauuacugugggaccugggacucuagcuuauccgcuggaggcguguucggcacagggaccaaaguaacugugcug

SEQ ID NO: 24495 - RNA, 321 nt, Artificial Sequence
  derived and/or modified sequence opt3 from anti-HIV-1_LightChain
cagagcgugcugacccaacccccuuccgucucugccgcuccaggccagagaguuacaaucucaugcuucgggaguagguuuagcuccgugucuugguaccagcagcucccgggaacugcacccaaacuucugauuuauccuaacggugagcggccaucgggcauacccgaccgcuucuuugggucagaaagcggaacgagugccaccuugggcaucacagguuuacaaacuggggaugaggcggacuacuauugugcuaccugggauuccucucugagcgccggaggcguauucggcacagggaccaagcuaacugugcuc

SEQ ID NO: 24496 - RNA, 333 nt, Artificial Sequence
  derived and/or modified sequence opt3 from anti-HIV-1_LightChain
cagagcgugcugacccaacccccuucccucucugccgcuccaggccagaaggucacaaucucaugcagugggagcucccuuaacauuggaaaucacuacguuucuugguaucaacaggugccggguacugcacccaaacuguugauauacgaggacaacaagagaccuucgggcaucccagauagguucucagggagcaaaaguggaacguccgccaccuuaggcauuacaggucugcagacuggggacgaagcggauuauuacuguggaaccuggcauucuagccuauccgcuggcggcguauuugggacaggaaccaaggugacuguccuc

SEQ ID NO: 24497 - RNA, 333 nt, Artificial Sequence
  derived and/or modified sequence opt3 from anti-HIV-1_LightChain
caguucgugcugacccaacccccuagcgucuccgccgcuccaggccagaagguuacagugucuugcucagggacuacgagugacaucggagagaacuacguaagcugguaucagaaauuuccggaagcagcccccaagcuccuuauuuacgauaaugacaaaagaccuuccgguauaccagauagguucucuggcucgaagucagggaccagcgcgacacugggaaucacuggcuugcagaccggugacgaggcugauuauuacugugggacaugggaccggaguuuauccgccggaggcguguuuggcaccgggacuaaagucacagugcug

SEQ ID NO: 24498 - RNA, 333 nt, Artificial Sequence
  derived and/or modified sequence opt3 from anti-HIV-1_LightChain
cugagcgugcucacccagcccccuuccgucucugccgcuccaggccaacagguuacaaucucaugcagugggacuacgagcaacauuggaaccaauuacguguccugguaucagcagaugccgcccacagcaccuaaacuucugauauacgagaacaauaagagaccaucugguauccccgacagguucucgggcucaaagagcgggaccagugccacuuugggaauuacaggcuuacaaaccggugaugaagcggacuauuacugugggacuugggauuccucucugagcgcuggaggcguauuuggcacagggaccaaagugacgguccua

SEQ ID NO: 24499 - RNA, 336 nt, Artificial Sequence
  derived and/or modified sequence opt3 from anti-HIV-1_LightChain
cagagcaugcugacccaacccccuuccgugucuggcgccccagggcagagagucacaaucucaugcacuggaaguaggagcaacauuggugcuggcuacgacguucacugguaucuccagcuuccggggacggcacccaagcuguugauauacgagaauaacaaacggccuuccggaaucccagaucgcuucucuggcucgaagucagguaccagcgccacauuagggauuacuggacugcagaccggcgacgaagcggauuauuacuguggcacaugggacaauagucuauccaccgggggaguguuugguacuggcacaaaaguaaccgugcuc

SEQ ID NO: 24500 - RNA, 333 nt, Artificial Sequence
  derived and/or modified sequence opt3 from anti-HIV-1_LightChain
cagagcgugcugacccaacccccuuccgucucugccacaccaggccagaagguuacuaucucaugcagugggagcagauccaacauuggaucucacuacgugucgugguaucagcaguucccggagucagcucccacgcuccuuauauacgaaaauguagagaggccuagcgguaucccagaccgguuuaguggcuccaaaucugggaccagcgcaacacugggaauuacuggcuugcaaaccggugaugaagccgacuauuacugugggacaugggauuccucauuaagugcgggaggcguguucggcaccgggacuaaggucacagugcug

SEQ ID NO: 24501 - RNA, 333 nt, Artificial Sequence
  derived and/or modified sequence opt3 from anti-HIV-1_LightChain
caguucuuucugacccaacccccuagccucuccgccacaccaggccagagagugucuaucucaugcagugggggagguagcaacauugcuaauaacgacgucuucugguuucagcaguucccgggcgcagggcccaggcuucugauauacgauaauuugaagcggcacuauggaacuccugaccgcuuuuccggcucuaaaucgggugccacggggaccuuagagaucacagaaguucaaacugcggaugaggcugacuacuauuguggaaccugggauucaagccugagugccggcggcguguucgggacaggaaccaagguaacugugcua

SEQ ID NO: 24502 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggggaagcuccaacauuggugacaauucugugucgugguaccagcagcucccgggcacugcacccaaacuucugauauaugagaacaauaagagaccuucagggaucccagauagguucagcggaaguaaauccggcacgucugccaccuuggguauuacaggguuacaaacuggagacgaagcggauuacuauuguggcaccugggacagcucccugucaacaggcgggguauuuggaaccgguacuaaggugacaguccua

SEQ ID NO: 24503 - RNA, 333 nt, Artificial Sequence
  derived and/or modified sequence opt3 from anti-HIV-1_LightChain
cagagcgugcugacccaacccccuuccgucucugccgcuccaggccagacaguuacuaucucaugcagugggagcgcauccaacauuggaagaaauucugugucgugguaccaguauguaccgggugccgcgcccaagaggcucauauacgagaacaauaaacggccuucaggcaucccagaccgcuucagcgggaguaaguccggaacgucugcuacccuuggcauuacaggucugcagacuggggaugaagccgacuauuacuguggaaccugggauaccagcuuguccgcaggcggcguguuugggacaggaacuaaagucacaguguua

SEQ ID NO: 24504 - RNA, 333 nt, Artificial Sequence
  derived and/or modified sequence opt3 from anti-HIV-1_LightChain
cagagcgugcuggcccaacccccuuccgucucugcugcaccaggccagaagguuaccaucucaugcagugggagaacaagcaacauuggaaauuacuucguguccugguaucagcaguuuccggguacugcccccaggcuccuuauauacgacaacgaucaacggccuucuggcaucccagaccgcuucucggggucaaaaagcggaacgagugcgacccugggcauuacagguuugcagacuggggaugaggcugacuauuacuguggaaccugggauuccucuuuaagcgccggcggcguauuugggacaggaaccaaggugacuguccug

SEQ ID NO: 24505 - RNA, 333 nt, Artificial Sequence
  derived and/or modified sequence opt3 from anti-HIV-1_LightChain
cagagcgcccugacccaacccgcuuccgugucugcagccccuggccagaaggucacaaucucaugcagugggagcuccucuaacauuggaaauauauacguuucgugguaucagcagcucccagguacugcgccgaaacuucugaucuacgagaacaauaagagacccucaggcauuccugacagguucagcgggaguaaauccggaacgucugcuaccuugggcaucacagguuuacaaacuggggaugaagccgacuauuacuguggaaccuggcacagcucccugucagcaggcggcguguuugggacaggaaccaagguaacugugcua

SEQ ID NO: 24506 - RNA, 333 nt, Artificial Sequence
  derived and/or modified sequence opt3 from anti-HIV-1_LightChain
cagagcgugcugacccaacccccuuccgucucugccacaccaggccagagaguuacugugucaugcagugggagcuccucuaacaucggaaaucacuacguaucgugguaucaacaggugccggguacggcucccaagcuccuuauuuacgacaacucaaauaggccuagcggcauaccagaucgguucaguggguccaaaucuggaaccagcgcaacacugggcaucacugguuugcagaccggggacgaggccgauuauuacuguggaacaugggacuccucauuaagugcgggcggcgucuuugggaccggaacuaaggugacaguucug

SEQ ID NO: 24507 - RNA, 333 nt, Artificial Sequence
  derived and/or modified sequence opt3 from anti-HIV-1_LightChain
cagagcgugcugacccaacccccuucccucucugccgcuccaggccagagagucacaguuucaugcagugggagcuccucuaacaucggagacaauuacgugucgugguaucagcagcuuccgggugcagcccccaggcuguugauuuacgauaacucaauacggccuagcgcgaucccagcucgcuucaguggcuccaagucugggacuagcgccacguuagcaauuaccggacugcaaacaggcgacgaggccgauuauuacugugguacuugggacuccucacuaagugcugggggaguauuuggcaccggcacaaaagugaccguccuc

SEQ ID NO: 24508 - RNA, 336 nt, Artificial Sequence
  derived and/or modified sequence opt3 from anti-HIV-1_LightChain
cagagcgcccugacccaacccgcuuccgugucuggcucaccugggcagaguaucacaauuagcugcacuggaacguccucugacgucgguggcuacgauuauguuucgugguaccuccagcuuccagggaccgcaccgaagcuguugauauaugagaacaauaaaagacccucaggaaucccugacagguucagcggcaguaaguccgguacaucugccacuuuagggauuaccggacugcagacaggcgaugaagcggacuacuauuguggcaccugggauagcucccuaucagcugggggaguguuugguacuggcacaaaaguaaccgugcuc

SEQ ID NO: 24509 - RNA, 333 nt, Artificial Sequence
  derived and/or modified sequence opt3 from anti-HIV-1_LightChain
cagagcgugcugacccaacccccuuccgucucugccgcuccaggccagagaguuacagugucaugcagugggagcuccucuaacaucggaaauaacuacguaucgugguaucagcaguucccggguacugcacccaagcucgugauuuacgacacggauaaaaggccuucaggcauaccagaccgguuuagcgggaguaaguccggaaccucugccacacuuggcaucacuggucugcaaaccggggaugaggcggacuauuacugugcuacaugggauagcuccuugucagccggaggcgucuucggcaccgggacuaaagugacaguuuua

SEQ ID NO: 24510 - RNA, 336 nt, Artificial Sequence
  derived and/or modified sequence opt3 from anti-HIV-1_LightChain
cagagcgugcugacccaacccccuuccgucucuggcgccccagggcagagaguuacaaucucaugcacuggaaacaguagcaauauuggugcuggcuacgacgugcacugguaucagcagcucccggggacggcacccaaacuucugauauccgagaacaauaagaggccuucuggaaucccagaucgguucucgggcucaaagagcgguaccagugccacauuggggauuacuggauuacaaaccggcgacgaagcggauuacuauuguggcacaugggacuccucucugagcgcugggggaguauuugguaccggcacuaaagugacaguccua

SEQ ID NO: 24511 - RNA, 333 nt, Artificial Sequence
  derived and/or modified sequence opt3 from anti-HIV-1_LightChain
cagagcgugcugacccaacccccuuccgccucuggcacaccagggcagagagucacuaucucaugcaguggaagcuccucuaacauugguucgaauuacguugacugguaucagcagcucccgggcacggcucccaaacuucugauauacgagaacaauaagaggccuucagggaucccagaucgguucagcggaaguaaguccggcaccucugcaacauuggguauuacuggguuacaaaccggagacgaagccgauuauuacuguggcacauggcacagcucccugucagcgggcgggguguuuggaaccgguacuaaaguaacagugcua

SEQ ID NO: 24512 - RNA, 333 nt, Artificial Sequence
  derived and/or modified sequence opt3 from anti-HIV-1_LightChain
cagagcgugcugacccaacccccuuccgucucugccacaccaggccagacuguuacgaucucaugcagugggagcuccucuaacauuggaaauaacuaccucucgugguauagacagcuuccgaggaccgcucccaagcuguugauauacgagaauaaccggcgcccuucaggugugccagcacgauucagcggcaguaaauccgggacaucugccacuuuagcgaucaccggacugcagacaggcgacgaagcugauuauuacugugguaccugggacagcucccuaucagccgggggaguauuuggcacuggcacaaaggugaccguccuc

SEQ ID NO: 24513 - RNA, 321 nt, Artificial Sequence
  derived and/or modified sequence opt3 from anti-HIV-1_LightChain
cagagcgugcugacccaacccccuuccgucucugccgcuccaggccagagaguuacaaucucaugcuucgggaguagguuuagcuccgugucuugguaccagcagcucccgggaacugcacccaaacuucugauuuauccuaacggugagcggccaucgggcauacccgaccgcuucuuugggucagaaagcggaacgagugccaccuugggcaucacagcgguacaaacuggugaugaggcugacuacuauugugggaccugggaugacuccuuaucuacaggaggcguguucggcaccgggacuaaggucacagugcug

SEQ ID NO: 24514 - RNA, 333 nt, Artificial Sequence
  derived and/or modified sequence opt3 from anti-HIV-1_LightChain
cagagcgugcugacccaacccccuuccgucucugccgcuccaggccagaagguuacacucucaugcagugggacuagcuccaacaucggaaauaacuacgugucuugguaucagcagguaccgggugcagcccccaaagugcuuauuuacgagaaugacaagagaccuucgggcauaccagauagguucucagggagcaaaaguggaacguccgcgacccugggcaucacagguuugcaaacuggggacgaagcugauuauuacuguggaaccugggaccggucuuuaagcgccggcggcgucuuugggacaggaaccaaggugacuguucug

SEQ ID NO: 24515 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcaacuccaauauuggaaacaauuacgugucuugguaucagcagcucccggguacugcaacgaaacuucugauauacgagaacgacaagagacccucgggcaucccugauagguucucagggagcaaaaguggaaccuccgccacauugggcauuacugguuuacaaaccggggacgaagcggauuauuacuguggaacauggcacucuagccuguccgcuggcggcguauuugggaccggaacuaaggugacaguccua

SEQ ID NO: 24516 - RNA, 333 nt, Artificial Sequence
  derived and/or modified sequence opt3 from anti-HIV-1_LightChain
cagagcgugcugacccaacccccuucccucucugccgcuccaggccagcaggucucaaucaguugccuugggagaagcuccaacauuggaacaaauuacguuucuugguaucagcaauucccggguacugcacccaagcuguugauauacgagaacaaaaagaggccuucggaaaucccagaccgguuuucaggcagcaaaagugggacguccgccaccuuaggaauuacaggccugcagcccggugaugaggcggacuauuacugugggacuugggauucuagccuauccgcuggaggcguguucggcaccgggacaaagguaaccgugcuc

SEQ ID NO: 24517 - RNA, 336 nt, Artificial Sequence
  derived and/or modified sequence opt3 from anti-HIV-1_LightChain
cagagcgcccugacccaacccccuuccgcuucuggcucaccagggcagagugugacaaucagcugcacuggaacguccucugacgucggugcauacaacucgguuucaugguaucagcagcucccgggcaccgcccccaaacuucugauuagcgagaauaacaagagaccuagugggauaccagauagguucuccggaucuaagagcggcacauccgcgacuuuggguaucaccggguuacaaacaggagacgaagcugauuacuauuguggcaccugggacucaagucugagcgccggcgggguguuuggaacugguacaaaaguaaccgugcua

SEQ ID NO: 24518 - RNA, 333 nt, Artificial Sequence
  derived and/or modified sequence opt3 from anti-HIV-1_LightChain
cagagcgcccugacccaacccccuuccgcuucuggcucaccagggcagagugugacaaucagcugcuccggagguucuucgaacauuggcaauaaccacgucucaugguaccagcaucucccggggagagcaccccagcuucugauauaugacacuacgcaaaggccuagccggaucccagaucgcuucaguggaucccgaucuggcaccagcgccacauuggcgauuacugguuuacagaccggggacgaggcuguuuacuauuguggaacaugggauaauucccugucaaccggcggcguguuugggacuggaacaaagguaaccgugcua

SEQ ID NO: 24519 - RNA, 333 nt, Artificial Sequence
  derived and/or modified sequence opt3 from anti-HIV-1_LightChain
cagagcgugcugacccaacccccuuccgucucugccgcuccaggccagagaguuacaaucucaugcagugggggaacuagcaacauugguaaugaguacguguccugguaucagcagcucccgggcacggcacccaaacuucugauauacgaaaacaauaagaggccuucugggaucccagaccgguucucgggaucaaagagcggcaccagugccacauuggguauuacuggguuacaaaccggagaugaggcggacuauuacuguggcacaugggauuccucucugagcgcuggcgggguauuuggaaccgguacuaaagugacaguccua

SEQ ID NO: 24520 - RNA, 333 nt, Artificial Sequence
  derived and/or modified sequence opt3 from anti-HIV-1_LightChain
cagagcgugcugacccaacccccuuccgucucugccgcuccaggccagagaguuacagugucaugcagugggagcuccucuaacaucggaaauaacuacguaucgugguaucagcagcucccgggugcagcccccaaacuucugauuuacgacacugauaagaggccuucaggcauaccagaccgguucagcgggaguaaguccggaacgucugcgaccuugggcaucacagguuuacaaacuggggaugaggcugacuauuacuguggaaccugggaucgcagccuguccgccggcggcguguuugggacaggaaccaaagucacugugcua

SEQ ID NO: 24521 - RNA, 333 nt, Artificial Sequence
  derived and/or modified sequence opt3 from anti-HIV-1_LightChain
cagagccugcucacccaacccccuuccgugucugccgcuccaggccagaaggucacaaucucaugcagugggggaaacagcgacauugguaaaaauuucguuuccugguaccagcagucuccgggcgcagcccccagacuucugauauaugagaacgauaggcggccuucggggaucccagaccgcuuuucaggaagcaagaguggcacuuccgcgacguuggguauuaccggguuacaaacaggagaugaagcugacuacuauuguggcacuugggaucgaucucugagcgccggcgggguguucggaaccgguacaaaaguaaccgugcua

SEQ ID NO: 24522 - RNA, 333 nt, Artificial Sequence
  derived and/or modified sequence opt3 from anti-HIV-1_LightChain
cagagcgugcugacccaacccccuuccgucucugccgcuccaggccagaagguuaacaucucaugcagugggagcuccucuaauauugguaaaaacuacgugucgugguaucagcagauaccgggaacagcacccaagguacucaucuacgagaauaacaaaagaccuucaggcauuccagacagguucagcgggaguaaguccggaacuucugccacgcuuggcaucgcgggucugcaaaccggggaugaagcugacuauuacugugccacaugggauagcuccuugucagcaggaggcguguuuggcacugggaccaaagucacaguguua

SEQ ID NO: 24523 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcuccucuaacauuggaaauagacacgugucgugguaccagcagcucccggguacuguacccaaacuucugauauaugagacgaacaagaggccuucaggcaucccagaccgguucagcgggaguaaauccggaaccucugcaacauugggcauuacugguuuacaaaccggggaugaagccgacuacuauuguggaacaugggauaauagccuguccaccggcggcguguuugggacuggaacaaaggucaccgugcua

SEQ ID NO: 24524 - RNA, 336 nt, Artificial Sequence
  derived and/or modified sequence opt3 from anti-HIV-1_LightChain
cagagcgugcugacccaacccccuuccgucucuggcgccccagggcagagaguuacaaucucaugcacuggaaguagcuccaacauuggugcuggcuacgacgugcacugguaucagcagcucccggggacggcacccaaacuucugauauucggacaugauaagaggccuucuggcaucccagaccgguuuucggguucaaagagcgggaccagugccacauugggaauuacuggcuuacaaaccggcgaugaggcggacuacuauugugggacaugggauuccucucugagcgcuggagguguauucggcaccgggacuaaagugacaguccua

SEQ ID NO: 24525 - RNA, 333 nt, Artificial Sequence
  derived and/or modified sequence opt3 from anti-HIV-1_LightChain
cagagcgugcugacccaacuccccuccgccucuggccuuccugggcagacagucacuaucucaugcaguggaagcacguccucuauugguucgaaccacguuuacugguaucaacagguggcuggcaccgcaccaaagcuguugauauacgagaauaacaaaagaccgucagggauccccgacagguucagcggaaguaaguccggcacaucugccacuuuagguauuaccgggcugcagacaggagaugaagcggacuauuacugugcuaccugggauagcucccuaucagccggcggcguauuugggacuggaacaaaagugaccguccuc

SEQ ID NO: 24526 - RNA, 333 nt, Artificial Sequence
  derived and/or modified sequence opt3 from anti-HIV-1_LightChain
cagagcgugcugacccaaacacccuccgccucuggcgcuccugggcagggagucacuaucucaugcagugguagcuccucuaacguuggcagaaauuacgugucgugguaucagcagcucccagggacggcaccgaaacuucugauuuacgagaacaccaagaggcccucaggaauaccugaccgguucagcggcaguaaguccgguacaucugccacuuuggggaucaccggauuacaaacaggcgaugaagcggacuauuacuguggcaccugggaucgcagccuguccgcugggggaguauuugguacuggcacaaaagugaccguccua

SEQ ID NO: 24527 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcuccucuaacauuggaaauaacuacgugucgugguaucagcaguucccggguacugcacccaaacuccuuauaucagacaauaacaagagaccuagcggcaucccagauagguuuaguguauccaaaucugggacgagcgccacccugggaauuacaggcuugcaagcgggugacgaggcugauuacuauugugggacuugggacuccucauuaagugccggaggcguguucggcaccgggacaaaggucaccgugcug

SEQ ID NO: 24528 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcaacuccaauauuggaaacaauuacgugacuugguaucagcaguucccggguacggcacccaaaguacucauauacgacaacucuagaaggccuucgggcaucccagaucgguuuucagggagcaagaguggaaccuccgccacacuuggcauuacuggucugcaaaccggggacgaggcggauuauuacuguggaacaugggacucuagcuuguccgcuggcggcguguucgggaccggaacuaaagucacaguguua

SEQ ID NO: 24529 - RNA, 333 nt, Artificial Sequence
  derived and/or modified sequence opt3 from anti-HIV-1_LightChain
cagagcgugcugacccaacccccuuccgucucuggcgccccagggcagagaguuacaaucucaugcaguggaagcuccucuaacauugguaauaacuacgugucgugguaucagcagcucccgggcacugcucccaaacuucugauauacgagaauacgaagaggccuucagggaucccagaccgguucagcggaaguaaguccggcaccucugcaacauuggguauuacuggguuacaaaccggagaugaagccgacuauuacuguggcacaugggaucgcagccuguccgcgggcgggguauuuggaaccgguacuaaagugacaguccua

SEQ ID NO: 24530 - RNA, 333 nt, Artificial Sequence
  derived and/or modified sequence opt3 from anti-HIV-1_LightChain
cagagcgugcugacccaacccccuuccgucucugccgcuccaggccagacaguuacuaucucaugcagugggagcacguccaacauuggacagaauuuccucucuugguuucagcacgugccggguaccgcacccaaacuucugauauacgagaacaauaagagaccuucgggcaucccagacagguucucagggagcaagaguggaacauccgccacuuugggcauuaccgguuuacaaacaggggaugaagcggacuauuacuguggaaccuggcauucuagccuguccgcuggcggcguauuugggacuggaacaaaagugaccguccua

SEQ ID NO: 24531 - RNA, 333 nt, Artificial Sequence
  derived and/or modified sequence opt3 from anti-HIV-1_LightChain
aacuucaugcugacccagcccccuagcgccuccggcacaccagggcaaagagugacuaucucuugcucaggaaguagcuccaauauugguucuaaguacgucucgugguaucagcagcucccgggcacggcucccaaacuucugauauacgagaacaccaagaggccuucagggaucccagaccgguuuagcggaaguaaauccggcacaucugcaacuuuggguauuaccggguuacagacaggagaugaagccgacuauuacuguggcaccugggaucgcagccuguccgcgggcgggguuuucggaacugguacaaaggugaccguacua

SEQ ID NO: 24532 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcuccucuaacauuggaaauaacuacgugucgugguaucagcuccuuccggguacugcacccaaacuguugauauacgagaauaacaagagaccuucaggcaucccagacagguucagcgggaguaaauccggaacgucugccaccuuaggcauuacaggucugcagacuggggaugaagcggacuauuacuguggaaccugggauaauagccuauccacaggcggcguauuugggaccggaacuaaggugacaguccuc

SEQ ID NO: 24533 - RNA, 333 nt, Artificial Sequence
  derived and/or modified sequence opt3 from anti-HIV-1_LightChain
cagagcgugcugacccaacccccuuccgucucugccgcuccaggccagaagguuacaaucucaugcagugggagcuccucuaacauuggaaauaacuacgugucgugguaucagcagcucccggguacugcacccaaaauaaucauuuacgacaauaacaagagaccuucaggcaucccagauagguucagcgggaguaaauccggaacgucugccacccuuggcauuacaggucugcaaacuggggacgaggcggauuauuacuguggaaccuggcacagcuccuugucagcuggcggcguauuugggacaggaaccaaggugacugucuua

SEQ ID NO: 24534 - RNA, 333 nt, Artificial Sequence
  derived and/or modified sequence opt3 from anti-HIV-1_LightChain
cagagcgugcugacccaacccccuuccgccucugcuacaccaggccagagagucacuaucucaugcagugggagcuccucuaacauuggaucgaagcacguuuacugguaucagaaacucccggguacggcacccaaacuucugauauacgagaauaccaagaggccuucaggcaucccagaccgguucagcgggaguaaguccggaacaucugccacuuugggcauuaccgguuuacagacaggggaugaagcggacuauuacuguggaaccugggaucgcagccuguccgcuggcggcguguuugggacuggaacaaaaguaaccgugcua

SEQ ID NO: 24535 - RNA, 432 nt, Artificial Sequence
  derived and/or modified sequence opt3 from anti-HIV-1_HeavyChain
caggcccaacugguggagagcggcgggggagucguucagcccgguagaucccucaggcuuucuugcgcugcaucaggcuucaccuuuaguagcuacgggauccacugggugcggcaggccccuggaaagggccuggaauggguagcggugauguccucugacgguacauauaaauacuauggggauucgaugaagggacgcuucacuauuucacgagacaacagcaaaaauaguuuguacuuacagaugaacucccugcgugcugucgauacggccguguauuacugugcaaaggaccuaggcgagggcgaaaaugaggaaugggccaccgauuauuacgacuuuucuauaggguacccaggacaagauccgagagguguugugggcacauucgacaucugggggcagggaacuauggucaccgugagcucc

SEQ ID NO: 24536 - RNA, 426 nt, Artificial Sequence
  derived and/or modified sequence opt3 from anti-HIV-1_HeavyChain
caggugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguggccgucaucuccgacgaugguucuaacaaauauuacgcggacucggugaaggggcgcuucacaauuucacgagauaauagcaaaaacacuuuguauuuacagaugaauagucugcgugcugaggacacggccguuuacuauugugcaaaggaucuaggagaauccgagaacgaagagugggccucugacuacuaugauuuuggcagcgacuacccaggccaagauccgagagcuguggucggggcauucuggggacaggguaccauggugacaguauccuca

SEQ ID NO: 24537 - RNA, 432 nt, Artificial Sequence
  derived and/or modified sequence opt3 from anti-HIV-1_HeavyChain
caggugcaacuggucgagagcggcgggggaguugugcaguccgguagaucucucaggcuuucaugcgccgcuaguggcuucaccuuuagcgcauacgcccugcacuggguacggcaggcgcccgggaagggauuggaauggguggcugucaucuccuaugacggccgcgauaaagacuacgccgauucugugaagggucgauucacaauuucgcgugacaacagcaaaaauacuuuauaucugcagaugaacucacuaagagcagaggauacggccguuuacuauugugcuaaggaccucggggaaagugagaaugaagagugggcauccgauuacuaugacuuuggaucugauuacccuggccaagacccaagggccguggucggcgcuuucgauauaugggggcagggaaccauggugacaguaagcucc

SEQ ID NO: 24538 - RNA, 432 nt, Artificial Sequence
  derived and/or modified sequence opt3 from anti-HIV-1_HeavyChain
caggugcaacugguccagagcggcgggggacucguucagcccgguagaucccuuaggcugucuugcguggccucaggcuuccgguuuaguuuccacgggaugcauuggguacgccaggcuccuggaaagggcuuggaguggguggcagucgugagcgacgaugguuccgaccaaaaauacguugauucugugaaggggcgauuaaccaucucgcgugacaacagcaaaaauacagucuaucugcagaugaacucacuaagagccgaagauacugcgguguacuauugugcuaaggaccucggagagagugaaaaugaggaaugggccuccgauuacuaugacuuuggcucugauuacccaggccaggacccgagggcaguaguuggggccuucgauauuuggggacaggguacgauggugaccgucagcucc

SEQ ID NO: 24539 - RNA, 432 nt, Artificial Sequence
  derived and/or modified sequence opt3 from anti-HIV-1_HeavyChain
gaggugcaccuggucgaaagcggcgggggaguugugcagcccgguagaucccucaggcuuucuugcgccgcuucaggcuucaccuuuaacaguuacgcaaugaucuggguacggcaagccccugggaagggacuggaguggguggcggucauuagcuaugacggcaauaacaaauacuaugcugauuccgugaagggucgcuucacaauaucucgagaaaauucgaaaaacacuuuguacuuacagaugaacucacugcgugccgaggacacggcaguuuaucauugugccaaggaucuaggggaaagcgagaaugaggaaugggcuagugacuacuaugauuuuggaagagacuacccaggccaggauccgaggggcguggucgggaccuucgacaucuggggacacgguacaauggugacuguauccucu

SEQ ID NO: 24540 - RNA, 432 nt, Artificial Sequence
  derived and/or modified sequence opt3 from anti-HIV-1_HeavyChain
caggugcaacuggucgagagcggcgggggaguugugagacccgguggcucccucaggcuuucuugcaccgccucaggguuccacuuuaacaaguacggaaugaauuggguacggcaggcuccuggcaaaggucuggcauugguggccuucauccagaguggggcgagcuauaacuacuaugcugacuccgucaagggacgcuuuacaauuucucgagauaauucgaaaaacacuuuauaccugcagaugaacucacuacgugccgaagacacggcaguguauuacugugccaaggaucucggcgacagcgagaaugaagagugggcuagugauuauuacgacuucggcagagauuacccagggcaagacccgaggggaguugugggugcauuugauauauggggccaugggaccauggucacaguguccucu

SEQ ID NO: 24541 - RNA, 432 nt, Artificial Sequence
  derived and/or modified sequence opt3 from anti-HIV-1_HeavyChain
caggugcaccuggucgagagcggcgggggaguugugcaacccgguaagucccucaccaucuacugcgccguaucugaguucacacuuucaaacuaugcuaugcauugggugagacugacuccuggcaaaggguugcagugggucgcagugauuaguuacgacggaagcaauaaguauuacgccgauuccguuaaaggcagguuuacgauaucucgggacaacucgaagaauaccuuauaucugcagaugaacucacuacgcgcggaagauacagcuguguacuauugugccaaagaccucggugaaagcgagaaugaagagugggcaagugauuacuacgacuucgggcgagauuauccaggacaggacccgcguggcgucgugggcguauuugauaucugggggcaaggaacuaugguuaccguguccucu

SEQ ID NO: 24542 - RNA, 432 nt, Artificial Sequence
  derived and/or modified sequence opt3 from anti-HIV-1_HeavyChain
gaggugcagcugcucgaaagcggcgggggagucguucaacccgguagaucccuuaggcugucuugcgccgcuucaggcuucaccuuuaguacauacgcauugcacugggugcggcaggccccugggaagggauuagaguggguagcggugaucagcuaugacggcuccacuaaauucuacgcugauucugucaagggucgcuuuacgauuucgcgagacaacagcaaaaauacccuguaucuacagaugaacucacuccgugccgaagauacagcaguguacuauugugccaaggaccugggggagagugaaaaugaggagugggcuuccgauuacuaugacuucggaucugauuacccaggccaggacccgagagcaguugugggcgccuuugauauaugggggcaaggaacuauggucaccgugagcucc

SEQ ID NO: 24543 - RNA, 432 nt, Artificial Sequence
  derived and/or modified sequence opt3 from anti-HIV-1_HeavyChain
caggugcaacuggucgagagcggcgggggaguugugcagcccgguggcucccucagacuuucuugcgccgcuucaggguucaccuuuaguagcuacggaaugcacuggguaaggcaggcaccuggcaagggucuggaauggguggccuucauccgguaugacggguccaacaaauacuaugcggauucugucaagggacgcuuuacaauuucgcgagagaauagcaaaaauacuuuguacuuacagaugaacucacugcgugcugaagacacggccguguaucauugugcaaaggaucuaggcgagagugaaauagaggaguggaccuccgacuacuaugauuucggcagagacuacccagggcaagauccgaggggaguuuuugguacauucgacaucuggggccacgggacuauggugaccgucucuagc

SEQ ID NO: 24544 - RNA, 432 nt, Artificial Sequence
  derived and/or modified sequence opt3 from anti-HIV-1_HeavyChain
gaggugcagcuggucgaaagcggcgggggaguugugaagcccgguggcucccucagacuuucuugcguagugucaggguucaccuuuaguaacgccuggaugagcugggucaggcaagcuccuggaaaaggccuggaguggguggcaguuaucuccgacgaugguucuaauaaguacuaugccgacucggugaaagggcgguucacaauuucacgcgauaacagcaagaauacuuuguacuuacagaugaacagucugcgagcggaagacacggcugucuauuacugugccaaagaucuaggagaguccgaaaaugaggagugggcaucugacuauuacgauuuuggcagcgacuauccaggccaggauccgcgugccgugguaggggcuuucgacauauggggacaggguaccaugguuacaguguccuca

SEQ ID NO: 24545 - RNA, 432 nt, Artificial Sequence
  derived and/or modified sequence opt3 from anti-HIV-1_HeavyChain
caggugcaacuggucgagagcggcgggggaguugugcagcccgguggcucccucagacuuucuugcgccgcuucaggguucaccuuuaguacauacggaaugcacuggguaaggcaggcaccuggcaagggucuggaauggguggccuucauccgguaugacgggcgcaacaaaaauuacgcggauagcgucaagggacgauuuacuauuucccgugacaacucuaaaaauacguuguauuuacagaugaacucgcugagagcugaggauaccgccguguacuauugugcaaaggaccuaggcgaaucagagaaugaagagugggccacagauuacuaugacuucagcauaggcuacccagggcaagauccgaggggaguuguggguaucuuugacauuuggggccaggggacuauggucaccgugaguucc

SEQ ID NO: 24546 - RNA, 432 nt, Artificial Sequence
  derived and/or modified sequence opt3 from anti-HIV-1_HeavyChain
caggugcaccuggucgagagcggcgggggaguugugcaacccgguggcucccucagacuuucuugcgccgcuucaggguucaguuuuagcaucuacggaaugcauuggguaaggcaggcaccuggcaagggucuggaaugggugaccuucacacgguaugacggguccaacaaauacuauacugauucugucaagggacgcuuuacgauuucgcgagacaauucaaagaacaccuuguacuuacagaugaauagccugcguacagaggauacugccguguauuacugugcgaaagaccuaggcgaaagugagaacgaagagugggcuuccgauuauuacgacuucggcucugauuacccagggcaggacccgagagccguugugggagcauuugauauauggggucaaggcaccauggucacagugagcucc

SEQ ID NO: 24547 - RNA, 432 nt, Artificial Sequence
  derived and/or modified sequence opt3 from anti-HIV-1_HeavyChain
caggugcaacuggucgagagcggcgggggaguugugcagcccgguggcucccucagacuuucuugcgccgcuucaggguucaccuuuaguagcuacggaaugcacuggguaaggcaggcaccuggcaagggucuggaauggguggccuucauccgguaugacggguccaacaaauacuaugcggauccagucaagggacgcuuuacaauuucucgagacaauucgaaaaacacuuuguacuuacagaugaacucacugcgugcugaggauacggccguguauuacugugcaaaggaccuaggcgaaagcgagaaugaagagugggccagugauuauuacgacuucggcagagauuacccggggcaagaccccaggggaguugugggugucuuugauauauggggccaggggaccauggugacagcuuccucu

SEQ ID NO: 24548 - RNA, 432 nt, Artificial Sequence
  derived and/or modified sequence opt3 from anti-HIV-1_HeavyChain
gagaugcagcugguggaaagcggcgggggacucguccaacccgguggcucccuuagacugucuugcgccgcuucaggguucaccuuuaguagcuacuggauguccuggguuaggcaggcaccuggaaagggcuuggaguggguggccguaaucucuuaugacgguaacaauaaauacuaugcggauucggugaaggggcgguucacaauuucacgcgaaaacagcaaaaauacuuuauaccugcagaugaacagucuacgagcugaggacacggccgucuauuacugugcaaaggaucucggagaauccgagaaugaggaaugggccucugacuauuacgauuuuggcagcgacuacccaggccaggauccgcguggggugguuggaaccuucgacauauggggucacggcacaauggugacugucuccuca

SEQ ID NO: 24549 - RNA, 432 nt, Artificial Sequence
  derived and/or modified sequence opt3 from anti-HIV-1_HeavyChain
caggugcaacuggucgagagcggcgggggaguugugcagcccgguagaucccucaggcuuucuugcgccgcuucaggcuucaccuuuaguagcugugcaaugcacuggguacggcaggccccugggaagggacuggaauggguggcggucaucuccuacgacggcaacaauaaacauuaugcugauucugugaagggucgcuucacaauuucgcgagacaacagcaaaaauacuuuguacuuacagaugaacucacugcgugccgaggauauggcaguuuauuacugcgccaaggaccuaggggaaagugagaaugaagagugggcuuccgauuauuacgacuuuuggagagauuauccaggacaagacccgaggggcugggugggcacguucgauauaugggggcagggaaccauggucacagugucuagc

SEQ ID NO: 24550 - RNA, 432 nt, Artificial Sequence
  derived and/or modified sequence opt3 from anti-HIV-1_HeavyChain
caggugcaacuggucgagagcggcgggggaguugugcagcccgguagaucccucaggcuuucuugcgccgcuucaggcuucaccuuuaguaacuacgggaugcacuggguacggcaggcaccuggaaagggccuggaaugggugacagucaucagcuccgacgguucuaaaaaguauuacgccgauucggugaaagggcgcuucacuauuucacgagacaauagcaagaacacguuguauuuacagaugaauggacugcgugcggaugacaccgcuguuuacuauugugccaaagaucuaggcgacagugagaacgaagagugggcauccgauuacuaugacuuuggcagagauuacccagggcaagacccgaggggaguggucggugccuucgauauauggggccaugggacaauggugacuguaucuagc

SEQ ID NO: 24551 - RNA, 432 nt, Artificial Sequence
  derived and/or modified sequence opt3 from anti-HIV-1_HeavyChain
caggugcaacuggucgagagcggcgggggaguugugcagcccgguggcucccucagacuuucuugcgccgcuucaggguucaccuuuaguagcuacggaaugcacuggguaaggcaggcaccuggcaagggucuggaauggguggccuucauccgguaugacggguccaacaaauacuaugcggauucugucaagggacgcuuuacaauuucgcgagacaauucaaagaacacuuuguacuuacagaugaauagccugcgugcuguggauacggccguuuauuacugugcaaaagaccuaggcgagggcgaaaacgaggaaugggccaccgauuauuacgacuucaguauaggguacccaggacaagauccgagagguguggucggcgcuuuugacaucugggggcagggaacaauggugacuguauccucu

SEQ ID NO: 24552 - RNA, 432 nt, Artificial Sequence
  derived and/or modified sequence opt3 from anti-HIV-1_HeavyChain
caggugcaacuggucgagagcggcgggggaguugugcagcccgguaggucccucaggcuuucuugcgccgcuucaggcuucaccuuucggaacuacgggaugcacuggguacgccagaguccuggaaagggccuggaauggguggcagucaucagcuaugacgguaaaauuauaaauuacaucgauuucgugaaggggcgauuuacaauuucccgugagaacucuaaaaauacuuuguauuuacagaugaacucgcugagagccgaagacacggcgguuuacuauugugcuaaggaucuaggagagucagaaaaugaggagugggccagcgacuacuaugauuucggcagugacuacccaggccaagauccgagagggguggucggaaccuuugacaucuggggucauggcacaauggugacuguauccucu

SEQ ID NO: 24553 - RNA, 432 nt, Artificial Sequence
  derived and/or modified sequence opt3 from anti-HIV-1_HeavyChain
gaggugcagcugcucgaaagcggcgggggacuuguccaacccgguagaucccugagguugucuugcgccgcuucaggcuucaccuuuaguagcuacguuaugcacugggugcggcaggcaccugggaagggauuagaguggguagccgugaucuccuaugacggcucuaacaaacauuacgcggauucggucaagggucgcuucacaauuucacgagacaauagcaaaaacacucuguaucuacagaugaauagucuccgugcugaagauacggccguguacuauagagcaaaggaccugggggaguccgaaaacgaggagugggccucugauuacuaugacuuuggaagggauuacccaggccaggacccgcggggcguuguggggguccuuuacauauggggacaagguaccauggugacaguaagcucc

SEQ ID NO: 24554 - RNA, 432 nt, Artificial Sequence
  derived and/or modified sequence opt3 from anti-HIV-1_HeavyChain
gaggugcagcuggucgaaagcggcgggggacucguuaagcccgguggcucccuuagacugucuugcgccgcuucaggguucaccuuuaguacauacagcaugcacugggugaggcaagcaccuggaaaaggcuuggaguggguagccgugaucuccuaugacgguaacaauaaguacuaugcggauucugucaaagggcgguucacuauuucgcgcgaaaacucaaagaauacguuauaccugcagaugaacagccuacgagcugaggacaccgccguguaucauugugcaaaagaucucggagaaagugagaaugaggaaugggccuccgacuacuaugauuuuggccgugacuacccaggccaggauccgagagggguugugggaacauucgacauauggggucacggcacuauggucaccgugucuagc

SEQ ID NO: 24555 - RNA, 432 nt, Artificial Sequence
  derived and/or modified sequence opt3 from anti-HIV-1_HeavyChain
caggugcaacuggucgacagcggcgggggaguugugcagcccgguagaucccucaggcuuuucugcgccguaucuggcuuuaccuucucaacauacacuaugcacugggugcggcaggcuccugggcgcggacuggagugggucgcagugaucaguuaugauggcagcacgaaguacuaugccgacuccguucagggucgauuuaccauuucucgugauaacucgaaaaauacauuguacuuacaaaugaacucacugagagcggaagacacugcuguguauuacugugccaaggaucuaggggagagcgaaaaugaggaaugggcaagugacuauuacgauuucggauccgacuacccaggccaggauccgagggccgucgugggcgcuuuugacauaugggggcagggaaccaugguaacaguuucuagc

SEQ ID NO: 24556 - RNA, 426 nt, Artificial Sequence
  derived and/or modified sequence opt3 from anti-HIV-1_HeavyChain
caggugcaacuggucgagagcggcgggggaguugugcagcccgguaggucccucaggcuuucuugcgccgcuucaggcuucaccuuuaguagcuucgggaugcacuggguacggcaggcaccuggaaagggccuggaauggguggccgucaucuccuacgacgguaacaauaaauauuacgcggauucugugaaggggcgcuuuacaauuucgcgagagaacagcaaaaauacuuuguauuuacagaugaacucacugcguccagaagacacggcuguuuacuauugugccaaggaucuaggagagagugaaaaugaggagugggcauccgacuacuaugauuucggcagagacuacccgggccaagaucccagagggguggucggaaccuuugacauauggggucauggcacaauggugacugua

SEQ ID NO: 24557 - RNA, 432 nt, Artificial Sequence
  derived and/or modified sequence opt3 from anti-HIV-1_HeavyChain
caggugcaacuggucgagagcggcgggggaguugugcagcccgguaggucccucaggcuuucuugcgccgcuucaggcuucauguuuagucgguacgggaugcacuggguacgccaggcaccuggaaagggccuggaauggguggccgucaucagccaugacgguuccaacaaauauuacgcggauucugugaaggggcgauucauuauaucgcgugacaauucaaagaacaccuuguauuuacagaugaauagccugagagcugaugacacagccguuuacuauugugcaaaagaucuaggagagagugaaaacgaggaaugggccuccgacuacuaugauuuuuggaucggcuacccaggccaagacccgagagggguggucggagcuuucgauauuuggggucagggcacuauggugacgguaucuagc

SEQ ID NO: 24558 - RNA, 432 nt, Artificial Sequence
  derived and/or modified sequence opt3 from anti-HIV-1_HeavyChain
caggugcaacuggucgagagcggcgggggaguugugcagcccgguggcucccucagacuuucuugcgccgcuucagcauucaccuuuaguagcuacgggaugcacuggguaaggcaggccccuggaaagggccuggaauggguggcguucauccgguaugacgguuccaacaaauacuaugcugauucugucaaggggcgcuuuacaauuucgcgagacaauucaaagaacacuuuguucuuacagaugaauagccugcgugccgaggauauggcaguguacuauugugccaaagaccuaggagaaagugagaacgaagagugggcuuccgauuacuaugacuuuuggagagauuacccaggccaagacccgaggggcuggguugggacguucgauauauggggacaggguaccauggugacagucucuagc

SEQ ID NO: 24559 - RNA, 426 nt, Artificial Sequence
  derived and/or modified sequence opt3 from anti-HIV-1_HeavyChain
caggugcaacuggucgagagcggcgggggaguugugcagcccgguagaucccucaggcuuucuugcgccgcuucaggcuucaccuuuaguagcuucgggaugcacuggguacggcaggcaccuggaaagggccuggaauggguggccgucaucuccuacgacgguucuaacaaauauuacguggauucgguuaaggggcgcuuuacaauuucacgagacaauagcaaaaacacuuuguauuuacagaugaauagucugcgugcggaggauacggcuguguacgccaaggaccuaggagaauccgagaacgaagagugggcaucugauuauuacgacuucggcagcgauuauccaggccaagacccgagaggggucgugggaaccuuugauauauggucccaggguacaaugguaacuguuucaagu

SEQ ID NO: 24560 - RNA, 432 nt, Artificial Sequence
  derived and/or modified sequence opt3 from anti-HIV-1_HeavyChain
caggugcaacuggucgagagcggcgggggaguugugcagcccgguggcucccucagacuuucuugcgccgcuucaggguucaccuuuaguacauacggaaugcacuggguaaggcaggcaccuggcaagggucuggacuggguggccuucauccgguaugaugggagccauaaauacuaugcggacuccgucaagggacgcuuuacuauuucucgagaaaacucgaaaaauacguuguacuuacagaugaacucacugcguccagaggauaccgcuguguauuacugugccaaggaccuaggcgaaagcgagaaugaagagugggcaagugauuauuacgacuucggcagagauuacccggggcaagaccccaggggaguuguggguacauuugauauauggggccacgggacuauggucaccguguccucu

SEQ ID NO: 24561 - RNA, 432 nt, Artificial Sequence
  derived and/or modified sequence opt3 from anti-HIV-1_HeavyChain
caggugcaacuggucgagagcggcgggggaguugugcagcccgguaggucccucaggcuuucuugcgccgcuucaggcuucaccuuuaguagcuacgcaaugcacuggguacggcaggccccugggaagggacuggaauggguggcggucaucuccuaugacggcucuggugauuacuaugcugacucggugaaagggcgcuucacaauuucacgagauaacagcaagaguacuuuguacuuacagaugaacucccugcguccagaggacacggccguuuauuacugugcaaaagaucuaggagaaucugagaaugaagagugggccagcgacuauuacgauuuuggcagagacuacccgggccaagaucccagagggguggucggaaccuucgacauauggggucauggcacaauggugacuguauccuca

SEQ ID NO: 24562 - RNA, 432 nt, Artificial Sequence
  derived and/or modified sequence opt3 from anti-HIV-1_HeavyChain
caggugcaccuggucgagagcggcgggggaguugugcaacccgguggcucccucagacuuucuugcgccgcuucaggguucaccuuuaguacauacggaaugcaguggguaaggcaggcaccuggcaagggucuggaauggguggccuucaucaaaaacgacgggacuaaugaguuuuauggagauagcgucaagggccgguucacgauuucccgcgacaacucuaaaaauaccgugucguugcauauggauucauuacgaccagaagacacagcgcuguacuauugugcuaaggaucuaggcgagagcgaaaacgaggagugggccagugacuacuaugauuuuggguccgacuacccgggacaggauccccgugcaguugugggugccuucgacauauggggccaagggacuauggucaccgugucuagc

SEQ ID NO: 24563 - RNA, 432 nt, Artificial Sequence
  derived and/or modified sequence opt3 from anti-HIV-1_HeavyChain
caggugcaacuggucgagagcggcgggggaguugugcagcccgguggcucccucagacuuucuugcguagccucaggguucaccuuuaguagcuacggaaugcacugggugaggcaggcuccuggcaagggucuggaaugggucgcauucauccgguaugacgggcgcaacaaauacuaugccgauuccgugaagggacgauuuacaauuucucgugacaaaucgaagaauacuuuguguuuacagaugaacucacugagaguugaggauacggcgguguacuauugcgcuaaagaccuaggcgauagcgaaaaugaggaaugggccagugacuacuaugauuucggcagggacuacccagggcaagauccgcggggagucgugggugcauuugacauauggggccaugggaccaugguaacaguuuccucu

SEQ ID NO: 24564 - RNA, 432 nt, Artificial Sequence
  derived and/or modified sequence opt3 from anti-HIV-1_HeavyChain
caggugcaacuggucgagagcggcgggggaguugugcagcccggucggucccucaggcuuucuugcgccgcuucaggcuucaccuuuaguagcuacgggaugcacuggguacggcaggcaccuggaaagggccuggaauggguggccgucaucuccuaugacgguucuaacaaauacuaucgcgauucggugaaggggcgauucacaauuucacgugacaauagcaaaaacacuguuuacuugcagaugaauaguuuaagagcggaggauacggcuguguauuacugugccaaggaccugggagaauccgagucugaagagugggcaagcgauuauuacgacuuuggcagggauuacccaggccaagacccgagaggggucgugggagcccuagauauauggggucagggcaucaugguaaccguuuccuca

SEQ ID NO: 24565 - RNA, 432 nt, Artificial Sequence
  derived and/or modified sequence opt3 from anti-HIV-1_HeavyChain
gaggugcagcuggucgaaagcggcgggggaaugguucaacccgguagaccucucaggcuuuccugcgccgcuucuggcuucaucuuuucaggguucggacugcacugggugcggcaggcaccaggcaaggguuuggaguggguagccaguauuagcuacgacgggggaaacaaauauuacgcggauuccgugcgcggccgauuuaccauaucucgugacaauucgaagaacacauuauaucugcagaugaacucacuaagagcugaagauacugccgucuacuauugugcaaaagaccucggcgagagcgaaaaugaggagugggccagugauuacuaugacuucggguccgauuacccgggacaggaccccagggcugugguuggugcauuugauaucuggggccaagggacgauggugaccgucucuagc

SEQ ID NO: 24566 - RNA, 432 nt, Artificial Sequence
  derived and/or modified sequence opt3 from anti-HIV-1_HeavyChain
gaggugcagcuggucgaaagcggcgggggaguugugagacccgguggcucccucaggcuuucuugcgccgcuucaggguucaccuuuaacgacuacggaauggcauggguacggcaagccccuggcaagggucuggaguggguggcggauaucaguuaugacgggagcaauaaauacuaugcugauuccgucaagggacgcuucacaauuucucgagacaacucgaaaaauacuuuguacuuacagaugaacucacugcgugccgaagauacggcaguguauuacugugccaaggaccuaggcgagagcgaaaaugaggagugggcuagugauuauuacgacuuuggcagagauuacccagggcaggacccgaggggaguugugggugcauucgauauauggggccaggggaccauggucacaguguccucu

SEQ ID NO: 24567 - RNA, 429 nt, Artificial Sequence
  derived and/or modified sequence opt3 from anti-HIV-1_HeavyChain
caggugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguggccgucguguccuaugacgagucuaaauacuaugcggauucgguuaagggucgcuucacaaucucacgagacaacagcaaaaauacuuuguacuuacagaugaacagucugcgugcugaagauauggccguguauuacugugcaaaggaccuaggggaguccgaaaaugaggagugggccucugauuauuacgaauuuuggagagacuacccaggacaagauccgaggggcugggucggcacguucgacauuugggggcagggaaccauggugacaguaagcucc

SEQ ID NO: 24568 - RNA, 432 nt, Artificial Sequence
  derived and/or modified sequence opt3 from anti-HIV-1_HeavyChain
caggugcaacuggucgagcccggcagagggguugugcacccuggagguagccucaggcuuuccugcguaaccucuggcuucacauuugaaaacuucccaaugcauugggugcggcaggccccggggaagggacuggagugggucgcuuugaucucauacgacggcagugauaaauauuacagcgacuccgugaagggucgcuuuacuauuucucgagauaauucgaaaaacacguuauaucugcagaugaacucacuacgugcagaagacaccgccguuuacuauugugcgaaggaucucggggagagcgaaaaugaggagugggcuagugacuacuaugauuucggauccgacuaccccggccaggauccuagaggcguggucgggacauuugacauauggggacacgguacuauggugaccguaucuagc

SEQ ID NO: 24569 - RNA, 432 nt, Artificial Sequence
  derived and/or modified sequence opt3 from anti-HIV-1_HeavyChain
caggcccaacugguggagagcggcgggggagucguucagcccgguaggucccucaggcuuucuugcgcugcaucaggcuucaguuuugccacccacgcgaugcauugggugcggcgcagcccugggaagggacuggaauggguagcuacaaucuccuacggcgguaaaaacgaguauuacgccgacucugugaaggggcgauucacuauuucgcgugaaaauucaaagaacacguuguauuuacagaugaauagccugagagcagaggauaccgccgucuacuauugugcuaaagaccuaggagaaagugagaacgaggaaugggcauccgauuacuaugacuuuggcucugauuacccaggccaggacccgagaggggugguuggaacauucgauauauggggucacggcacuauggugaccgucagcucc

SEQ ID NO: 24570 - RNA, 432 nt, Artificial Sequence
  derived and/or modified sequence opt3 from anti-HIV-1_HeavyChain
gccgugcagcuggucgagagcggcgggggacucguuaagcccgguggcucccuuagacugucuugcgcugcaucaggguucaccuuuuucaacacauggaugaguugggugaggcaaagcccuggaaaaggcuuggaauggguagccgacaucuccuacgaugguucuaauaaguauuacgcggacucggugaaagggcgguuuacuauuucacgcgauaacagcaagaauacguuauaucugcagaugaacagucuacgagcugaggacaccgccgucuacuauugugcaaaagaucucggagaauccgagaaugaagagugggccucugacuacuaugauuucggccgugacuacccaggccaggauccgagaggggugguuggaguguuugacauauggggucagggcacaauggucacugugagcucc

SEQ ID NO: 24571 - RNA, 432 nt, Artificial Sequence
  derived and/or modified sequence opt3 from anti-HIV-1_HeavyChain
caggugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguggccgucaucuccuaugacgguucuaacaaauacuaugcggauucggugaaggggcgcuucacaauuucacgagacaauagcaaaaacacuuuguacuuacagaugaauagucugcgugcugaggauacggccguuuauuacugugcaaaggaccuaggagaauccgagaacgaagagugggccucugauuauuacgacuuuggcagcgauuacccaggccaagacccgagagcuguggucggggcauucgauauauggggacaggguaccauggugacaguauccuca

SEQ ID NO: 24572 - RNA, 432 nt, Artificial Sequence
  derived and/or modified sequence opt3 from anti-HIV-1_HeavyChain
caggugagacuggucgagagcggcgggaggguugugcaacccggagguucccuccggcuuucuugcguagccucaggcuucaccuuuaguagcuacgggauccacugggugcgccaggcuccuggaaagggccuggaaugggucacauucauuuggcaugacggucgagauacuuauuacgcagacgccgugaaagggcguuuuacgauauccagagauaacucuaagaauaccuuguauuuacagaugaacucgcugagggcggaggacacagcuguuuacuauugugccaaagaucuaggagaaucagagaaugaagagugggcaacugacuacuaugauuucuggaccggcuacccaggccaggacccgcgggccguggucggggcuuuugauaucuggggacaagguacaauggugaccguaagcagu

SEQ ID NO: 24573 - RNA, 432 nt, Artificial Sequence
  derived and/or modified sequence opt3 from anti-HIV-1_HeavyChain
caggugcaccuggucgagagcggcgggggaguugugcaacccgguagaucccucaggaucuacugcgccguaucugaguucaccuuucggaacuaugcuaugcauugggugcgccuugcaccuggcaaggggcugcagugggucgccgugauuucauacgacggaaguaauaaauauuacggcgauagcguuaagggucgauucacaauaucccgugacaacucuaaaaauacuuuguauuuacagauggauucgcugagagcggaagacacggcuguguacuauugugccaaggaucuaggggaaucagagaacgaagagugggcaagcgacuacuacgauuuuggaagggacuauccaggccaggauccgcggggcgucguggggaccuucgacaucuggggacacgguacaaugguaacuguuaguucc

SEQ ID NO: 24574 - RNA, 432 nt, Artificial Sequence
  derived and/or modified sequence opt3 from anti-HIV-1_HeavyChain
gaggugcagcuggucgaaagcggcgggggacucguuaagcccgguggcucccuuagacugucuugcgccgcuucaggguucaccuuuagugacgcauggaugagcugggugaggcaagccccuggaaaaggcauggaguggguagcggugaucuccuacgaugguucuaacaaguauuacgcugacucggucaaagggcgguucacaauuucacgcgauaauagcaagaacacuuuguauuuacagaugaauagucugcgagccguggacacggcaguuuacuauugugccaaagaucuaggagaaggcgagaacgaagagugggcuaccgacuacuaugauuuuuccauaggcuacccagggcaggacccgcguggaguggucggugcauucgauaucuggggccaggggacaauggugacuguaucuagc

SEQ ID NO: 24575 - RNA, 432 nt, Artificial Sequence
  derived and/or modified sequence opt3 from anti-HIV-1_HeavyChain
gaggugcaggucguugaaagcggcgggggacuggugaagcccgguggcucccucagacuuucuugcgaggccucaggguucaccuuuaguaacgcuuggaugagcuggguaaggcaagcaccuggaaaaggccuggaauggguggccgucaucuccuacgacgguaauaacaaguauuacgcggauucugugaaagggcgguucacaauuucgcgcgaaaauucaaagaacacuuuguauuuacagaugaauagccugcgagcugaggacacggccguuuaccacugugcaaaagaucuaggagagagugagaacgaagagugggccuccgacuauuacgauuuuggccgugacuauccaggccaggauccgagagggguggucggaaccuucgacauauggggucauggcacaauggugacuguaucuagc

SEQ ID NO: 24576 - RNA, 432 nt, Artificial Sequence
  derived and/or modified sequence opt3 from anti-HIV-1_HeavyChain
caggugcaacuggucgagagcggcgggggaguugugcagcccgguggcucccucagacuuucuugcgccgcuucaggguucaccuuuaguagcuacggaauccacuggguaaggcaggcaccuggcaagggucuggaauggguggccuucauucgguccgacgcgacaaacaaauauuacgcugauucugucaaggggcgcuuuacuauaucgcgagagaauagcaaaaauacguuguauuuacagaugaacucacugcgugccgaagacaccgcaguguacuauugugccaaggaucuaggagagagugaaaacgaggagugggcuuccgacuacuaugauuucggcucugacuacccaggccaagauccgagagggguugugggaacauuugacaucuggggucauggcacuauggucaccgugagcucc

SEQ ID NO: 24577 - RNA, 432 nt, Artificial Sequence
  derived and/or modified sequence opt3 from anti-HIV-1_HeavyChain
caggugcaacuggucgagagcggcgggggaguugugcagcccgguagaucccucaggcuuucuugcgccgcuucaggcuucaccuuuaguagcuucgggaugcacuggguacggcaggcaccuggaaagggccuggaauggguggccgucaucuccuacgacgguaacaauaaauauuacgcggauucugugaaggggcgcuuuacaauuucgcgagagaacagcaaaaauacuuuguauuuacagaugaacucacugcgugcugaagacacggccguuuacuauugugcaaaggaucuaggagagagugaaaaugaggagugggccuccgacuacuaugauuucggcucugacuacccaggccaagauccgagagggguggucggaaccuuugacauauggggucauggcacaauggugacuguaagcucc

SEQ ID NO: 24578 - RNA, 432 nt, Artificial Sequence
  derived and/or modified sequence opt3 from anti-HIV-1_HeavyChain
caggugcaacuggucgagagcggcgggggaguugugcagcccgguagaucccucaggcuuucuugcgccgcuucaggcuucaccuuuaguaacuacgcaauggacuggguacggcaggccccugggaagggacuggaauggguggcggucaucagcuaugauggcuccaauaaauacuaugcugacucugugaagggucgcuucacaauuucgcgagauaacagcaaaaauacuuuguacuuacagaugaacucacugcgugccgaggacacggcaguuuauuacugugccaaggaucuaggggaaagugagaaugaagagugggcuaccgacuauuacgauuuuuggacaggauacccaggccaagacccgagagcaguggucggcgccuucgauauaugggggcagggaacuauggugaccguauccucu

SEQ ID NO: 24579 - RNA, 432 nt, Artificial Sequence
  derived and/or modified sequence opt3 from anti-HIV-1_HeavyChain
caggugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguggccgucguguccuaugacgagucuaacaaauacuaugcggguucgguuaaggggcgcuucacaaucucacgagauaauagcaaaaacacuuuguacuuacagaugaauagucugcguacggaagacauggcuguguauuacugugccaaggaucuaggagaguccgaaaacgaggagugggcaucugacuauuacgauuuuggcagagaauacccaggccaagacccgagggggugggucggaaccuucgauauuuggggucagggcacaauggugacuguaagcucc

SEQ ID NO: 24580 - RNA, 432 nt, Artificial Sequence
  derived and/or modified sequence opt3 from anti-HIV-1_HeavyChain
caggugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguggccgucaucuccuaugacgguucuaacaaauacuauguggauucgguuaaggggcgcuucacaauuucacgagacaauagcaaaaacacuuuguacuuacagaugaauagucugcgugcggaggauacggcuguguauuacugugccaaggaccuaggagaauccgagaacgaagagugggcaaccgauuauuacgacuuuucuauaggcuacccaggccaagauccgagaggggucgugggaaucuucgacauuuggggucagggcacaaugguaacuguuagcucc

SEQ ID NO: 24581 - RNA, 432 nt, Artificial Sequence
  derived and/or modified sequence opt3 from anti-HIV-1_HeavyChain
caggugcaacuggucgagagcggcgggggaguugugcagcccgguagaucccucaggcuuucuugcgccgcuucaggcuucaccuuuaguacaagcgggaugcacuggguacggcaggcaccuggaaagggcauggaauggguggccgucaucuccuacgacgguucuaacaaauauuacgcggauucggugaaggggcgcuucacuauuucacgagacaauagcaaaaacacgcuguauuugcagaugaauaguuuacgugcuguugauaccgccguguacuauugugcaaaggaccugggagagggcgaaaacgaggaaugggccacagauuacuaugacuuuuccauaggcuacccagggcaagauccgagaggagucgugggugcuuucgacaucuggggccaggggacuaugguaaccguuucuagc

SEQ ID NO: 24582 - RNA, 363 nt, Artificial Sequence
  derived and/or modified sequence opt3 from anti-HIV_C38-VRC18.02_HeavyChain
caggugagacugguccaaagcggcaaccagguuaggaagcccggggccuccgugcggaucucuugcgaggcuucaggauacaaauucauugaccacuuuauacauuggguacgccaggugccuggucacggccucgaauggcuuggguggaucaauccacgaggaggcggugucaacuauagucguagcuuccaggggaagcuguccaugaccaugacaagagauaauuuugaggaaacugcauacuuggacuuaucuaaacugaacccgggagauacggccguguauuucugugcgaggggcuuugcuggcuacgaguggucguucauuugggggcaaggaacccuaguuaucgugucaagc

SEQ ID NO: 24583 - RNA, 396 nt, Artificial Sequence
  derived and/or modified sequence opt3 from anti-HIV_44-VRC13.02_HeavyChain
caggugcaacugguccagagcggcaccgcccucaagucccccgggucuucagcuaaacuuaguugcacaguucugggagacgaguucgguacuuacuuuaucagcuggauuagacaggcaccuggccagggguuggaaugggugggaggcauaguaccacacucccaauuacagucuucggcccagaaguuccaugguaggaucauuaucucagcgggggcuggagugacgccgcccgucgugagccugcagcuaaccaaccucacauuugaggauacuggcaccuauuucugugcccgggaacgcggccgacaccgugacccuaaaacaggggaugcacugagaggaagguacuuugacuucuggggucggggcaccgggcuucgcguuaguacu

SEQ ID NO: 24584 - RNA, 321 nt, Artificial Sequence
  derived and/or modified sequence opt3 from anti-HIV-1_LightChain
gacaucaagcugacccagagccccgccuuccucuccgcuucugugggcgagagagucacauuuacuugcagggcaucacaagauauuagucacgaccuuguuugguuccagcagaaagccgggcgggcgccuagccuguugauguuuuacggauccacguuagaacgcggugugccaccgcgauucucuggccguagaucggggaccgaguuuacaguaacuauagauucacugcagcccgaagacgugggaaccuauuacugucaacagcuaagcgcuuucccucucacauuuggcggugggaccacugucgauaucaag

SEQ ID NO: 24585 - RNA, 321 nt, Artificial Sequence
  derived and/or modified sequence opt3 from anti-HIV-1_LightChain
gacaucaagaugacccagagccccgccuuccuguccgcuucugugggcgagagagucacauuuacuugcagggcaucacaagauauuagucacgacguugugugguuccagcagaaaagcggguccgccccuaagcuccuuauguuuuacggaucuacgcuggaacgggguguaccaccgcgcuucucgggccgacguucagggaccgaguuuacagugacuauagauggauugcagcccgaagacgucggcaccuauuacugucaacaguuaagcgcguucccucugacauuuggugggggaaccacuguggauaucaaa

SEQ ID NO: 24586 - RNA, 321 nt, Artificial Sequence
  derived and/or modified sequence opt3 from anti-HIV-1_LightChain
gacaucaagcugacccagagccccgccuuccucuccgcuucugugggcgagagagucacauuuacuugcagggcaucacaagauauucggcacgaacuuguuugguaccagcagaaaccugggcgcggaccaaagcuguugauauauuacgguaguacguuagagggcggggugccgagccgauucuccggacguagaucuggcaccgaauuuacaguaacuaucucgucacugcagcccgaggacguggguaccuauuacugucaacagcuaaacagcuucccucucacauuugggggaggcaccacugucgauauuagg

SEQ ID NO: 24587 - RNA, 321 nt, Artificial Sequence
  derived and/or modified sequence opt3 from anti-HIV-1_LightChain
gacauccagcugacccaaagccccuccuuccucucugccucagugggcgauagagucaguauuacaugcagggcuagccaggggauaaagcacgagcuugcaugguaccagcagaaaccuggacgggccccaucccuguugaucuauuacgcgucuacuuuagcucgcgguguuccgucgcgauuuucagccagcuggaguggcacgcuguucacccuaacaauuaaugggcuccaacccgaagacuuugcaacuuauuucugucagcagaugaacucccugccucuuaccuuuggaggcgguacaaagauggaugugcgu

SEQ ID NO: 24588 - RNA, 321 nt, Artificial Sequence
  derived and/or modified sequence opt3 from anti-HIV-1_LightChain
gacauccagcugacccaaagccccuccuuccucucugccucagugggcgauaaggucacaauuacuugcagagcuagucacgggguuaggaacgagcuugcaugguaccagcagaaaccuggaaaggccccaaaucuguugauauauuacgcgagcacguuacaguccggugugccgucucgguuuucggcuaccggcucagggacacauuucacucugaccguaagcagucuacaacccgaagacuuugccacauauuucugucagcacauguccucuuacccucucaccuuuggaggcgguacuaaaguggagaucaag

SEQ ID NO: 24589 - RNA, 321 nt, Artificial Sequence
  derived and/or modified sequence opt3 from anti-HIV-1_LightChain
gacauccagcugacccaaagccccuccuuccucucugccucagugggcgauaaggucacauuuacuugcagagcuagucaggggguuaggaacgagcuugcaugguaccagcagaaaccuggaaaggccccaaaucuguugauuuauuacgcgagcacguuacaauccggugugccgucucgguucucggcuaccggcucagggacacacuuuagccugacuguaaguucccuacagcccgaagacuucgccaccuauuuuugucagcauaugucuagcuacccucucacauucggaggcgguaccaaaguggagauaaag

SEQ ID NO: 24590 - RNA, 321 nt, Artificial Sequence
  derived and/or modified sequence opt3 from anti-HIV-1_LightChain
gacauccagcugacccaaagccccuccuuccucucugccucagugggcgauaaggucacaauuacuugcagagcuagucaggggguuaggaacgagcuugcaugguaccagcagaaaccuggaaaggccccaaaucuguugauauauuacgcgagcacguuacaauccggugugccgucucgguuuucggcuaccggcucagggacacacuucacucugaccguaagcagucuacagcccgaagacuuugccacauauuucugucagcauauguccucuuacccucucaccuuuggaggcgguacuaaaguggagaucaag

SEQ ID NO: 24591 - RNA, 366 nt, Artificial Sequence
  derived and/or modified sequence opt3 from anti-HIV-1_HeavyChain
agccaguaccuggcccaacccggcgcugagguggcaaagccuggggccuccgucaaaguuucuugcaaggugcacggagacaacuucagaggucauuaucuccacuggguaaggcaggcgccaggccaggggcuucaguggaucggaggcauuaauccguuuucaggugaagcugccuacgggaaacgguucgagggacgccugcgauugacccgugauacaagugugaacacugcauauauggaauuagccaagcugacgcccgacgauaccgcugucuacuuuugugcaagagacaaaacauauaaugaugaguucacugccauggacauauggggccauggcaccacagugaucguuagcucc

SEQ ID NO: 24592 - RNA, 366 nt, Artificial Sequence
  derived and/or modified sequence opt3 from anti-HIV-1_HeavyChain
agccaguaccuggcccaacccggcgcugagguggcaaagccuugggccuccgucaaaguuucuugcagagugcacggggacaacuucaggggauuuuaucuccauuggguacggcaggcgccaggucagggccuugaauggaucgggggaauuaauccguucucaggcgaggcugccuacggucgccgauuugaagggcgucugagauugaccagggauacaaguauaaacacugcauauauggaggugacgaaguuaaccagcgacgauacagccgucuacuucugugcucgggacaaaacuuauaaugaugaauuuaccgcaauggacaucuggggacagggcacaaccgugauuguuuccucu

SEQ ID NO: 24593 - RNA, 366 nt, Artificial Sequence
  derived and/or modified sequence opt3 from anti-HIV-1_HeavyChain
agccaguaccuggcccaauccggcucugaggugaagaaacccggggcuucagucaagguuaguugcagacuccacggagacaaauucggugcacauuauauccacugggugaggcaggccccuggccaggggcuugaauggcugggauuuuuccauccaggcaccggugaugcgguaagcgcucagaaguuucaagggcggauuuccuugacacgcgacacuucuauaucgacgggauacuuagaggugcgacgucugucaagcgaugacaccgccgucuauuacugugcaagagauaaaacauauagugacgaagccacuggcauggauaucuggggccaggggaccacagugauuguuuccucu

SEQ ID NO: 24594 - RNA, 366 nt, Artificial Sequence
  derived and/or modified sequence opt3 from anti-HIV-1_HeavyChain
agccuggagcucgugcaguccggcaccgaagucaagaaacccggggccucuguuaaggugucaugcaaacuuuucggagacacaaucacgagugguccuauucacuggguaagacaagcuccaggccaggggcuggaguggaugggauggacuaacccgcauagcggcgauaccgcaacagcccccaaguuucaggguaggguguacaugacuaaugacaaaaagauaaacaccgcguucuuggaugucacacgguuagcuuccgacgauaccgccaucuauuuuugugcacgcgacauguacuauucuaaugaagccguggggauggauguuuggggacagggcacuacagugucggucucaagc

SEQ ID NO: 24595 - RNA, 366 nt, Artificial Sequence
  derived and/or modified sequence opt3 from anti-HIV-1_HeavyChain
caggaggugcugguccaaagcggcgccgaaguuaagaaacccggggcuuccgugaagguaucuugcagagcauucggauacaccuuuacagcccacgcgcuccauugggugaggcaggcuccuggucagggccuugaguggcugggguggaucaacccacacucaggagacacuacgaccagucagaaauuccaaggccgggucuauaugacacgcgauaagagcauuaauacugccuacuuggaagugacccgauuaacauccgacgauaccgcaauauuuuauugugcccgugacaaauacuauggugaugaggcuguugggauggacguguggggacagggcacuucugucacagugucguca

SEQ ID NO: 24596 - RNA, 366 nt, Artificial Sequence
  derived and/or modified sequence opt3 from anti-HIV-1_HeavyChain
caggaggugcugguccaaagcggcgccgaaguuaagaaacccggggcuuccgugaagguaucuugcagagcauucggauacaccuuuacagguaacgcccuccacugggugaggcaggcgccuggccaggggcuugaguggcugggauggaucaauccacauucaggcgacacuacgaccagucagaaauuccaaggucgggucuauaugacacgcgauaaggcuauuaacacugccuacuuggacgugacccgauuaacaagcgaugacaccgcaauauauuacugugcccgugauaaauauuacgggaaugaagcuguuggaauggacguguggggccagggcacuuccgucacagugucuucg

SEQ ID NO: 24597 - RNA, 366 nt, Artificial Sequence
  derived and/or modified sequence opt3 from anti-HIV-1_HeavyChain
caggaggugcugguccaaagcggcgccgaaguuaagaaacccggggcuuccgugaagguaucuugcagagcauucggauacaccuuuacagguaacgcccuccacugggugaggcaggcgccuggccaggggcuugaguggcugggauggaucaauccacauucaggcgacacuacgaccagucagaaauuccaaggucgggucuauaugacacgcgauaagagcauuaacacugccuuuuuggacgugacccgauuaacauccgaugacaccgggauauacuauugugcucgugauaaauacuauggaaaugaagcaguuggcauggacguguggggccaggggacuucugucacagugucguca

SEQ ID NO: 24598 - RNA, 303 nt, Artificial Sequence
  derived and/or modified sequence opt3 from anti-HIV_45_LightChain
agccugacccagucccccggcacacucucucuuucaccuggggagacugccaucauuaguugcagaacgagccaauacggaucccuggcuugguaucagcagaggccaggucaggcaccgcgguuggugauauacucuggcucgacccgcgccgcggggauccccgaccgauucucaggaagccguuggggcccugauuauaacuuaacaauuaguaaucuggaauccggugacuuuggggucuacuauugucaacaguacgaguucuuuggacagggcacuaagguucagguggauaucaaa

SEQ ID NO: 24599 - RNA, 303 nt, Artificial Sequence
  derived and/or modified sequence opt3 from anti-HIV_45_LightChain
gugcugacccagagccccggcacacucucccuuucuccuggggagacugccacgaucucaugcagaaccagucaauacggaagccuggcuugguaucagcagaggccaggucaggcaccgcgguuggucauuuacuccggcucuacacgcgccgcggggauacccgaccgauucucgggaucacguagcggcccugauuauacuuuaaccaucaguaaccuggaauccggugacuuugggguuuacuauugucaacaguacgaguucuuuggacagggcacaaaggugcagcaagauaauaaa

SEQ ID NO: 24600 - RNA, 303 nt, Artificial Sequence
  derived and/or modified sequence opt3 from anti-HIV_45_LightChain
gugcugacccagagccccggcacacucucccuuucuccuggggagacugccaucauuucaugcagaacgagucaauacggaagccuggcuugguaucagcagaggccaggucaggcaccgcgguuggucauauacuccggcucuacccgcgccgcggggauccccgaccgauucucgggaucacguuggggcccugauuauaacuuaacaauuagcaaucuggaaaguggugacuuugggguuuacuauugucaacaguacgaguucuuuggacagggcacuaaggugcagguagauaucaaa

SEQ ID NO: 24601 - RNA, 363 nt, Artificial Sequence
  derived and/or modified sequence opt3 from anti-HIV_45_HeavyChain
caggugagacugagccaauccggcgggcagaugaagaaacccggagagucuaugaggaucucaugccgggccagugguuacgaguucauugacuguacccucaacuggauacgccuugcuccuggccgacguccagaauggaugggguggcugaagccgagaggaggcgcagucaauuaugccaggguuuuucagggucgggugacaaugacucgcgauguauacagcgacacggcguucuuggaauuaagaucccugaccgcugaugacacagccguguauuuuugcacuagggggaaaaccgucgauuacaacugggacuucgagcacgugggacccggcacaccuguuaccgugucuucg

SEQ ID NO: 24602 - RNA, 363 nt, Artificial Sequence
  derived and/or modified sequence opt3 from anti-HIV_45_HeavyChain
caggugagacugagccaauccggcgggcagaugaagaaacccggagagucuaugaggaucucaugccaggccagugguuacgaguucauugacuguacccucaacuggguccggcuugcuccuggccgccgaccagaauggaugggguggcugaagccgcguggaggcgcaguuaauuaugccagaauauuucaggguagggugacaaugacucgggauguauacagcgacacggcguucuuggaauuacgcucccugaccgcugaugacacagccguguauuuuugcacuagagggaaaaacugugauuacaauugggacuucgagcacgucggacccggcuauccugugaccguuucucca

SEQ ID NO: 24603 - RNA, 375 nt, Artificial Sequence
  derived and/or modified sequence opt3 from anti-HIV_45_HeavyChain
caggugagacugagccaauccggcgggcagaugaagaaacccggagacucuaugaggaucucaugccgggccagugguuacgaguucauuaacuguccuauaaauuggauccgccucgcuccaggcaagcgaccggaauggaugggguggaugaaaccccguggaggcgcagucagcuaugccagacagcuucaggguaggguuaccaugacacgggauauguacuccgagacugcguuucuggaauugcgcucuuuaacgucggacgauaccgcuguguauuucugcacaagagggaaguacuguacugccagggacuauuacaacugggauuuugagcacuggggacaaggcaccccuguaacagugucaagc

SEQ ID NO: 24604 - RNA, 435 nt, Artificial Sequence
  derived and/or modified sequence opt3 from anti-HIV_cap256-206-252885_VR-Chain
caggagcaacugguggaaagcggcgggggagucguucccccugguuccucucucacccuuucaugcguggccaguagauucacauuuagcgcuuucggcaugcacuggguaaggcaggcaccagggaagggacuggaguggguggccggcgucuccuuuguggguaucaaaaaguacuaugcggacucuguuaaagggcgguucacuauuucgcgcgauaacucaaagaauacguuguuuuuacagaugaacggacugcgaggcgaagacaccggccuauacuauugugugaaagauaugcguuaccucgagugcgaagagugggcuagcgacuauuacgauuucgggaagccgaaucagcccugucuggacagaaggggagucagugguauauccgccuuuuggggccaagggacaacugugaccguaucuagc

SEQ ID NO: 24605 - RNA, 438 nt, Artificial Sequence
  derived and/or modified sequence opt3 from anti-HIV_cap256-206-249183_VR-Chain
caggugcugcucgucgagagcggcgggggaguuguggaacccgguaccucccuuacacugucuugcgccgcuucaagauucacuuuuaguaacuucggcaugcacuggguaaggcaaacgccugggggaggcuuggaguggguggcaagcaucuccaaugaagguaacaagaaauaccaugccgagucugucugggggcgguuuauuauaucgcgcgacaauucaaagaacaccguguucuuacacaugagcagucugcgaccagaugacuccgcgcuauauuuuuguguucgugauagacaggaagacgauugcgaggugugguggucugacuacgaggcuuucggaagggaaaucccgugucggcaguaucgcggccagggccucgccgggauuuuugauaucuggggaagagguacaauggucacugugagcucc

SEQ ID NO: 24606 - RNA, 438 nt, Artificial Sequence
  derived and/or modified sequence opt3 from anti-HIV_cap256-206-220956_VR-Chain
cagaugaugcugguggagagcggcggggacgucguugaacccggaagaucccucacccuuucuugcgccacaucacaauucacuuuuaguaacuacgguaugcacugggugaggcaggcuccuggccgggggcuggaguggguagcaagcaucuccaaugaaggaaacaagaaauaucaugccgagucuguguggggccgcuugauuauaucgcgagauaauucaaagaacacguuauuccugcacaugagcagucuacgugcggacgauuccgcucucuacuuuugugucagagacaggcaggaagaugagugcgaggaaugguggucuaauuauuacgccuucggucgcgggggaccaugucggaaauauagaggccagggccuggcagggaucuuugacguguggggaagggguaccaugguuacagugagcucc

SEQ ID NO: 24607 - RNA, 432 nt, Artificial Sequence
  derived and/or modified sequence opt3 from anti-HIV_cap256-206-220629_VR-Chain
caggagcaacugguggaaagcggcgggggagucguucccccugguaagucccucaaacuuucuugcguggccucaagauucaguuuuggcgcuuucgggaugcacuggguaaggcaggcaccaggaaagggccuggaguggguggccgguaucagcuuugcggggauuaaaaaguacuauggagacuccgucaaaggccgguucuacauaucucgcgauaacucgcagaauaccuuguuuuuagaaaugaacggccugcgaggggacgauacagcucguuauuacugugugaaggaccuaagagagcucgaaugcgaggagugggccucagauuauuacgacuucggaaagccgcagcccugucuggauagcagggguguuaguggcaucuccgcaaugugggggccuggaacuauggugacggucucuagc

SEQ ID NO: 24608 - RNA, 381 nt, Artificial Sequence
  derived and/or modified sequence opt3 from anti-HIV_cap256-206-200599_VR-Chain
caggagaagcugguggaaagcggcgggggagccguccaacccgguggcucccucagacuuucuugcguugcuucaggguucaccuuuaacggauucggcaugcacugggugaggcaggcaccugguaaagggcuggaguggguagccacaaucaguuuuagcggaguguacauuucccgggaaaauucuaagaacacuuuguauuuacagaugaauggccugcgcggcgaggacacggcgcuauacuauugugcuaaagaucuccgauaccuggaaugcggggaguggucgaccuauuacccacagccgugucuugacacacguggagucucagguauaagcaacguguggggccccgggacuagaguuaccgugaguucc

SEQ ID NO: 24609 - RNA, 432 nt, Artificial Sequence
  derived and/or modified sequence opt3 from anti-HIV_cap256-206-186347_VR-Chain
caggagcugcucguggaaagcggcgggggagucguucccccugguaagucccuuaccaucucuugcguggccucaagauucacauuuagugcuuucggcaugcacuggguaaggcaagcaccagggaaaggacugcaguggguggccagcauuuccuuugcgggcacuaagaaauacuaugcugacuucgucaagggucgguuuacgauaucucgcgauaacucgaaaaauaccaucuucuugcagaugaacggguuacgaggagaggacacagcccuguaccauugugugaaggauaugcgucagcuagaaugcgaggaauggacuucagacuauuacgauuuuggcagaccgcaacccuguauugacaggcggggcguuagcgggaucagugcaauguggggaccugguaccauggugacagucuccucu

SEQ ID NO: 24610 - RNA, 438 nt, Artificial Sequence
  derived and/or modified sequence opt3 from anti-HIV_cap256-206-186226_VR-Chain
cagaugcugcucguggagagcggcgggggagucguugaacccgguagaucccuuacccugucuugcgccacaucacaauucacuuuuaguaacuacggcaugcacugggugaggcagacgccugggaccggauuggaguggguagcuagcaucuccaaugaaggcaacaagaaauaucauggugaggcagugugggggcgguucauuauaucucgcgacaauucgaagaaaacauuauuucugcacaugucaaaccuacgagccgaugacagcggacucuacuucuguguccgugauagacaggaagacgagugcgaggaaugguggagugauuauuacuccuuuggcaggggcgggccaugucggaaguaucauggacagggucuggcgggcaucuucgacauuugggggcgcggaacucuugugaccguuucuagc

SEQ ID NO: 24611 - RNA, 435 nt, Artificial Sequence
  derived and/or modified sequence opt3 from anti-HIV_cap256-206-179686_VR-Chain
caggagcaacugguggaaagcggcgggggagucguucccccuuggaagucccucacccuuucuugcgaggccucaagauucacauuuagugcuuucgguaugcacugggugaggcaggcaccaggcaaagggcuggaauggguagccggaaucagcuuugcgggcauuaagaaauacuaugcugacuccgugaagggucgguucuuuauaucucgcgauaacucgaaaaaucgagucuuguuagagaugaacgggcugcguagagaagacacugccagguacuucugugugaaggaucuacgggagcucgagugcgaagagugggcaucagacuauuacgauuuuggaaagccgaaucagcccugucuggaccgcagaggcguuagcggcaucagugccaugugggggcagggaacgauggugaccgucuccucu

SEQ ID NO: 24612 - RNA, 417 nt, Artificial Sequence
  derived and/or modified sequence opt3 from anti-HIV_cap256-206-173707_VR-Chain
caggagaagcugguggaaagcggcgggggagccguccaacccgguggcucccucagacuuucuugcguugcuucaggguucaccuuuaaaggauucggcaugcacugggugaggcaggcaccugguaaggggcuggaguggguagccacaaucaguuuuagcggagugaaaaaguacuauggcaacuccgcgaaaggccgguucuuuauuucucgcgacaauuugaagaacacugucuacuuagaaaugaaugggcugcgaggagaggauacggcucuauauuacugugccaaggaccuccguuaucuggaaugcggugaguggucgaccuacuauccacagccgugucuugauacaagaggcgugucagggauaagcaacguuuggggacccggcacuaaagugaccgucaguucc

SEQ ID NO: 24613 - RNA, 432 nt, Artificial Sequence
  derived and/or modified sequence opt3 from anti-HIV_cap256-206-173339_VR-Chain
caggagcugcucguggaaagcggcgggggagucguucccccugguaagucccuuaaacugucuugcguggccucaagauucaccuuuggcgcuuucgggaugcacuggguaaggcaagcaccaggaaagggcuuggaguggguggccgguaucaguuuugcggggacuaaaaacuacuaugcugacagcgucaagggacgguucacaauuucccgcgauaauccgaaaaacacguuauuucugcagaugaauggccuacgaggcgacgauaccgggcucuacuauugugugaaggacaugcgugaacuggagugcgaacuuuggacaucugauuacuaugacuucggaagaccccagccuuguauagaucagagggguguuucgggcaucucagccaugugggggcaaggaacuauggugaccauuagcagu

SEQ ID NO: 24614 - RNA, 438 nt, Artificial Sequence
  derived and/or modified sequence opt3 from anti-HIV_cap256-206-172689_VR-Chain
cagaugaugcugguggagagcggcgggggagucguugaacccgguagaucccucacccuuucuugcgccacaucacacuucacuuuuaguaacuacggcaugcauugggugaggcaagcuccugggggacggcuggaguggguagcaagcaucuccaaugccggcaacaagaaauaucacggugacucugugugggggcgcuugauuauaucgcgagauaauucaaagaacacguuauuccugcauaugagcagucuacgugucgacgauuccgcgcucuacuuuugugugagagacaggcaggaagaugagugcgaagagugguggucugacuauuacgcuuucggacggggcggcccaugucgcaaauauagagggcagggacuggccgguaucuuugauauuuggggcagggggaccaugguuacagugagcucc

SEQ ID NO: 24615 - RNA, 432 nt, Artificial Sequence
  derived and/or modified sequence opt3 from anti-HIV_cap256-206-162744_VR-Chain
caggagaagcugguggaaagcggcgggggagucguucccccugguaaaucccucagacuuucuugcguggccucaggcuucaccuuuagugcuuucgggaugcacuggguaaggcaagcaccaggaaagggccuggaguggguggccgguaucagcuuugcggggauuaaaaacuacuaugcugacuccgucaagggacgguucacaauaucucgcgauaauucgaaaaacucauuguuuuuacagaugaauggccugcgaggcgacgauacugcccguuacuauugugugaaggacaugagagaacuagagugcgaagaguggacgagcgauuacuaugacuucgggaagccgcagcccuguaucgauaggcggggaguuagugguauuuccgcaauguggggccaggggaccauggugacaaucucuagc

SEQ ID NO: 24616 - RNA, 438 nt, Artificial Sequence
  derived and/or modified sequence opt3 from anti-HIV_cap256-206-146057_VR-Chain
cagaugcaacugguggagagcggcgggggagucguucagcccgguaccucccucacacuuucuugcguggccucacaguucacuuuuaguaacuacggcaugcacuggaucagacaggcuccugggcaaggacuggaauggguagcaagcauuuccaaugacggcgguaagagguaucauggggaugccgugugggcgcgguucauaaucucucgcgacaacucgaaaaauacggucuuuuugcagaugaccucauuacgagcugaggauacagcccguuacuucugugugagagacaggcaggaagaugagugccuggaaugguggagcgacuauuacaacuuuggacggcagcuaccaugugcaaaguuccgcggccucggccuggccgggguuuuugauauuuggggacacgguacuauggugaccgucaguucc

SEQ ID NO: 24617 - RNA, 435 nt, Artificial Sequence
  derived and/or modified sequence opt3 from anti-HIV_cap256-206-139519_VR-Chain
caggagcaacugguggaaagcggcgggggagucguucccccugguaccucccucagacuuucuugcguggccucaagguucaguuuuggcagcuucgggaugcacuggguacggcaggcuccaggaaagggccuggaguggguggcagguaucuccuuugucgggauuaaaaaguacuauggagacucugugaaaggccgcuucuuuauaucgcgagauaacucaaagaauacauuguucuuagaaaugaacggccugcguggggaggacacugccagauacuauuguguuaaagauaugagggaacuagagugcgaggaaugggcgagcgacuacuaugauuuuggaaagccgaaucagcccugucucgaccggcgcggugugaguggcaucuccgcuaugugggggccuggaacgaugcugaccgucucuagc

SEQ ID NO: 24618 - RNA, 432 nt, Artificial Sequence
  derived and/or modified sequence opt3 from anti-HIV_cap256-206-136316_VR-Chain
caggagcaacugguggaaagcggcgggggagucguucccccugguaagucccucacccuuucuugcguggccucaggcuucacauuuagugcuuucgggaugcacuggguaagacaggcaccaggaaaaggccuggaguggguggccgguaucagcuuugucgggauuaagaaauacuauggagacuccgugaagggcagguucacuauaucucgggauaacucgaaaaauacguuguuuuuacagaugaacggccugcgcggggacgauaccgcgcuauaccauuguguuaaggacaugcgacagcucgaaugcgaggaauggacaucagauuauuacgacuucggaaagccgcaacccuguaucgauccucguggugugagcggcauuagugcuaugugggggcagggaacuauggucaccguguccucu

SEQ ID NO: 24619 - RNA, 438 nt, Artificial Sequence
  derived and/or modified sequence opt3 from anti-HIV_cap256-206-116098_VR-Chain
cagaugaugcugguggagagcggcgggggagucguugaacccgguagaucccucacccuuucuugcgccgcuucacaauucacauuuaguaacuacggcaugcacugggugaggcaggcaccugggcgggagcuggaauggguagccagcaucuccaaugcgggaaacaagaaauaucauggcgaggcuguguggggucgcuugauuauaucucgagacaauucgaagaacacuuuauuccugcacaugucaaaucuacguccagaugacagcgcccucuacuuuugugucagagauaggcaggaagacgagugcgaggaaugguggagugauuauuacgcauucgggcggggaggcccgugucgcaaauaucauggccaggggcuggccggaaucuuugacauuugggguagaggcacgauggugaccguuuccucu

SEQ ID NO: 24620 - RNA, 432 nt, Artificial Sequence
  derived and/or modified sequence opt3 from anti-HIV_cap256-206-115862_VR-Chain
caggagcaacugguggaaagcggcgggggagucguucccccugguaagucccucagacuuucuugcgugggcucaagguucaccuuuagugccuucgggaugcacuggguacggcaggcuccaggaaaaggccuggaguggguggcaagcaucuccuuugccgguacaaagaaauacuaugucgacucugugaaggggcgcuucuuuauuucgcgagauaacagcaaaaauacuguuuucuuggaaaugaacggauuacguggcgaggacacgggccuguacuauugugugaaggauaugagagaacuagagugcgaggaaugggcgucagacuacuaugauuuugggaagccgcagcccugucucgacaggcggggagucagugguauauccgcuauguggggccaggggacccuggugaucauuucuagc

SEQ ID NO: 24621 - RNA, 435 nt, Artificial Sequence
  derived and/or modified sequence opt3 from anti-HIV_cap256-206-107018_VR-Chain
caggagcaacugguggaaagcggcgggggagucguucccccugguaagucccucacccuuucuugcguggccucaagauucaguuuuagcgcuuucggcaugcacuggguaaggcaggcaccagggaaaggacuggaguggguggccuccaucucuuuugucggcauuaagaaauacuauggugacucggugaaggggcgguucuuuauaucacgcgauaacagcaaaaauacaguuuucuuggaaaugaacggauuacgaggcgaggacacuggccuguacuauugugugaaggauaugcgugaacuagagugcgaggaaugggcgagugacuacuaugauuuugggaagccgaaucagcccugucucgacagaaggggagucuccgguaucucugcuauguggggccaggggacgcuggugauuguaagcucc

SEQ ID NO: 24622 - RNA, 438 nt, Artificial Sequence
  derived and/or modified sequence opt3 from anti-HIV_cap256-206-098644_VR-Chain
cagaugcugcucguggagagcggcgggggagucguugaacccgguagaucccuuacccugucuugcgccgcuucacaauucacauuuaguaacuacggcaugcacugggugaggcaggcaccugggggaggcuuggaguggguagccagcaucuccaaugaagguaacaagcgguaucauggggagucuguguggggacgcuucgucauuucgcgagacaauagcaaaaacacuuuauuucugcacaugucaacgcuacguccagaugacagugcgcucuacuucugugugagagauaggcaggaagacgagugcgaggaauggugguccgauuauuacgcuuuuggccggggcgggccgugucgcaaguaucauggacagggucuggccggcauauucgacguuugggggagaggaaccauggugacaggccuuuuu

SEQ ID NO: 24623 - RNA, 417 nt, Artificial Sequence
  derived and/or modified sequence opt3 from anti-HIV_cap256-206-098135_VR-Chain
caggagaagcugguggaaagcggcgggggagccguccaacccgguggcucccucagacuuucuugcguugcuucaggguucaccuuuaguggauucggcaugcacugggugaggcaggcaccugguaaagggcuggaguggguagccacaaucagcuuuuccggaaugaagaaauacuauggcacuucugcgaagggccgguucucgauuuaccgcgacaacagcaaaaauacguuguauuuacagauggaugggcugcgagaaaaggacaccgcucuauacuauugugccaaggaucuccguuaccuggagugcggagaauggucaacauauuacccacagccgugucuugacagaaggggugugaguggcauauccaacgucugggggcccggaacuauggugaccguuucuagc

SEQ ID NO: 24624 - RNA, 435 nt, Artificial Sequence
  derived and/or modified sequence opt3 from anti-HIV_cap256-206-096276_VR-Chain
caggagcaacugguggaaagcggcgggggagucguucccccugguuccucucucagacuuucaugcguggccaguagguucaccuuuagcgcuuucggcaugcacuggguacggcaggcaccagggaagggacuggaguggguggccggcaucuccuuugucgguauuaaaaaguacuaugcggacucugugaaagggcgcuucacaauaucgcgagauaacucaaagaauacuuuguuuuuacagaugaacggacugcguggcgaagacacgggccuauacuauuguguuaaagauaugagagagcucgaaugcgaggaguggaggagcgacuacuaugauuucgggaagccgaaucagcccuaccuggaccggcgcggagugagugguaucuccgcuuuuuggggccaagggaccauggucacagugucuagc

SEQ ID NO: 24625 - RNA, 438 nt, Artificial Sequence
  derived and/or modified sequence opt3 from anti-HIV_cap256-206-092794_VR-Chain
cagaugaugcugguggagagcggcgggggagucguugaacccgguagaucccucacccuuucuugcgccacaucacaauucacuuuuaguaacuacggcaugcacugggugaggcaggcuccugggcggggacuggaguggguagcaagcaucuccaaugaaggcaacaagcgcuaucauggugagucugugugggggcgauucauuauaucgcgugacaauagcaaaaacacguuguuuuuacacaugucaacccugagagccgaugacagugcgcuauacuucugugucagggaucggcaggaagacgagugcgaggaauggugguccgauuauuacgcuuuuggacgcggcggcccauguagaaaguaucaugggcagggacucgccgguaucuucgacauugugggcagggggacacugguuacugugucuagc

SEQ ID NO: 24626 - RNA, 432 nt, Artificial Sequence
  derived and/or modified sequence opt3 from anti-HIV_cap256-206-086817_VR-Chain
caggagcaacugguggaaagcggcgggggagucguucccccugguaagucccucagacuuucuugcgccgcuucaggcuucaguuuuggggcauucggaaugcacugggugaggcaggccccaggcaaaggucuggaguggguagcggggaucagcuuugugggaauuaaguacuauuacgcugacuccgucaaaggccgguucaccauaucucgcgauaacucgaagaauacaguguuuuugcagaugaacggcuuacgaggggacgauacuggacguuauuacuguguuaaagacaugagagaacuggagugcgaagaguggacgucagauuauuacgacuucgguaagccgcagcccuguaucgauaggcggggcgugagcgggauuagugccauguggggacaaggcaccauggucacaaucuccucu

SEQ ID NO: 24627 - RNA, 432 nt, Artificial Sequence
  derived and/or modified sequence opt3 from anti-HIV_cap256-206-086446_VR-Chain
caggagcaacugguggaaagcggcgggggagucguucccccugguaagucccuccggcuuucuugcguggccucaagguucaccuuuagugcuuucggcaugcacuggguacggcaggcaccagggaaaggacuggaguggguggccggcaucagcuuugucgguauuaagaaauacuauuccgacgcggugaaggggcgcuucuacauaucucgagauaacucgaaaaauacauuguuuuuagaaaugaacggacugcguggcgacgauacugcuagauauuacuguguuaaggaccuaagggagcucgaaugcgaggagugggccucagauuauuacgacuucggcaagccgcagcccugucuggauagcagaggggugaguggaaucuccgcaauguggggucagggcacgauggucaccgugucuagc

SEQ ID NO: 24628 - RNA, 432 nt, Artificial Sequence
  derived and/or modified sequence opt3 from anti-HIV_cap256-206-086180_VR-Chain
caggagcaacuggaagagagcggcgggggagugguucccccugguaagucccucagacuuucuugcgucgccucaagguucaccuuuagugcuuucggcaugcacugggugcggcaggcaccagggaaaggacuggaauggguagccggcaucagcuuuguggguauuaagaaauacuaugcggacuccgucaaggggcgcuucacaauaucucgagauaacucgaaaaauacuuuguuuuuacagaugaacggacugcguggcgacgauacgggccuauacuucugugugaaggacaugagagagcucgaaugcgagcaguggaccucagauuauuacgacuuugggaagccgcaacccuguaucgauccuaggggaguuagcgguauuagugcuauguggggccaggggacaauggugacugucuccucu

SEQ ID NO: 24629 - RNA, 435 nt, Artificial Sequence
  derived and/or modified sequence opt3 from anti-HIV_cap256-206-083708_VR-Chain
caggagcaacugguggaaagcggcgggggagucauucccccuggucagucccuccggcuuucuugcguugccucaagguucaccuuuagugcuuucggcaugcacugggugcggcaggcaccagggaagggacuggaguggguaagcuccgugucuuuugccggcaucaaaaaguacuaugcggacucggucaaaggucgcuucuuuauaucacgagauaacagcaagaauacaguguucuuggaaaugaacggguuacguggagaggacacuggccuguacuauuguguuaaagauaugagagaacuagagugcgaggaaugggcuagugacuacuaugauuuuggcaagccggaccagcccugucucgauaggagagggguguccggaaucucugccauguggggucaaggcacgcuggucauugugagcucc

SEQ ID NO: 24630 - RNA, 432 nt, Artificial Sequence
  derived and/or modified sequence opt3 from anti-HIV_cap256-206-079556_VR-Chain
caggagcaacugguggaaagcggcgggggagucguucccccugguaagucccucagacuuucuugcguggccucaggcuucaccuuuaguggguucggaaugcacuggguaaggcaggcuccaggcaaaggucuggaguggguggcagggaucagcuuugucggaauuaaguacuauuacgccgacuccgugaaaggccgguucucuauaucgcgcgauaacucaaagaauacauuguuuuuacagaugaacggccugcgaggggacgauacugcgcuauauuacuguguuaaagacaugcgugaacucgagugcgaagaguggacgagcgauuauuacgacuucggaaagccgcagcccuguaucgauagaaggggugugaguggcauuuccgcuaugugggggcaaggaaccauggucacagugucuagc

SEQ ID NO: 24631 - RNA, 438 nt, Artificial Sequence
  derived and/or modified sequence opt3 from anti-HIV_cap256-206-078657_VR-Chain
cagaugcugcucguggagagcggcgggggagucguugaacccgguagaucccuuacccugucuugcgccacaucacaauucacuuuuaguaacuacggcaugcacugggugaggcaggcuccugggcggggauuggaguggguagcaagcaucuccaaugaaggcucuaagaaauaucauggugagccagugugggggcgcuucauuauaucgcgagacaacucaaagaaaacguuauuucugcacaugagcaaucuacgugucgaugacagugcccucuacuucugugugagagauaggcaggaagacgagugcgaggaauggugguccgauuauuacgcguuuggacggggcggcccgugucgcaaguaucaugggcagggacuggcugguaucuucgacauuuggggcagagggaccaugguuacagugucuagc

SEQ ID NO: 24632 - RNA, 438 nt, Artificial Sequence
  derived and/or modified sequence opt3 from anti-HIV_cap256-206-075802_VR-Chain
cagaugcugcucguggagagcggcggggacgucguugaacccggaaagucccuuacccugucuugcgccacaucaagauucacuuuuaguaacuacgguaugcacugggugaggcaagcuccuggcgggggauuggaguggguagcaagcaucuccaaugaaggcaacaaaaaguaucauggugagucugugugggggcgguucauuauaucgcgcgauaauagcaaaaacacguuauuucugcacaugucagcccuacgaaccgacgauagugcgcucuacuucuguguccgugacagacaggaagaugagugcgaggaauggugguccgacuauuacgcuuuuggaaggggcggcccaugucggaaguaucaugggcagggacuggccgguaucuucgauauuuggggccgcgggacaauggugacuguuucuagc

SEQ ID NO: 24633 - RNA, 438 nt, Artificial Sequence
  derived and/or modified sequence opt3 from anti-HIV_cap256-206-069097_VR-Chain
cagaugcugcucguggagagcggcgggggagucguugaacccgguagaucccuuacccugucuugcgccacaucaagguucacuuuuaguaacuacggcaugcacugggugcggcaagcuccugggcgcgaguuggaauggguagcaagcaucuccaaugagggaaacaagaaauaucaugccgaaucuguguggggccgauucauuauaucgcgugacaauucaaagaacacguuauuucugcacaugagcaaugucagaggugaugacagugcgcuauacuucugugugagggaucggcaggaggacgagugcgaagaguggugguccgauuauuacgcuuuugggcgcggaggcccauguagaaaauaucauggccaggggcucgccggaaucuucgacguuugggguaggggcaccguggucacagugucuagc

SEQ ID NO: 24634 - RNA, 438 nt, Artificial Sequence
  derived and/or modified sequence opt3 from anti-HIV_cap256-206-067758_VR-Chain
cagaugcugcucguggagagcggcgggggagucguugaacccgguagaucccuuacccugucuugcgccgcuucacaauucacauuuagucacuacggcaugcauugggugaggcaggcaccugggcggggauuggaguggguagccagcaucuccaacgaaggcaauaagcgcuaucacggugagucugugugggggcgauucauuauaucgcgugacaacagcaaaaauacuuuauuucugcauaugucagcgcuaagaacggaugacagugcucucuacuucugugucagggaucggcaggaagacgagugcgaggaauggugguccgauuauuacgccuuuggacgcggcggcccauguagaaaguggcacgggcagggacuggcagguaucuucgacauuuggggcagggggaccgugguuacagugucuagc

SEQ ID NO: 24635 - RNA, 417 nt, Artificial Sequence
  derived and/or modified sequence opt3 from anti-HIV_cap256-206-057019_VR-Chain
caggagaagcugguggaaagcggcgggggagccguccaacccgguggcucccucagacuuucuugcguugcuucaggguucaguuuuagcggauacggcaugcacugggugaggcaggcaccugguaaagggcuggagugguuggccaccaucuccuucucuggaguaaagaaauauuacggcacaucggcgaagggccgguuuuauauuuaccgcgacaacacuaaaaauacgauguauuuagaaaugaacgggcugcgaggagaggauaccgcucuauacuauugugccaaggaccuccguuaccuggaaugcggugaguggucaacauacuauccacagccgugucuugauacuagaggcgugagcgggauaaguaaugucuggggacccggcaccauggugacaguuuccucu

SEQ ID NO: 24636 - RNA, 438 nt, Artificial Sequence
  derived and/or modified sequence opt3 from anti-HIV_cap256-206-055385_VR-Chain
cagaugaugcugguggagagcggcgggggagucguugaacccgguagaucccucacccuuucuugcgccgcuucaaaguucacauuuaguaacuacggcaugcacugggugaggcaagcaccugggcggggacuggaguggguagccagcaucuccaaugaaggcaacaaaaaguaucauggugagccagugugggggcgcuugauuauaucucgagacaauucgaaaaacacuuuauuccugcacaugucagaucuacgugcggacgauagcgcucucuacuuuugugucagagacaggcaggaagaugagugcgaggaaugguggaguaauuauuacgccuucggacggggcggcccgugucgcaaguggagagggcagggacuggcagguaucuuugacguguggggcagggggacgaugguuaccguguccucu

SEQ ID NO: 24637 - RNA, 435 nt, Artificial Sequence
  derived and/or modified sequence opt3 from anti-HIV_cap256-206-053187_VR-Chain
caggagcaacugguggaaagcggcgggggagucguucccccugguuccucucucagacuuucaugcguggccaguagguucaccuuuagcgcuuucggcaugcacuggguacggcaggcaccagggaagggacuggaguggguggccggcaucuccuuugucgguauuaaauacuauuacgcggacucugugaaggggcgcuucacaauaucgcgagauaacagcaaaaauacuuuguuuuuacagaugaacggacugcguggcgaagacacgggccuauauuacuguguuaaggauaugagagagcucgaaugcgaggagugggcuucagacuauuacgauuucgggaaaccgaaucagcccugucuggacaggcggggagugagugguaucuccgccuuuuggggccaagggaccauggucacagugucuagc

SEQ ID NO: 24638 - RNA, 438 nt, Artificial Sequence
  derived and/or modified sequence opt3 from anti-HIV_cap256-206-053139_VR-Chain
cagaugcugcucguggagagcggcggggacgucguugaacccggaagaucccuuacccugucuugcgccacaucacaauucacuuuuaguaacuacgguaugcacugggugaggcaggcuccuggccggggguuggaguggguagcaagcaucuccaaugaaggaucuaagaaauaucauggcgagucgguguggggucgcuucauuauaucacgagauaacagcaagaauacguuauuucugcacaugaccacacuacguccagacgauagugcccucuacuucugugucagagacaggcaggaagaugagugcgaggaauggugguccgacuauuacgcguuugggcggggaggcccgugucgcaaauaucauggccaggggcuggcuggaaucuucgauauuugggguagaggcacuauggugaccguuucuagc

SEQ ID NO: 24639 - RNA, 432 nt, Artificial Sequence
  derived and/or modified sequence opt3 from anti-HIV_cap256-206-050350_VR-Chain
caggagcaacugguggaaagcggcgggggagucguucccccugguaagucccucaaacuuucuugcguggccucaagguucaguuuuggcgcuuucgggaugcacuggguaaggcaggcaccaggaaagggccuggaguggguggccgguaucagcuuugucgggauuaaaaaguacuaugcggacuccgugaaaggacgguucuacauaucucgcgauaacucgaagaauaccguguuuuuggaaaugaacgcuuuacgaggcgaggacacagcccuguaucauuguguuaaggauaugcgugaacuagagugcgaggaaugggcaucagacuacuaugauuucggcaaaccgcagcccugucucgacagaagaggggucagcggaaucagugccaugugggguccuggcacuauggugauuguauccucu

SEQ ID NO: 24640 - RNA, 432 nt, Artificial Sequence
  derived and/or modified sequence opt3 from anti-HIV_cap256-206-046207_VR-Chain
caggagcaacugguggaaagcggcgggggagucguucccccugguaccucccuccggcuuucuugcguggccucaagguucacauuuagugcuuucggcaugcacuggguacggcaggcaccagggaagggacuggaguggguggccggcaucagcuuugcggguauuaaaaaguacuaugcugacuccgucaaagggcgcuucacuauaucucgagauaacucgaaaaauucauuguuuuuagaaaugaacggacugcguggcgacgauacggcccuauacuauugugugaaggaccucagauaccuggagugcgaacuuuggaccagcgauuauuacgacuucggcaggccgcagcccuguaucgauaguagagggguuuccggaauuucugcaaugugggguccuggcacaauggugacugucagcgcc

SEQ ID NO: 24641 - RNA, 417 nt, Artificial Sequence
  derived and/or modified sequence opt3 from anti-HIV_cap256-206-043389_VR-Chain
caggagaagcugguggaaagcggcgggggagccguccaacccgguggcucccucagacuuucuugcguugcuucaggguucaccuuuaguggauucggcaugcacugguuuaggcaggcaccugguaaagggcuggaguggguggccacaaucagcuucuccggaauuaagaaauacuauaacacuucugcgaagggccgguuuuucauaucgcgcgacaauacgaaagauaccuuguacuuacagauggacggccugcaggaaaaggauacagcucuauaucucugugccaaggaccugcgauaccuugagugcggguauuggucaacuuacuauccacaaccgugucuggauacccguggaguaagcgguaucaguaacguguggggccccgggacaauggucaccguguccucu

SEQ ID NO: 24642 - RNA, 432 nt, Artificial Sequence
  derived and/or modified sequence opt3 from anti-HIV_cap256-206-042555_VR-Chain
caggagcaacugguggaaagcggcgggggagucguucccccugguaagucccucagacuuucuugcgugguaucaggcuucaccuuuagugccuucgggaugcacugggugaggcaggcuccaggaaaaggccuggagugggucgcagguaucagcuuugccgggacaaaguccuacuaugcggaaucugugaaaggacgguucacuauuucgcgcgacaacucaaagaauagcuuguuuuuacagaugaacggccugcgaggcgaugacacggcucuauacuauuguguuaaagauaugcgugagcucgaaugcgagcuguggaccagugacuacuaugauuucgggagaccgcagcccuguauagacaggcggggaguguccgguaucucugccauguggggccaagggacaauggucacuauuagcucc

SEQ ID NO: 24643 - RNA, 432 nt, Artificial Sequence
  derived and/or modified sequence opt3 from anti-HIV_cap256-206-029720_VR-Chain
caggagaagcugguggaaagcggcgggggagucguucaacccgguagaucccucacccuuucuugcguggccucacacuucacauuuaguggcguagggaugcauugggugaggcaggcuccuggaaaaggccuggagugggucgcagguaucagcuucgccgggacucggaaguacuaugcggacuccgugaaaggacgcuuuacgauuucucgagauaacucgaagaauaccguuuacuugcagaugaacggcuuacguggcgaagacacagcucuguaucacugugccaaagaucuaagagagcucgaaugcgagcuguggacuucagacuacuaugauuucgggaggccacagccguguauagaccggcgcggagugagcgguaucugcgauauguggggccaagggaccauggucauugugaguucc

SEQ ID NO: 24644 - RNA, 432 nt, Artificial Sequence
  derived and/or modified sequence opt3 from anti-HIV_cap256-206-028848_VR-Chain
caggagcaacugguggaaagcggcgggggagucguucccccugguaagucccucagacuuucuugcguggccucaggcuucaccuuuaguggguucggaaugcacuggguaaggcaggcuccaggcaaaggucugcaguggguggcagggaucagcuuugccggaacaaaguacuauuacgaggacuccgucaaaggccgguucacuauuucucgcgauaacucgaagaauacgguguuuuugcagaugaacggcuuacgaggggacgauaccgcgcuguauuacuguguuaaagacaugcgugaacuagagugcgaagaguggacaucagauuauuacgacuucggaaagccgcaacccuguauagauagaaggggugugagcggcaucagugcuaugugggggcagggaacuauggucaccauuuccucu

SEQ ID NO: 24645 - RNA, 432 nt, Artificial Sequence
  derived and/or modified sequence opt3 from anti-HIV_cap256-206-027652_VR-Chain
caggagcaacugguggucagcggcggggacguugugcccccuggaaagucccucagacuuucuugcguagccucagguuucaccuuuagugcuuucggcaugcacugggugaggcaggcaccagggaaaggacuggaaugggucgccagcaucuccuuugcgggcacaaaguacuauuacgcugauucugugaaaggucgguucgccauuucgcgcgacaacucaaagaauacuuuguuuuuacagaugaacgggcugcgacgugaggauacgggacuauauuacuguguuaaagacaugagacagcucgaaugcgaggaauggaccagcgauuauuacgacuucggcaggccgcaacccuguauagaucggcgcggcgugagugggaucuccgcaauguggggacaggguacaauggucacuauuucuagc

SEQ ID NO: 24646 - RNA, 417 nt, Artificial Sequence
  derived and/or modified sequence opt3 from anti-HIV_cap256-206-024075_VR-Chain
caggagaagcugguggaaagcggcgggggagccguccaacccgguggcucccucagacuuucuugcguugcuucaggguucaccuuuaguggauucggcaugcacugggugaggcaggcaccugguaaagggcuggagugguuggccacaaucagcuuuuccggaguaaagaaauacuauggcacuucugcgaagggccgguucuacauuucgcgcgacaacacgaaaaauaccguguauuuacagauggaugggcugcgaggagacgauacagcuauauacuauugugccaaggaccuacguuuucucgaaugcggucuguggucaacuuacuauccacagccgugucuugauaccagaggcgucagcgggaucaguaacguguggggacccggcacaaugguuaccguguccucu

SEQ ID NO: 24647 - RNA, 417 nt, Artificial Sequence
  derived and/or modified sequence opt3 from anti-HIV_cap256-206-008748_VR-Chain
caggagaagcugguggaaagcggcgggggagccguccaacccgguggcucccucagacuuucuugcguugcuucaggguucaccuuuaacggauucggcaugcacugggugaggcaggcaccugguaaagggcuggaguggguagccacaaucaguuuuagcggagugaagaaauacuauggcacuuccgcgaagggccgguucuuuauuucucgcgaaaauucgaaaaacacguuguacuuacagaugaaugggcugcgaggagaggacaccgcucuauauuacugugccaaggaucuccguuaucuggaaugcggugaguggucaacauacuauccacagccgugucuugacacuagaggcgucagcgggauaaguaacguguggggacccggcaccaggguuacaguguccucu

SEQ ID NO: 24648 - RNA, 432 nt, Artificial Sequence
  derived and/or modified sequence opt3 from anti-HIV_cap256-206-008530_VR-Chain
caggagcaacugguggaaagcggcgggggagucguucccccugguaagucccucagacuuucuugcguggccucaggcuucaguuuuggggcuuucggaaugcacuggguaaggcaggcaccaggcaaaggucuggaguggguggccgggaucagcuuugucggaauuaaguacuauuacgcggacuccgugaaaggccgguucaccauaucucgcgauaacucgaagaaaacauuguuuuuacagaugaauggccugcgaggggacgauacugcucuauauuacuguguuaaggacaugcgugaacucgagugcgaagaguggacgucagauuauuacgacuucggaaagccgcagcccuguaucgauagaaggggugugagcggcauuagugccuuuugggggcaaggaaccauggucacaaucuccucu

SEQ ID NO: 24649 - RNA, 432 nt, Artificial Sequence
  derived and/or modified sequence opt3 from anti-HIV_cap256-176-723043_VR-Chain
caggagcaacugguggaaagcggcgggggagucguucccccugguaagucccucagacuuucuugcguggccucaggcuucaccuuuagugcuuucgggaugcacuggguaaggcaggcaccaggaaaaggccuggaguggguggccggugucagcuuugcggggaucaaguacuauuacgcugacuccgugaaaggacgguucacaauuucucgcgauaacucgaagaauacuuuguuuuuacagaugaacggccugcgaggcgacgauacggcccuauauuacuguguuaaagaccuccgugaacuggagugcgaagaguggaccucagauuauuacgacuucgggagaccgcagcccuguauagauccuaggggagugagcgguaucagugcaauguggggccaagggacagucgugacuauuuccucu

SEQ ID NO: 24650 - RNA, 432 nt, Artificial Sequence
  derived and/or modified sequence opt3 from anti-HIV_cap256-176-600049_VR-Chain
gaggugcagcugguccaaagcggcgggggaguugugcagcccgguagaucccucaggcuuucuugcgccgcuccuuacuucgaauuuggccgguauggguuccacuggguacgccaggcaccaggaaagggccuggaguggguggccucaaucaguuuugcgggucgaggguacuaucauagcccguccgucuggggacguuucaccauuucuagagacaacucgaaaaauacauuguacuuacagaugaacucacugaggauagaagauacugcucuauauuuuugugcccgggaccuccgcgagagcgaaugcgaggagugggaaagugauuacuaugacuucggcaagaaaggccccugugugaagccuagagggguugcaggaggucuggaucuuuggggccaagggacgauggugaucgucuccucu

SEQ ID NO: 24651 - RNA, 432 nt, Artificial Sequence
  derived and/or modified sequence opt3 from anti-HIV_cap256-176-531926_VR-Chain
caggugcaacuggucgagagcggcgggggaguugugcccccugguaagucccucacccuuucuugcguagccucaagauucacauuuagugcuuucggcaugcacugggugaggcaggcaccagggaaaggacuggaaugggucgccggcaucagcuuuguggguauucggaaguacuaugcggacuccguuaaagggcgcuucucuauaucgcgagauaacucaaagaauacuguguuuuuggagaugaacggauuacguggcgaagacacgggccuguacuauugugucaaagauaugagagagcuagaaugcgaggagugggcuagcgacuacuaugauuucgggaagccgcagcccugucucgacaggcggggagugagugguaucuccgccauguggggccaggggacccugguaauuaucucuagc

SEQ ID NO: 24652 - RNA, 432 nt, Artificial Sequence
  derived and/or modified sequence opt3 from anti-HIV_cap256-176-504134_VR-Chain
gaggugcagcuggucgaaagcggcgggggaguugugcccccugguaagucccucagacuuucuugcguaaccucaaggcuggccuucggcgcuuuugggaugcacugggugcggcaagcaccaggaaaaggcuuggagugggucgccaguaucagcuucgcggguauuaagaaauacuaugcugacuccgugaaggggcgcuuuacaauaucucgagauaacucgaaagacacuguuuucuuagaaaugaauggacugcguggcgaugacacgggccuauacuauugugugaaggauaugagauaccucgagugcgaagagugggccucagacuauuacgauuuugggaggccgcagcccugucuggacccucggggagucagcgguaucagugcaauguggggccaggggacccuugugauuaucuccucu

SEQ ID NO: 24653 - RNA, 432 nt, Artificial Sequence
  derived and/or modified sequence opt3 from anti-HIV_cap256-119-186229_VR-Chain
cagaugcaacugguggagagcggcgggggagucguucagcccgguggcucccucaggcuucugugcucugccucaggguucaccuuuaguacauacggaaugcacugggugaggcaggcuccuggcaaggguuuggaauggguagcaagcaucuccuaugacgggucugauaaauaccaugccggauuaguguggggccgguucauuauaucgcgcgacaacucaaagaauacucuguaucuacagaugaacagccuccgagcggaggauacggcucuguacuauuguguccgugacgaaagagagagugaaugcgagcuuugggaguccgauuacuauaauuuuggcaaaaagcugccaugugugaaaccgagagggguugccggaaccuuggacaucuggggucaaggcacaacugugauugucucuagc

SEQ ID NO: 24654 - RNA, 432 nt, Artificial Sequence
  derived and/or modified sequence opt3 from anti-HIV_cap256-119-183891_VR-Chain
caggugcaacuggucgagagcggcgggggaguugugcagcccgguggcucccuccggcuuucuugcgccgcuucaggguucaccuuuaguagcuacggaaugcacuggguaaggcaggcaccuggcaagggucuggaauggguggccuucacacgguaugacggguccgauaaauacuauuuggacucugucaagggacgcuuuacuaucucgcgagauaacucaaaauacacguuauuccugcagauggugagccuacguaccgaggacacagcgcucuauuuuugugcuagagaucugagggaaagugagugcgaagagugggaguccuacuauuacgacuucggcaagaaaggcccauguguuaagccgagagggguggucggagugcuugauauuuggggucaaggcacucugguaaccguuucuagc

SEQ ID NO: 24655 - RNA, 435 nt, Artificial Sequence
  derived and/or modified sequence opt3 from anti-HIV_cap256-119-183631_VR-Chain
caggugcaacugguccagagcggcgggggaguugugcagcccgguagaucccucaggcuuucuugcgccgcuucaaaguucaccuuuaguacauacacucugcacuggguacggcaggcaccuggcaaaggguuggaguggguggccgucaucagccaugacggaggcaaccgcuucuaugcggauuccgugaagggucgauuuacgauuucucgugacaauucgaaaaacaauuuauuccugcaaaugaacucacuaagaguugaagauaccgcucucuacuauugugccagggaccugcgggagauggaaugcgaggaauggacacuuuacaauuauuacgauuuugggagccgcggaccauguguggacccgagaggcgucgugggcaguuucgauguaugggggcagggaacuaugguuaccguguccucu

SEQ ID NO: 24656 - RNA, 432 nt, Artificial Sequence
  derived and/or modified sequence opt3 from anti-HIV_cap256-119-182676_VR-Chain
caggugcaacuggucgagagcggcgggggaguugugcagcccgguaagucccucaggcuuucuugcguagugucaggcuucaccuuuaguaacuacccuaugcacugggucaggcaggccccagggaaaggacuggaauggguggcuagcaucuccuucgcaggcauuaagaaauauuacggugacucuguuaaggggcgguuuacaauaucgcgcgauaauagcaaaaacacuuuguauuuacagauggacggacugcgaggcgaggauacggcccuauacuauugugcgaaggaccuccgugaacuggagugcgaagagugggcuucagauuacuaugacuucggcagaccgcaacccugucuugauccuagaggggugaguggaaucuccaaugucuggggucagggcaccauggugacaguaucuagc

SEQ ID NO: 24657 - RNA, 432 nt, Artificial Sequence
  derived and/or modified sequence opt3 from anti-HIV_cap256-119-180772_VR-Chain
caggugcaacuggucgagagcggcgggggaguugugcagcccgguagaucccucaggcuuucuugcgccgcuucagaguucaccuuuaguaacuacgcaaugcacuggguacggcaggccccuggcaaggggcuggaauggguggcgagcaucuccuucgacggacgcgauaaauaucauucuucguuggucuggggccgauuaacaauuucacgugacaauagcaagaguacucuguuucuacagaugaacucccucagaccagaagauacggcucuguacuauugugccagggacgugcgggagucugaaugcgaggaguggcaaagcgauuacuaugcauucuaccgcaaacuuccguguguuaagcccagagguguggccgggacccuggacauauggggacagggcacaauggucacuguguccuca

SEQ ID NO: 24658 - RNA, 435 nt, Artificial Sequence
  derived and/or modified sequence opt3 from anti-HIV_cap256-119-180508_VR-Chain
caggugcaccuggucgagagcggcgggggaguugugcaacccgguagaucccucaggcuuucuugcgccgcuucacauuucagucugagcuccuacggcaugcacuggguacggcagaccccugggaagggauuggaauggguggcaggcaucucuuuugccggugucaagacauauuacgggacuucggugaagggacgcuucacgauuucacgagacaacagcaaaaauaacuuauaucugcagaugaauagucuacguccagaggauaccgcgcucuacuauugugcuagagaccugagggaaauggagugcgaagaguggaaacuuuacaacuauuacgauuuucggacacgcggcccguguguugaccccagaggcguggucggguccuucgauguguggggacaggguacuguaguuaccgugucuagc

SEQ ID NO: 24659 - RNA, 432 nt, Artificial Sequence
  derived and/or modified sequence opt3 from anti-HIV_cap256-119-180260_VR-Chain
gaggugcagcuggucgaaagcggcgggggaguugugagacccgguggcucccucaggcuuucuugcgccgcuucacaauucaccuuuaguaacuucgggaugcacuggguacggcaggcaccuggaaagggccuggaguggguggccagcaucuccuuugucgguauuaaaacacauuacgcuaauucugugcgcgggcgauucacuauaucgcgugaccagucaaagaacacguuguauuuacagaugaauagcguuagaguggaagauaccggaagguacuauugugcgcgggacaugcgcgaguacgaaugcgagcugugggccagugauuauuacgacuuuggcaaaccacaaccgugugaggaucccagaggcgucguggggacauucgacauguggggacuagguacucucguaaccguuuccucu

SEQ ID NO: 24660 - RNA, 432 nt, Artificial Sequence
  derived and/or modified sequence opt3 from anti-HIV_cap256-119-180173_VR-Chain
gaggugcagcuggucgaaagcggcgggggacucguucaacccgguggcucccuuaggcugucuugcgccgcuucaggguucaccgugaguagcaacuacauguccuggguaaggcaggcaccuggaaagggcuuggaguggguggccucuaucucguuugcggguacuaaaaagcacuauggaaauucagucaaagggcgguucacaauuagccgcgacaacaguaagaauacguuauaccugcagaugaacucccuacgaggcgaagauaccgcucucuauuacugugccaaagaccugcgugaguaugaaugcgaggaguggacaucugauuacuaugacuuuggcagaccacagccguguauagauagcagaggggugguuggaauccuugacauuuggucccaagguacuauggugaccgucucaagu

SEQ ID NO: 24661 - RNA, 432 nt, Artificial Sequence
  derived and/or modified sequence opt3 from anti-HIV_cap256-119-179839_VR-Chain
caggugcaacuggucgagagcggcgggggaguugugcagcccgguagaucccucaggcuuucuugcgccgcuucaggcuucaguuuugggaccagcgacguacacugggugcggcaggcaccuggagaaggccuggagugggucgccuugaucuccuucgauggucgccagaaggacuuagcggauucugugcgagggcguuuuacaauuucgagagacucaagcaaaaacacucuguaccuagaaaugaauagucucaggccagaggauacggcucuguauuacugugccaaggacaugcggggauaugaaugcgaggaguggaccuccgauuacuaugacuucggccgcccgcaacccuguauagauucuagaggcguuguggggacauuugacgucuggggacaggguacuauggugaccguaagcucc

SEQ ID NO: 24662 - RNA, 423 nt, Artificial Sequence
  derived and/or modified sequence opt3 from anti-HIV_cap256-119-179262_VR-Chain
caggugcaacuggucgagagcggcgggagaguugugcaguccggagguucucucaggcuuucaugcggcgccaguggguucagcuuuaccacauccgcuaugcacuggguacggcaggcacccggaaagggccuggaauggguggccaucaacggugcgaauaaacauuacgcugagucugucaaggggcgcuucacuauuucgcgagacaacagcaaaaauacguuguuuuuagaaaugaacucacugcguccugaugacaccgcccuauauuucugugugaaggaucagagagaggacgaaugcgaggagugguggagugauuacuaugacuuuggaagggaacaaccaugucucgauccgcggggcguugugggcauauucgaccugugggggcagggaacaauggucacuguguccucu

SEQ ID NO: 24663 - RNA, 432 nt, Artificial Sequence
  derived and/or modified sequence opt3 from anti-HIV_cap256-119-178995_VR-Chain
caggugcaacuggucgagagcggcgggggaguugugcagcccgguaagucccucagacuuucuugcgccgcuucaggcuucacccugacaagguuugcaaugcacuggguacggcaggccccugggaaaggauuggaauggguggcggucaucugguacgacggcaguaacaaguauuacgcugauagcgugaaaggucgcuucacuguuucccgagacaauucuaagaacacguuauaucugcagaugaacucgcuacguaccgaggauacagcccucuacuauugugugagagacaggcgggaaucagagugcgaacugugggagagcgauuacuauaauuuugggcgcagacuuccaugugucaaaccgaggggaguggcaggcauucuggacauauggggccaagggacuaccguaacaguuaguccc

SEQ ID NO: 24664 - RNA, 432 nt, Artificial Sequence
  derived and/or modified sequence opt3 from anti-HIV_cap256-119-178455_VR-Chain
gaggugcagcuggucgaaagcggcgggggacucguucaacccgguggcucccuuagacugucuugcgugguaucaggguucaccuuuaguaacuucuggaugagcugggugaggcaggccccuggaaagggcuuggagugggucgcuuccaucucuuacgacggucgggauaaauaucacucgucauuagugugggggcgccugacaauuagccgagacaauaguaaguccacucuauuucuccagaugaacucucugcgugcagaagauacggcccuuuacuauugugcgagagaccugagggagagcgaaugcgaggaguggcaguccgauuacuaugcuuucuacaaaaaguugccauguguuaaaccgcggggaguggccggcacccucgacauauggggccaagggacaauggucacugugucaagu

SEQ ID NO: 24665 - RNA, 438 nt, Artificial Sequence
  derived and/or modified sequence opt3 from anti-HIV_cap256-119-177993_VR-Chain
caggugcaccuggucgagagcggcgggggaguugugcaacccgguaagucccucagaaucuacugcgccguaucugaguucaccuuuucaaacuaugcuaugcauugggugaggcuugcaccuggccgggggcugcagugguuggccgucauuaguuacgacggaagcaaaaaguauuacgcggauuccuuagaaggccgcuucacaauaucuaaagacaauucgaagaacacucuguuucuacagaugaacucacuccgaguggaagauacggcucuguauuucuguguuaaagaccagcgugaggaugaaugcgaggagugguggagcgacuacuaugauuuuggugaaagagccccacuuccgaaggugcccgggccuggaccaggcuggaaucuggacauguggggccacgggaccauggucacagugaguucc

SEQ ID NO: 24666 - RNA, 438 nt, Artificial Sequence
  derived and/or modified sequence opt3 from anti-HIV_cap256-119-177727_VR-Chain
caggugcaacuggucgagagcggcgggggaguugugcagcccgguagaucccucaggcuuucuugcgccgcuucaggcuucacccugagucgguacgacaugcacuggguacgccaggcaccugggaagggauuggaauggguggccagcaucuccaaagauggcacaaagaaauaucauggugacucugucugggggcgauuuauuauaucgcgugauaacucaaagaauacuuuauuccugcagaugagcagucuaagagcggaggacacggcucucuacuuuugugugagggaucaacgggaagccgagugcgaagaguggugguccgacuauuacgauuucggacgcgagcugccauguagaaaauuuaggggccuuggccuggcagggaucuucgacauuuggggacacgguaccaugguuacagugucuagc

SEQ ID NO: 24667 - RNA, 432 nt, Artificial Sequence
  derived and/or modified sequence opt3 from anti-HIV_cap256-119-176746_VR-Chain
gaggugcagcuggucgaaagcggcgggggacucguucaacccgguggcucccuuagacugucuugcgccgcuucagacuucaccuuugaugacuacgcaaugcacugggugaggcaggccccugggaagggauuggaguggguaggcgguaucaguuaugaugggagcgacaaauaccauacaaauuccguguggggacgguucauugucucucgcgauaauucgaagaacacuuuauaucugcagaugaacucacuacgaccagaagacacggcgcucuacuauugugugcgugauagaagggagagcgaaugcgaggagcgguggagugacuacuaugauuuuggcaaacagcugccguguguuaagccccgcggcguggcugggauauucgacaucuggggacaagguaccauggucacaguguccucu

SEQ ID NO: 24668 - RNA, 432 nt, Artificial Sequence
  derived and/or modified sequence opt3 from anti-HIV_cap256-119-176241_VR-Chain
caggugcaacuggucgagagcggcgggggaguugugcagcccgguagaucccucaggcuuucuugcgccgcuucaggcuucaccuuuaguaacuacgcaaugcacuggguacggcaggccccugggaagggacuggaauggguggcggucaucagcuaugacggcuccaauaaauacuaugcugauucugugaagggucgcuucacaauuucgcgagacaacagcaaaaauacuuuguacuuacagauggaugggcugcguggagaggacacggcccuauauuacugugcaaaggaucucagagaacuggagugcgaagagugggccucagacuauuacgauuuuggcaggccacaaccgugucuugacccccggggcguuagugggauauccaacguguggggacaggguaccauggucacagugucuagc

SEQ ID NO: 24669 - RNA, 432 nt, Artificial Sequence
  derived and/or modified sequence opt3 from anti-HIV_cap256-119-175215_VR-Chain
caggugcaacuggucgagagcggcgggggaguugugcagcccgguagaucccucaggcuuucuugcgccguaucacaguucaccuuuggccgguacgggauguauugggugcgccaggcuccuggaaagggccuggaaugggucgcagguaucaguuacgacgggagcgauaaauaucacacaaacuccguguggggacgauucauuguuucucgugacaauucgaagaacauguuguacuuacaaaugaauaaccugagaccagaggauacugcccuauauuacugugugagggaccggcgcgaaucagagugcgaagagagauggagcgauuauuacgacuuuggcaaacagcucccgugugucaagcccaggggcguggcggggauauucgauaucuggggacaggguacgaugguaaccguuaguucc

SEQ ID NO: 24670 - RNA, 432 nt, Artificial Sequence
  derived and/or modified sequence opt3 from anti-HIV_cap256-119-173928_VR-Chain
ggcguggagcugcucgaaagcgggggaggucuugucgagcccggcgggucccugcgguugucuugcguuggaucacaguucaguuuugacagguacggcaugcacugggugcggcaagccccugguaagggguuagaauggguagcugcagugagcuucgauggaaccgacaaauaucaugccgaugacgucuggggccgcuuuacaaucucccgagauaacucuaagaauacucuguaccuacagaugaacucgcuccgugcggaggacacggcucuguauuacugugccaaagaucuuagagaagacgagugcgaggaaugguggucagauuauuacgaccugggcaagcaguugccauguaggaaaagcagagggguggcaggaguucucgauaaguggggucugggcaccauggugacagucaguucc

SEQ ID NO: 24671 - RNA, 432 nt, Artificial Sequence
  derived and/or modified sequence opt3 from anti-HIV_cap256-119-173495_VR-Chain
caggugcaacuggucgagagcggcgggggaguugugcagcccgguaagucccucagacuuucuugcgccgcuucaagguucaccuuuaaccgguacggcaugcacuggguacgccaggcaccugggaaaggacuggaauggguggccgcgaucaguuucgacggcacagauaaguaucauagcgacgaugucuggggucgauuuacuauuucccgugacaauucuaaaaacacguuguacuuacagaugaacucgcugagagcugaggauaccgccguguauuacugugcaaaggaccuaagggaagaugagugcgaggaacgguggucagacuauuacgauuucgggaaacaacucccaugucgcaagagcagaggaguugccggcauauuugacaauuggggccaggggacaauggugacugucaguucc

SEQ ID NO: 24672 - RNA, 432 nt, Artificial Sequence
  derived and/or modified sequence opt3 from anti-HIV_cap256-119-172882_VR-Chain
caggugcaacuggucgagagcggcgggggaguugugcagcccgguagaucccucacccuuucuugcgaaguaucaggcuucacauuuaagacuuacgggaugcacugggugaggcaggccccuggaaaaggccuggagugggucgcuaguaucagcuaugacgguuccgauaaguaccaugcagaccgggugugggggcgcuucacgauuucucgagauaacucgaaaaauaccuuguauuuacagaugaacucacugcgugccgaagacacagcgcuauacuauuguguuagagaugcuagggagagcgaaugcgagcucugggagagugacuacuauaauuuuggacggaagcugccaugugugaaaccgcgcggcgucgccggcacucuugauauaugggggcaaggaaccauggugacaguauccucu

SEQ ID NO: 24673 - RNA, 432 nt, Artificial Sequence
  derived and/or modified sequence opt3 from anti-HIV_cap256-119-172429_VR-Chain
gaggugcagcuggucgaaaccggcgggggacucauccaacccgguggcagccuuagacuguccugcguugccucucaguucacauuuucaggguguggauugcacugggugaggcaggcuccuggcaaggguuuagaguggguagcaaguauuagcuucgccgggacuaaaaagcauuacggaaacuccgugaaaggccgguuuacgauaucucgcgacaauucgaagaacacccuguaucuagaaaugaauacacuccgagcggaggauacugcucuguacuauugcgccaaagaccuucgugaauacgagugugaggaauggaccucagauuauuacgacuucggcagaccacagccgugcaucgauagcaggggagucguggggauucuggacaucuggggucaaggcacaaugguuaguguguccucu

SEQ ID NO: 24674 - RNA, 432 nt, Artificial Sequence
  derived and/or modified sequence opt3 from anti-HIV_cap256-119-172223_VR-Chain
caggugcaacuggucgagagcggcgggggaguugugcagcccgguagaucccucaggcuuucuugcgccgcuucaggcuucaccuuuaguagcuacgcaaugcacuggguacggcaggccccugggaagggacuggaauggguggcggucaucuccuaugacggccgcgauuucuaccaugcucgaucuguguggggucguuuuacaauuucgagagacaacagcaaaaauacuuugcacuuacagaugaacucacugaggccagaggauacggcccuauauuucugugcacgggaccuccgcgaaagugagugcgaagagugggaguccuacuauuacgauuuugggaagaaagacccguguguuaagcccagaggaguggucggcgugcuggauauauggggccaagggacccuuguaacaguuucuagc

SEQ ID NO: 24675 - RNA, 432 nt, Artificial Sequence
  derived and/or modified sequence opt3 from anti-HIV_cap256-119-171838_VR-Chain
caggugcaacugggcgagagcgggggaggugucguucagcccggcagaucccucaggcuuucuugcgccgcuucaggguucaccuuuaguacauucgcaaugcacugggugcggcaggccccuggaaagggccuggaauggguagcggugaucagcuacgacgguuccaauaaauauuacgcugauucugucaaggggcgcuuugccauuucgcgagacaaugccaaaaacuuguuacaucugcagaugaacucacuacguccagaggauacugcacucuauuacugugcuaaggaccugcaagaagaugagugcgaagagugguggagcgacuauuacgauuucggaaaacagcuuccguguagaaagaguaggggcguggcaggcauauuugacgauugggggcagggaacgaugguuaccguguccucu

SEQ ID NO: 24676 - RNA, 432 nt, Artificial Sequence
  derived and/or modified sequence opt3 from anti-HIV_cap256-119-171587_VR-Chain
gaggugcagcuggucgaaagcggcgggggacucguucaacccgguggcucccuuagacugucuugcgccgcuucaggguucaccuuuagugacuacuauaugagcuggaucaggcaggcaccuggaaagggcuuggaguggguggccuccauuucuuucgcggguacaaaacagcacuacgggaacucgguaaagggacgguuuacuauaucacgcgauaauagcaaaaacacgguguauuuacagaugaauagucugcgacuagaagacaccgcucucuacuauugugccaaggaucugcgugaguacgaaugcgaggaguggacauccgacuauuacgauuucggcagaccacaaccguguaucgacucuaggggcgucguggggauucuugauaucuggggacaggguacuaugguuaccgugagcucc

SEQ ID NO: 24677 - RNA, 432 nt, Artificial Sequence
  derived and/or modified sequence opt3 from anti-HIV_cap256-119-169596_VR-Chain
cuggugcagcucgucgagagcggcgggggaguugugcaacccgguagaucccuuaggcugucuugcaccgccucaggcuucacauuuaguagcuucgcuaugcaccggguacgccagacuccugggaagggauuggaauggguggcauccaucucuuacgacggcucggauaaauaucaugccgaccgagucuggggucguuuuacgauuucaagagauaacagcaagaauaccuuauaccugcagaugaacagucuaagggcggaggacacagcucucuauuacugugugcgggaugcccgcgaauccgagugcgaacugugggagucugacuauuacaauuucgggagaaaacuuccauguguuaagccgaggggaguggcaggcacucuggauauauggggccaggggaccauggucacagugagcucc

SEQ ID NO: 24678 - RNA, 432 nt, Artificial Sequence
  derived and/or modified sequence opt3 from anti-HIV_cap256-119-169523_VR-Chain
caggugcaacuggucgagagcggcgggggaguugugcagcccggugaaucccucagacuuucuugcgccgcuucaggcuucaguuuugggaccagcgacguacacugggugaggcaggcaccuggagagggccuggaaugggucgccuccaucucuuucgcggguauuaagaaauacuauggggauucggugaagggacgguuuacaauaucacgcgacaacagcaaaaauacuuuguacuuacagauggauggccugcgaggcgaggacacggcucuauauuacugugccaaggaucuccgugaacuggagugcgaggaaugggcaagugacuauuacgauuucgggagaccacaaccgugucuugaccccaggggaguuuccgguaucucuaacguguggggccaggggaccauggucacagugagcucc

SEQ ID NO: 24679 - RNA, 432 nt, Artificial Sequence
  derived and/or modified sequence opt3 from anti-HIV_cap256-119-169462_VR-Chain
gaggugcagcuggucgaaagcggcgggggacucguucaacccgguggcucccuuagacugucuugcgccgcuucaggguucaccuuuacaacuuacaguuugcacugggugaggcagagcccuggaaagggcuuagaguggguagcagccaucuccuucgcggguacgaaagaaaacuaugcuaauucugugcgggggcgcuuuaccauuucgcgagacaacucaaagaauacacuguaccuacagaugaacagccuccgugccgaggauacugcacuguauuacuguaccaaagacaugagagaauaugagugcgaggaauggacaagugauuacuaugacuucggaaggccacagccguguauagauucccggggcgucgugggcaccuuugacguuugggggcaaggaacuauggugacagucucuagc

SEQ ID NO: 24680 - RNA, 432 nt, Artificial Sequence
  derived and/or modified sequence opt3 from anti-HIV_cap256-119-169092_VR-Chain
gaggugcagcuggucgaaagcggcgggggacucguucaacccgguggcucccuuagacugucuugcgugaucucaggguucaccuuuaguagcuacgagaugaauuggguaaggcaggccccuggaaagggcuuggaauggguggcugguauuuccuaugacgggcgggauaaauaccacgcacauuucgucuggggacgcauaacaaucucucgagacaauucgaagaacacuuuauaucugcagaugaacucacuacgugccgaggauacggcgcucuaccacugugugagagaccugagggaaagcgagugcgagcuuugggaaagugauuauuacgacuuuggcaaaaagcugccauguguuaaaccgcggggcguggcugggauuuucgauuuguggggacaggguaccauggucacaguguccucu

SEQ ID NO: 24681 - RNA, 432 nt, Artificial Sequence
  derived and/or modified sequence opt3 from anti-HIV_cap256-119-168680_VR-Chain
caggugcaacuggucgagagcggcgggggaguugugcagcccgguagaucccucaggguaucuugcgccgcuucacacuucaccuuuagucgguacggcaugcauugggugcgccaggcaccugggaagggacuugaaugggucgccagcaucuccuaugacggccgagauuucuaccacgcgcguucugugugggguagauuugcuauuucgagggacaacagcaaaaauacacugcauuugcagaugaacucauuacggacugaggauacggcccuguaucacuguguucgcgaccuaagagaaagugagugcgaacucugggaguccgauuacuaugacuucgggaagaaacugccaugugugaagccgaggggagucgcaggcaccuuugaucuuuggggccaagggacaauggugacuguaucuagc

SEQ ID NO: 24682 - RNA, 438 nt, Artificial Sequence
  derived and/or modified sequence opt3 from anti-HIV_cap256-119-166385_VR-Chain
caggugcaacuggucgagagcggcgggggaguugugcaccccgguagaucccucaggcuuucuugcgccgcuucaggcuucaguuuugggaacuucggaaugcauuggguacggcaggcaccuggcaagggucuggaauggguggccagcaucuccaaugacgggaccaaaaaguaccacgcggagucugucugggaucgcuuuucgauuucaaaagacaacagcaagaauacauuguucuuacagaugaacagucugcgaguggaagauacugcucuauauuuuuguguuaaagaccagcgugaggaugaaugcgaggaguggugguccgacuacuaugauuucggaagagaacucccauguaggaagucucggggccugggccuugccgggauauuugacauguggggacaugguacgauggugaccgucagcucc

SEQ ID NO: 24683 - RNA, 432 nt, Artificial Sequence
  derived and/or modified sequence opt3 from anti-HIV_cap256-119-165943_VR-Chain
gaggugcagcuggucgaaagcggcgggggacucguucaacccggucggucccuuaggcugucuugcgccgugucaggcuucaccguaaguagcaacuacauguccugggugcggcaggcuccugggaagggauuggagugggucgcaucuaucucguuugccggcauuaaaaaguauuacggugacucagugaaagggcgcuucacaauaagccgagauaauaguaagaacacuuuauaucugcagauggacggacuacguggcgaagauacggcgcucuacuauugugcuaaagaccugagagagcuugaaugcgaggagugggccuccgauuacuaugacuuuggcaggccacagccgugucuggaucccagagggguuucuggaaucagcaauguguggggucaaggcaccauggucacaguguccuca

SEQ ID NO: 24684 - RNA, 432 nt, Artificial Sequence
  derived and/or modified sequence opt3 from anti-HIV_cap256-119-165738_VR-Chain
gaggugcagcuggucgaaagcggcgggggacucguucaacccgguagaucccuuaggcugucuugcgccgcuucaggcuucaccuuugacgauuacgcaaugaacugggugcggcaggccccugggaagggauuggaguggguagcgacaaucaguuucgacggcacugauaaauaucacgcugacgauguguggggucgcuuuacgauuagccgagacaauuccaagaaaaccuuauaccugcagaugaacucucuacgugccgaagauacagcacucuauuacugugccaaggaccugagagaggaugaaugcgaggagugguggucggacuauuacgaucuugggaaacagcugccauguaggaagucacggggagucgcuggcguguuggacaaguggggccucgggacuaugguuaccgugagcagu

SEQ ID NO: 24685 - RNA, 432 nt, Artificial Sequence
  derived and/or modified sequence opt3 from anti-HIV_cap256-119-164913_VR-Chain
caggaccaccugguggagagcggcgggggagguguccaacccggcaagucccucagacuuucuugcgccgcuucaggguucaccuuuagugcacaugccaugcacuggguuaggcaggcgccuggaaaaggcccagaauggguggcuguaaucagccaugauggugggcagcaguucuaccgggaguccgugaagggacgcuuuacaauuucucgagacaacucgaaaaauacucuguauuugcaaauggauggcuuacguggcgaagacacggcccuguacuauugugcaaaggaucuaagagagcucgaaugcgaggagugggccucagacuacuaugauuucgggaggccgcagcccugucuggacccucggggagucagcgguauaaguaacguguggggccaggggaccaugguuacaguguccucu

SEQ ID NO: 24686 - RNA, 432 nt, Artificial Sequence
  derived and/or modified sequence opt3 from anti-HIV_cap256-119-164167_VR-Chain
gaggugagacuggucgaaagcggcgggggacucauccagcccgguggcucccuuaggcugucuugcgccgcuucaggguugaccguuaguagcaaucacauguccugggugcggcaagcaccuggaaagggcuuagaguggguagccucuauuucguacgacggucgcgauuucuaucaugcgcgaucagugugggggcguuuuacaauaagcagagacaauaguaaaaacacucugcaccuacagaugaacucccucaggccagaagauacggcucuguacuucugugcccgggaccuucgcgagucugaaugcgaggagugggaaagcuauuacuaugauuuuggaaagaaaggcccgugugucaagcccagaggcgugguuggggugcuggacaucuggggacaggguaccuuggucacaguguccuca

SEQ ID NO: 24687 - RNA, 432 nt, Artificial Sequence
  derived and/or modified sequence opt3 from anti-HIV_cap256-119-163558_VR-Chain
cagaugcaacugguggagagcggcgggggagucguucagcccgguagaucccucacccuuucuugcgccgcuucacaguucaacuuugcaaauuacggcaugcacugggugaggcaggccccugggaagggacuggaauggguagcgaguaucagcuaugacggcuccgauaaauaccaugcugaccggguguggggucgcuucacaauuucucgagauaacucgaagaauacuuuguauuuacaaaugaacucacugcgugccgaggacacggcacuauacuauugugucagagaugccagggaaagcgagugcgaacucugggagagugacuacuauaauuuugggcggaaacugccaugugugaagccgcgcggaguugcuggcacccuugauauauggggccaggggacaauggugacugucuccucu

SEQ ID NO: 24688 - RNA, 432 nt, Artificial Sequence
  derived and/or modified sequence opt3 from anti-HIV_cap256-119-162043_VR-Chain
caggugcaacuggucgagagcggcgggggaguugugcagcccgguagaucccucaggguaucuugcgccgcuucacacuucaccuuuagucgguacggcaugcauugggugcgccaggcaccugggaagggacuugaaugggucacaggcaucagcuucgccgcgacuaaaacguauuacggugacuccgugcgagggcguuuuaccguuucuagagauauuucgaagaauacacuguauuugcagaugaacucauuaaggccagaggacacugcuauguacuauugugcccgggaucaacgcuacuaugaaugcgaggaaugggcaagcgacuacuacgauuucggaagagagcagccgugucaggaccccaggggcguggucggcauacuggaucuaugggggcagggaaccauggugacaguaaguucc

SEQ ID NO: 24689 - RNA, 432 nt, Artificial Sequence
  derived and/or modified sequence opt3 from anti-HIV_cap256-119-161718_VR-Chain
caggugcaacuggucgagagcggcgggggaguugugcagcccgguaagucccucagacuuucuugcgccgcuucacacuucaguuuuaacagguacggcaugcauuggguacggcaggcaccugggaaaggacuggaauggguggccgcgaucagcuaugacggcaccgauaaguaccacgcugaccaggucuggggucgcuucacaauuucccgagauaauucuaaaaacacuuuguauuuacaaaugaauagccugcguccagaggacacggcccuauacuauugugcaaaggaucucagagaagacgagugcgaagagugguggucagauuacuaugaccuggggaaacagcuuccguguaggaagucgcggggaguggccggcauauuugauaaguggggccaggggaccaugguuacagugaguucc

SEQ ID NO: 24690 - RNA, 432 nt, Artificial Sequence
  derived and/or modified sequence opt3 from anti-HIV_cap256-119-161675_VR-Chain
caggugcaacuggucgagagcggcgggggaguugugcagcccgguagaucccucaggcuuucuugcaccgccucaggcuucacauuuaguaucuacagcaugaacuggguacggcaggcuccugggaagggacuggacuggguggcaggcauuuccuucgccgcgacuaaaacguauuacggugggucugucaagggacgcuuuaccgugucgcgagauauaagcaaaaauacauuguauuuacagaugaacucacugcguccagaagacacugcuauguacuauugugccagagaucaaagguacuaugagugcgaagagugggcaagugacuacuacgauuucggccgggaacagccgugucaggacccccgcggcguugugggggucuuugauauguggggacaggguaccauggugacaguauccucu

SEQ ID NO: 24691 - RNA, 432 nt, Artificial Sequence
  derived and/or modified sequence opt3 from anti-HIV_cap256-119-161053_VR-Chain
caggugcaccuggucgagagcggcgggggaguugugcaacccgguaccucccucagacuuucuugcguagccucaggcuucacauuuaguaauuucgcuaugcauugggugaggcaggcaccugggaagggacuggaaugggccgcgaucauuagcacucggggcaauaaccgcaauuacgcugacuccguccgaggucguuuuacggugucuagagauauaucgaaaaacaccuuguauuuacagaugaacucacugaggccagaggacacagccauguacuauugugcacgggaucagcgcuacuaugaaugcgaggaaugggccagcgacuacuaugauuucgggagagagcaaccgugucaggaccccaggggaguugugggcauccuagaucucuggggccaggggacuauggucaccgugaguucc

SEQ ID NO: 24692 - RNA, 432 nt, Artificial Sequence
  derived and/or modified sequence opt3 from anti-HIV_cap256-119-159499_VR-Chain
caggugcaacuggucgagagcggcgggggaguugugcagcccgguagaucccucaggcuuucuugcgccgcuucaggcuucgcauuuagucacuacgggaucuucuggguacggcaggccccuggaaagggccuggaauggguggcgagcauuuccuuugacggucgcgauuauuaccauucuccacacgucugggggcgauugaccauaucgcgugacaacagcaaaaauacauuauaucugcagaugaacucacuaagagcugaggauacugcccucuacuauugugcaagggaccugcgggaaagugagcgcgaagagugggaguccgauuacuaugacuucggaaagaaaggcccgugcgugaagcccagaggcguugccgggucucuugauauguggggacaagguacgauggugaucgucagcucc

SEQ ID NO: 24693 - RNA, 432 nt, Artificial Sequence
  derived and/or modified sequence opt3 from anti-HIV_cap256-119-159114_VR-Chain
gaggugcagcuggucgaaagcggcgggggacucguucaacccgguggcucccuuagacuggccugcgcugcaucuggguugaccuucaggaagcacggaaugcauugggugcggcaggccccuggcaaagguuuagaguggguaucauacaucaguagcgacggggugaacaauuaucugauugauuccguccgcggacgauuuacagugucucgugacaacucgaagaauacucuauaccuccagauggauggccugagaggcgaagacacggcgcuuuauuacugugcuaaagaucugagggaguuggaaugcgaggagugggccucagacuauuacgauuucgggcggccacagccgugucucgacccccgcggaguuagcgguauaaguaacguguggggccaagggaccauggucacaguguccucu

SEQ ID NO: 24694 - RNA, 432 nt, Artificial Sequence
  derived and/or modified sequence opt3 from anti-HIV_cap256-119-156751_VR-Chain
gaggugcagcugcucgaaagcggcgggggacuuguccaacccgguggcucccugagauugucuugcgccgcuucaggguucgcauuuaguagcuacggaaugcacuggguuaggcaggccccuggcaaggguuuagaguggguggcguccaucucuuaugacgggcgggauuucuaccaugcucgcucgguauggggacgauuuaccauuucacgugacaacagcaaaaauacacugcaccuacagaugaacagucucagaccagaagauacugcccuguauuucugugcaagggaccuucgggaguccgaaugcgaggagugggaaucuuacuauuacgauuuuggcaagaaaggcccgugugugaagccccgcggggucgugggaguucuggacauauggggucagggcacguuggugaccgucagcucc

SEQ ID NO: 24695 - RNA, 432 nt, Artificial Sequence
  derived and/or modified sequence opt3 from anti-HIV_cap256-119-155656_VR-Chain
gaggugcagcuggucgaaagcggcgggggacucguucaacccgguggcucccuuagacugucuugcgccgcuucagggaucaccuucaguagcuacggaaugcacugggugaggcaggcaccuggcaaggguuuggaguggguagccuuuauucgguaugacggguccucuaaauacuaugcggauucggugaagggacgcuucacaauaucacgagacaacagcaaaaauacuuuauaccugcagauggauggccuacguggcgaagacacggcucucuauuacugugccaaggaucugagagagcuugaaugcgaggagugggcaagugacuauuacgauuuugggaggccacagccgugucuggacccccggggagucuccgguaucucuaacguguggggccaagggaccaugguuacagugagcucc

SEQ ID NO: 24696 - RNA, 432 nt, Artificial Sequence
  derived and/or modified sequence opt3 from anti-HIV_cap256-119-154420_VR-Chain
caggugagacuggucgagagcggcgggggaguugugcaacccgguaggucccuccggaucucuugcgccgcuucacaguucauguuuagucgcuacggcaugcacuggguacgacaggcaccugggaagggacuugaauggguggccagcauuuccuaugacggcaccgauaaauaccaugcggaccuggucuggggucguuucacaauaucuagagauaacucgaagaauacuuuguauuuacagaugaacucacugagggcugaggacacggcccuauacuauugugcacgggaucuccgcgaaagcgagugcgaagagugggagagugacuacuaugauuuugggaaaaagggaccaugugugaaaccgagaggcguugccggcucccuggacaugugggggcaaggaaccauggugaucgucucuagc

SEQ ID NO: 24697 - RNA, 432 nt, Artificial Sequence
  derived and/or modified sequence opt3 from anti-HIV_cap256-119-153954_VR-Chain
gaggugcagguccuggaaagcggcgggggacucguucaacccgguggcucccuuaggcugucuugcguggccucacaguucaccuuuaguggguguggauugcacuggguaaggcaggcuccuggcaaggguuuagaguggguggcaagcaucuccuucgccgggacuaaaaagcauuacggaaacucugucaaaggccgguuuacaauuucgcgcgacaauucaaagaacacgguguaucuggaaaugaauagccuacgagcggaggauaccgcucucuacuauugcgccaaagaccugcgugaauacgagugugaggaauggacaagugauuauuacgacuucggcagaccacagccgugcauagauuccagagggguugugggaauccuugacauuuggggucaaggcacuauggucaccgugucuagc

SEQ ID NO: 24698 - RNA, 432 nt, Artificial Sequence
  derived and/or modified sequence opt3 from anti-HIV_cap256-119-153864_VR-Chain
caggugcaccuggucgagagcggcgggggaguugugcaacccgguggcucccucagacuuucuugcgccgcuucaggguucaccuuuaguggauguggccugcauuggguaaggcaggcaccugguaagggguuggaauggguggccagcaucuccuucgcgggaacuaaaaagcacuacgggucuucgguccggggccgcuuuucaauuagccgagacaacaguaaaaauacauuauaucugcagaugaacucccuacguacggaggauaccgcucucuacuucugcgccaaggaccugagagaauaugagugugaagaguggacaucugauuacuaugacuuuggcaggccacagccgugcauagauagccggggagugguugguauccuugacauuuggggccaagggacuauggugaccgucuccuca

SEQ ID NO: 24699 - RNA, 432 nt, Artificial Sequence
  derived and/or modified sequence opt3 from anti-HIV_cap256-119-153793_VR-Chain
gaggugcagcuggucgaaagcggcgggggaguugugcaacccgguggcucccucagacuuucuugcgccaccucaggguucacauuuggaacuuucggcaugcacuggguaaggcaggcuccugguaaggggcuggacuggguggcauacauccgguaugauggaaaaacgaagaacuacggcgagagugucaaaggccgcuuuaccauuagccgagacaauuccaagaacacaaugucuuugcagaugaauagcuuacguccagaagauacugcccuguauuacugugcgaaagaccuaagagaggaugaaugcgaggagagguggucagacuauuacgauuucgggaagcagcucccgugucggaagucgcgcggaguggcugguguuuuugacaacuggggccaagggaccauggugacagucaguucc

SEQ ID NO: 24700 - RNA, 432 nt, Artificial Sequence
  derived and/or modified sequence opt3 from anti-HIV_cap256-119-153462_VR-Chain
caggugcaacuggucgagagcggcgggggaguugugcagcccgguggcucccucagacuuucuugcgccgcuucaggguucaccuuuaguaauuacggaaugcaguggguaaggcaggcaccuggcaagggucuggaauggguggccgcgaucagcuaugacgggcggaaugaguacuaugcugaauccgucaaaggacgcuucacaauuucucgagauaacuuuaagucgacuuuguucuuacaaaugaacucacugcgugccgaggacacggcacuauacuauugugccagagaucucagggaaagcgagugcgaggaaugggagagugacuacuaugcuuuuuaccggaaacugccaugugugaagccgcgcggcguugcaggcacccuugauauaugggggcagggaacaauggugacugucuccucu

SEQ ID NO: 24701 - RNA, 438 nt, Artificial Sequence
  derived and/or modified sequence opt3 from anti-HIV_cap256-119-153124_VR-Chain
caggugcaacuggucgagagcggcgggggaguugugcagcccgguagaucccucacccuuucuugcaucgccucacaguucaacuuugcuaguuacggcaugcacuggguaaggcaggcaccugggaagggacuggaauggguggccagcauuucccaugacggcacuaaaaaguaucacgcggagucugucuggggucgguucacaauaucgaaagauaauucaaagaacacguuguuuuuacaaaugaauagccugcgcguggaagacaccgcucuauacuucuguguuaaagaucagcgagaggacgaaugcgaggagugguggagugauuauuacgacuuugggcgugaacucccauguagaaaguccaggggacugggccuugccggcaucuucgauaugugggggcauggaacaauggugacugucucuagc

SEQ ID NO: 24702 - RNA, 438 nt, Artificial Sequence
  derived and/or modified sequence opt3 from anti-HIV_cap256-119-153025_VR-Chain
cagaugcaacugguggagagcggcgggggagucguucagcccgguaagucccucacccuuucuugcgccgcuucacaguucacauuuaguaacuacggcaugcacugggugagacaggcaccugggaaaggacuggaauggguagccagcaucuccaaugacggcaacaagaaauaucauggugauucugugugggggagguugacuauuucgcgggacaauucaaagaacacguuauuccugcaaaugaauagccuacgcccagaggauaccgcgcucuacuuuugugucaaagaccagcgagaagaugagugcgaagagugguggagugacuauuacgauuucggacgugagcugccguguagaaaguuuaggggccuuggccuggcugggauauucgacaucuggggacacgguacaauggugacuguuuccucu

SEQ ID NO: 24703 - RNA, 432 nt, Artificial Sequence
  derived and/or modified sequence opt3 from anti-HIV_cap256-119-152713_VR-Chain
gaggugcagcuggucgaaagcggcgggggacucguuaggcccgguggcucccuuaggcugucuugcgccaccucaggguucacauuuaguagccacuggauguccugggugcggcaagcuccuggaaagggcuuggaguggguagcagguaucucuuucgccgggacuaaaacguacuauggagacucggugaagggccgcuuuaccgucucaacagauauuagcaaaaacacuuuauaccuacaggugaauagucugcgaccagaagacaccgcgauguauuacugugcucgugaucagagauauuacgagugcgaagagugggccuccgacuauuacgauuucggcaaggagcagccgugucucgaccccagagggguugugggaauauuugauaucuggggucaaggcacaauggucaccgugucuagc

SEQ ID NO: 24704 - RNA, 438 nt, Artificial Sequence
  derived and/or modified sequence opt3 from anti-HIV_cap256-119-151794_VR-Chain
cacgugcagcuggucgagagcggcgggggaguugugcaacccgguaccucccucagacuuucuugcguagccucagaguucaguuuuaagaacuacggcaugcauugggugaggcaggcuccugggaaaggacuggaaugggucgcaagcaucuccaaugacggcacaaagaaauaucacgccgaaucugugugggaucgguucucgauuucaaaggacaacagcaaaaauacuuuguuuuuacagaugaacagucugcgcguugaggauacggcgcuauacuucugugugaaggaccagcgagaagaugagugcgaggaauggugguccgacuauuacgauuuuggucgugagcucccauguagaaagucuagggggcugggacuugcuggcauauucgacauguggggccaugggaccauggucacagugagcucc

SEQ ID NO: 24705 - RNA, 438 nt, Artificial Sequence
  derived and/or modified sequence opt3 from anti-HIV_cap256-119-150980_VR-Chain
caggugcaacuggucgagagcggcgggggaguugugcagcccgguaagucccucagacuuucuugcgccgcuucaggcuucauccugaguaacuacgcaaugcacuggguaaggcaggccccugggaaaggauuggaauggguggcgagcauuuccaaugacggcucuaagaaauaucauggugauucggucugggcucgguuuauaaucucacgcgacaacagcaagaauaccuuauuccugcagaugaguucccuacgagccgaggauacagcacucuacuuuugugugcgugaccacagagaagaugagugcgaagagugguggucugacuauuacgauuucgggagggagcugccaugucggaaauuucgcggacuuggccuggccggcauuuucgacaucugggggcauggaacuaugguuacggugagcucc

SEQ ID NO: 24706 - RNA, 432 nt, Artificial Sequence
  derived and/or modified sequence opt3 from anti-HIV_cap256-119-148895_VR-Chain
caggugcaacuggucgagagcggcgggggaguugugcagcccgguagaucccucaggcuuucuugcgccgcuucaggcuucaccuuucggaguuacgggaugcacuggguacgccaggcaccuggaaagggccuggaauggguggccgucaucagcuccgacggugauauugaguauuacacacagucugugaaagggcgauucacuauaucgcgugacaacucaaagaauacguuguauuuacaaaugaacgcgcugagaccagaagauaccgcuauguacuauugugccagggaccagcgguacuaugagugcgaagagugggcaagcgauuacuacgacuuuggacgcgagcagccgugucaggaucccagaggcguugugggcgucuucgacaugugggggcaaggaacaauggugacuguaaguucc

SEQ ID NO: 24707 - RNA, 438 nt, Artificial Sequence
  derived and/or modified sequence opt3 from anti-HIV_cap256-119-148848_VR-Chain
cagaugcaacugguggagagcggcgggggagucguucagcccgguagaucccucacccuuucuugcgccgcuucacaguucaguuuuacaagcuacggcaugcacugggugaggcaggcaccugggaagggacuggaauggguagccuccaucucuaacgacggcacuaaaaaguaucauggugagucggugugggaucgguucucaauuagccgcgacaauaguaaaaacacguuguuuuuacaaaugaacucccugcgagucgaagauaccgcgcuauacuucugugugaaggaccagcgugaggaugaaugcgaggagugguggucugacuauuacgauuuugggaaagaacucccauguagaaaguggaagacaaggggaguugcuggcauacuggacaauuggggccaggggacuaugcuuaccgugagcucc

SEQ ID NO: 24708 - RNA, 432 nt, Artificial Sequence
  derived and/or modified sequence opt3 from anti-HIV_cap256-119-148743_VR-Chain
caggugcaacuggucgagagcggcgggggaguugugcagcccgguagaucccucacccuuucuugcgccgcuucacaguucaacuuugcaaauuacggcaugcacuggguaaggcaggccccugggaagggacuggaauggguggcgaguaucagcaacgacggcacuaaaaaguaucaugcugaguccgucugggaucgguucucuauuucgaaagacaauucaaagaacacauuguuuuuacaaaugaauagccugcgcguggaagauacggcccuauacuucuguguuaaagaccagcgagaggaugaaugcgaggagugguggagugacuauuacgauuuugguaagaagcucccaugucguaaauccagagggcuggcaggaauauuccacguguggggccauggcaccauggucacagugucuagc

SEQ ID NO: 24709 - RNA, 432 nt, Artificial Sequence
  derived and/or modified sequence opt3 from anti-HIV_cap256-119-148595_VR-Chain
gaggugcagcuggucgaaagcggcgggggacucguucaacccgguggcucccuuagacugucuugcgccgcuucaagguucaccuuugacaacuacgggaugcacugggugcggcaggcaccuggaaagggcuuggaguggguagccuuacugaauuaugaugguaguaaaaaguacuauguggacagcgucaaagggcgcuucaucauuuuucgagauaacuccaagaauacacuauuccuccagaugaacucucugcguccagaagacacugcgcuuuacuuuugugugaaagaucagagagaggacgcuugcgaagagugguggucggauuauuacgacuucggaaagaagcugccguguaggaaaucacggggcuuggccggcauauuucauguuugggggcacggaacgauggugaccgucagcagu

SEQ ID NO: 24710 - RNA, 432 nt, Artificial Sequence
  derived and/or modified sequence opt3 from anti-HIV_cap256-119-148490_VR-Chain
caggugcaacuggucgagagcggcgggggaguugugcagcccgguagaucccucaggcuuucuugcguagccucaggcuucaccuuuagugacuacgcuaugcacugggugcggcaggcaccugggaagggacuggaaugggucgccacaaucagcuucgauggcgcggacaaauaucaugcugaugacguguggggucgcuuuacuauuucccgagauaacucuaagaauacguuguacuuacagaugaacucgcugcguccagaggacaccgcccuauauuacugugcaaaagaucucagagaagacgagugcgaagagagguggucagauuauuacgacuucgggaagcaacugccgugucggaaaagccgcggaguugccggcguguuugauaauuggggccaggggacaauggucacugugaguucc

SEQ ID NO: 24711 - RNA, 438 nt, Artificial Sequence
  derived and/or modified sequence opt3 from anti-HIV_cap256-119-148470_VR-Chain
caggugcaacuggucgagagcggcgggggaguugugcagcccgguagaucccucaggcuuucuugcguagccucaggcuucaccuuuaguagcuacgggauccacugggugcggcaggcuccuggaaagggccuggaaugggucgcagugauuuccgacgaugguucuaaaaaguaucaugaggaaucgguuugggggcgcuucacaauaucaaaagacaacagcaagaauacuuuguuuuuacagaugaacagucugcgaaucgaggauacggcccuauacuucugugugaaagaccaacgugaagaugagugcgaggaauggugguccgacuauuacgauuuuggaagagagcucccauguaggaagucucggggccugggccuugcggggauuuucgacauguggggacacgguaccauggucacagugagcucc

SEQ ID NO: 24712 - RNA, 432 nt, Artificial Sequence
  derived and/or modified sequence opt3 from anti-HIV_cap256-119-148107_VR-Chain
gaggugcagcuggucgaaagcggcgggggacucguucaacccgguggcucccuuagacugucuugcgccgcuucaggguucaccgugaguagcaacuacaugacauggguaaggcaggcaccucggaagggauuggagugggugggcuccaucucuuaugacgguucggauaaauaccacacuaauucauuaugggggcgcuuuauugucagccgagacaacaguaagaauacgcuguaucuacagaugaacaaucuccguccagaagauaccgcccuguacuauugugugagagacaggcgggaguccgaaugcgaggagcgcuggucugauuacuaugacuucggaaaacagcuuccguguguuaagcccagaggcguggcgggcauauuugauaucugggggcaaggaacaauggucacugugagcucc

SEQ ID NO: 24713 - RNA, 432 nt, Artificial Sequence
  derived and/or modified sequence opt3 from anti-HIV_cap256-119-147933_VR-Chain
gagcugcagcucguggaaagcggcgggggacuuguccaacccgguuggucccugagauugucuugcgaggccucaggcuucccuuuuagugcuuucuggaugaccuggguuaggcaggcaccagggaagggauuaggcuggguggccuuuauccgguacgacgguagcaacaaauauuacgcggauuccguaaaggggcgcuucacaauuucucgagacaauucgaugacuacgcuguaucuacagaugaacucacuccgugcugaagaugccgcaguguacuauugugccaaagaccugagagaggaugaaugcgaggagugguggagcgacuacuaugauuuuggaaagaggcuuccgugucggaaaagucgcggcgucgcuggcguguucgacaagugggggcagggaaccaugguuacaguguccucu

SEQ ID NO: 24714 - RNA, 432 nt, Artificial Sequence
  derived and/or modified sequence opt3 from anti-HIV_cap256-119-147434_VR-Chain
caggugcaacuggucgagagcggcgggggaguugugcaggccgguagaucccucaggcuuucuugcgcugcaucacaguucaccuuuggccgguacgggaugcacuggguacgccaggcccccggaaagggccuggaauggguggguaguaucagcuaugacggguccgauaaauaccauacaaacucugucuggggacgauucauugugucgcgugacaauucaaagaacacuuuguauuuacaaaugaauagccugagaccugaggauacggcgauguacuauugugcuagggaccagcgguacuaugaaugcgaggaaugggccagugauuacuacgacuuuggccgcgagcagccaugucaggauccgagaggcguugugggggucuucgacauguggggacaagguaccauggugacaguauccucu

SEQ ID NO: 24715 - RNA, 435 nt, Artificial Sequence
  derived and/or modified sequence opt3 from anti-HIV_cap256-119-146106_VR-Chain
caggugcaacuggucgagagcggcgggggaguugugcagcccgguagaucccucaggcuuucuugcgccgcuucaggcuucaccuuuaguagcuccgggaugcacuggguacggcaggcaccuggaaagggccugcaguggguggccgucaucucuuacgacggugggaacaaauauuacgcggauucggugaagggacgcuucacaauuucacgagacaauagcaaaaacaauuuguauuuacaaaugaacagucugcguccagaagauacugcucuauacuauugugccagagaccucagggagauggaaugcgaggaauggaagcuguacaauuauuacgauuuucggacgcgcggcccguguguugaccccagaggcguggucggguccuucgauguguggggacaggguaccguaguuacagugucuagc

SEQ ID NO: 24716 - RNA, 438 nt, Artificial Sequence
  derived and/or modified sequence opt3 from anti-HIV_cap256-119-145604_VR-Chain
gacgugcagcuggccgagagcggcgggggacucguccaacccgguggcucccuuagacugucuugcguugcuucaggguucaccuuuaguagcuucgaaaugcacugggugaggcaggcaccuggaaagggcuuggaguggguagccuccaucucuaaugaugguacaaaacgguaccaugcggaaucggugugggaccgcuuuucaauuagcaaggauaauaguaaaaacacuuuauuccugcagaugaacucccuacgagucgaggacacggcucucuauuuuugugugaaggaucagcgugaagacgagugcgaggaaugguggucugauuacuaugacuucgggagagagcugccauguaggaaaagccggggacuuggccuggccggcauauuugauaugugggggcacggaaccaugguuacaguguccuca

SEQ ID NO: 24717 - RNA, 438 nt, Artificial Sequence
  derived and/or modified sequence opt3 from anti-HIV_cap256-119-143998_VR-Chain
caggugcaacuggucgagagcggcgggggaguugugcagcccgguagaucccucaggcuuucuugcgccgcuucaggcuucaccuuucggaacuacgggaugcacuggguacgccaggcaccuggaaagggccuggaauggguggccaguaucagcaaugacgguuccaaaaaguaucauggggauucugucugggcgcgauucauuauaucgcgugacaacagcaaaaauacauuguuuuuacagaugucaagucugagagcugaggauacugcccuauacuucugugugaaggaccaaagggaagaugagugcgaagaguggugguccgacuauuacgauuuuggacgggagcucccaugucgcaaaucuagaggccugggccuugcagggaucuucgacauguggggacacgguacgaugguuaccgugagcucc

SEQ ID NO: 24718 - RNA, 438 nt, Artificial Sequence
  derived and/or modified sequence opt3 from anti-HIV_cap256-119-143441_VR-Chain
gaggugcaccuggucgaaagcggcgggggacucgcccagcccgguagaucccuuaggcugucuugcgcugcaucacaauucaacuuugccaguuacggcaugcauuggguucggcaggcgccugggaagggauuggaguggguggcuagcaucuccaaugacggcaccaaacgcuaucacgccgaaucuguaugggaucgauucucgauuucaaaggacaacagcaaaaauacauuauuucugcagaugaacagucuacguguggaggauacugcacucuacuucugugucaaggaccagagagaagaugagugcgaggaauggugguccgacuauuacgauuuugguagggagcugccaugucggaaaucucgcgggcuuggacuggccggcauauucgacauguggggccaugggacgauggugaccguuagcucc

SEQ ID NO: 24719 - RNA, 432 nt, Artificial Sequence
  derived and/or modified sequence opt3 from anti-HIV_cap256-119-141307_VR-Chain
caggugcaccuggucgagagcggcgggggaguugugcaacccgguagaucccucaggcuuucuugcgccgcuucacaguucaccuuuaaucgguacggccugcauuggguacgccaggcaccugggaagggauuggaauggguggccggcaucaguuaugacggucgagauaaauaccacgcgcauuucgucugggggcguuuuauuauaagcagagacaauuccaagaacacauuauaucugcagaugaacucucuaagggcugaggauacugcccucuacuauugugugcgggaccugcgcgaaucggagugcgaacuuugggagucagauuacuaugacuucggaaaaagacugccauguguuaagccgaggggcguggcaggcacguuugauuugugggggcaaggaaccauggucacagugagcagu

SEQ ID NO: 24720 - RNA, 432 nt, Artificial Sequence
  derived and/or modified sequence opt3 from anti-HIV_cap256-119-140896_VR-Chain
gaggugaagcuggucgaaagcggcgggggacucguucagcccgguggcucccuuaaacugucuugcgccgcuucaggguucaccuuuaguuacuaugcaaugcacugggugagacaagccccuggaaagggcuuggaguggguagcggugaucagcuacgacgguuccgauaaauauuacgcugacucugucaaggggagguucacaauuucgcgggauaacagcaaaaauacuuuacaucugcagaugaacucacuacgcccagaagacacggcccucuauuuuugugcacgagaucugcgugagagugaaugcgaggagugggaauccuacuauuacgacuucggaaagaagggcccgugugugaaacccagaggcguuguggggguccuugauauauggggacaggguacccuggugacaguaucuagc

SEQ ID NO: 24721 - RNA, 432 nt, Artificial Sequence
  derived and/or modified sequence opt3 from anti-HIV_cap256-119-140090_VR-Chain
gaggugcagcuggucgaaagcggcgggggacucguucaacccgguggcucccuuagacugucuugcgccgcuucaggguucgcauuuaguagcuacuggaugaccugggugaggcaggccccuggaaagggcuuggaguggguagcggugaucuccuaugacgguucuaacaaauacuaugcugauucgguccgggggcgcuucacaauuucacgagacagcaguaagaauacuuuauaccuggaaaugaacucccuacguccagaggauacggcccucuauuacugugcaaaagacaugagaggauaugaaugcgaggaguggaccucugauuacuacgacuuuggcaggccgcagcccuguauagauagccggggcgugguugggacauucgacguguggggacaggguacuauggucaccguguccuca

SEQ ID NO: 24722 - RNA, 438 nt, Artificial Sequence
  derived and/or modified sequence opt3 from anti-HIV_cap256-119-140037_VR-Chain
caggugcaacuggucgagagcggcgggggacucguucagcccgguagaucccuuaggcugucuugcgccgcuucaggcuucaccuuugacgauuacgugaugcacuggguacggcaggcaccugggaagggauuggaauggguggccaguaucagcaacgacggcacuaaaaaguaucaugaggaauccgucuggggucgcuucacaauuucuaaagauaauucgaagucaacguuauuucugcagaugaacagccuacgaauagaggacaccgcgcucuacuucugugugaaagaucaacgugaagacgagugcgaggaaugguggagugauuauuacgacuuugggagagagcugccauguaggaagucccggggacuuggccuggcuggcaucuucgauaugugggggcacggaacaaugguuacugugucuagc

SEQ ID NO: 24723 - RNA, 432 nt, Artificial Sequence
  derived and/or modified sequence opt3 from anti-HIV_cap256-119-139135_VR-Chain
gaggugcagcuggucgaaagcggcgggggaguugugaggcccgguggcuccguaaggcucucuugcguggccucaggguucaguuuucggagcuacggaaugcacuggguccgccaagcuccuggcaagggucuugaguggguggcauccaucucuuaugacgggcgagauuucuaccaugcccguucgguuuggggaagauuuaccauuucaagggacaacagcaaaaauacacugcacuugcagaugaacaguuuacggccagaagauacugcgcuguauuucugugcucgcgaccuaagagaguccgaaugcgaggagugggaaucuuacuauuacgauuuuggcaagaaaggcccgugugugaagcccagaggggucgugggaguacucgacauauggggucagggcacgcugguuaccgugagcucc

SEQ ID NO: 24724 - RNA, 438 nt, Artificial Sequence
  derived and/or modified sequence opt3 from anti-HIV_cap256-119-137881_VR-Chain
caggugcaacuggucgagagcggcgggggacucguuaagcccgguagaucccuuacccugucuugcgccgcuucacaguucacauuuaguaacuacggcaugcacugggugaggcaggcaccugggaaaggauuggaauggguagccagcaucuccaaugacggcaacaagaaauaucauggugauucugugugggcgcgguucacuauuucgcgcgacaauucaaagaacacguuauuucugcagaugagcagucuacgaaccgaggauacagcucucuacuucuguguccgugacagaagggaagaugagugcgaagaguggugguccgacuauuacgauuuugggcgggagcugccaugucgcaaauucagaggacuuggccuggccggcauauuugacaucugggggcacggaacuauggugaccguuucuagc

SEQ ID NO: 24725 - RNA, 432 nt, Artificial Sequence
  derived and/or modified sequence opt3 from anti-HIV_cap256-119-137643_VR-Chain
gaggugcagcuggucgaaagcggcggggaccucguucaacccggagguucccuuagacugucuugcgccgcuucaggcuucaguuuuagcuccuacgggaugcacugggugaggcaggcaccugauaagggauuggaguggguaaccgugaucucuuaugacggcucgaacaaacauuacgccgauucagucaagggucgguucacaauuagccgcgacaauaguaaaaacacuuuauaucuggaaaugaauacgcuacgagcggaggauaccgcucucuacuauugugccaaggaccugcgugaauacgagugcgaggaauggacauccgauuauuacgacuuugggagaccacagccguguauagauucuaggggagugguuggcauccuugacauuuggggccaggggacuauggugagcgucuccuca

SEQ ID NO: 24726 - RNA, 438 nt, Artificial Sequence
  derived and/or modified sequence opt3 from anti-HIV_cap256-119-137170_VR-Chain
caggugcaacuggucgagagcggcgggggaguugugcagcccgguagaucccucaggcuuucuugcgccgcuucagaguucaccuuuagucgguacagcaugcacuggguacgccaggcaccuggcaaggggcuggaauggguggccgucaucuccucugacggaucgaaccaguuccaugcggauucaguguggggccgauuuacaauuagcaaagacaauaguaagaacacuuuguucuuacaaaugaauagccugcguauagaagauacggcucuauauuuuuguguuaaagaccagagagaggaugaaugcgaggagugguggucugacuacuaugauuucgguagggaacucccaugucggaagucccgcgggcugggacuugccggcaucuuugacauguggggccacgggaccauggugacagucuccuca

SEQ ID NO: 24727 - RNA, 432 nt, Artificial Sequence
  derived and/or modified sequence opt3 from anti-HIV_cap256-119-136616_VR-Chain
caggugcaacuggucgagagcggcgggggaguugugcagcccgguagaucccucaggcuuucuugcgccgcuucaggcuucaccuuuagucggaacgcaaucaauuggguacgccaggccccugggcgaggacuggaauggguggcggucauuagcgacgauggcuccuugaaguacuaugcugacucugugaaaggucguuucacaauaucgagagauaacucaaagaauacuuuauaccugcagaugaacaaucuaaggccagaggacacggcccucuauuacuguguucgggaucgcagagaaagcgagugcgaagagagguggagugacuauuacgauuuugggaaacaacugccgugugugaagccccggggagucgcaggcaucuucgacauuuggggccaggggaccauggugacaguauccucu

SEQ ID NO: 24728 - RNA, 432 nt, Artificial Sequence
  derived and/or modified sequence opt3 from anti-HIV_cap256-119-136206_VR-Chain
caggugcaacuggucgagagcggcgggggaguugugcagcccgguaggucccucaggcuuucuugcgccgcuucacaguucaccuuuggccgguacgggaugcacuggguacgccaggcaccuggaaagggccuggaauggguggccgcgaucaguuucgcugguacuaaaaaguauuacggggacagcgcccgaggacguuuuacaauuuccagagauaacucuaaaaauauguuguucuuacaaaugaacucgcugagggcagaggacacggcccuauauuacugugcucgggaucuccgcgacuaugaaugcgaggaaugggaggcauacuauuacgauuuuggcagagucggcccauguaccgacccgagaggggugguuggaauacuggauguguggggucagggcacacuugucacugugucaagc

SEQ ID NO: 24729 - RNA, 438 nt, Artificial Sequence
  derived and/or modified sequence opt3 from anti-HIV_cap256-119-135565_VR-Chain
caggugcaccuggucgagagcggcgggggaguugugcaacccgguaagucccucagacuuucuugcgccgcuucacaguucaccuuugacagguacggcaugcauuggguacggcaggcaccugggaaaggacuggaauggguggccaguaucagcaacgauggcacagacaaguaucacgcggauaaugucuggggucgcuucacuauuucccgagacaacucuaaaaauacguuguacuuagagaugaacucgcugcguggggaagauaccgcucuauauuuuugugugaaggaccagagagaggaugaaugcgaggagugguggucagacuacuaugauuucggaagggaacucccaugucggaaaagccgcggccugggccuugccgggauauuugacauguggggacaugguacaaugguuacugugaguucc

SEQ ID NO: 24730 - RNA, 432 nt, Artificial Sequence
  derived and/or modified sequence opt3 from anti-HIV_cap256-119-135025_VR-Chain
gaggugcagcuggucgaaagcggcgggggacucguucaacccgguggcucccuuagacugucuugcgaggccucaggguucaccuuuaacacauacgaaaugaauugggugaggcagccuccaggacggggcuuggaguggguagcugguaucaguuucgcagccacuaagacguauuacgggggaagcgugaaaggccgcuuuaccgucucccgagacauuucuaagaacacauuauaucugcagauggauggccuacguggggaagacacugcgcucuacuauugugcuaaagaucugagagagcuugagugcgaagagugggccucggacuacuaugauuucggaaggccgcagcccugucuggacccucggggugugucaggcauaagcaauguuugggggcaaggaaccauggugacagucaguucc

SEQ ID NO: 24731 - RNA, 432 nt, Artificial Sequence
  derived and/or modified sequence opt3 from anti-HIV_cap256-119-133983_VR-Chain
cagaugcaacugguggagagcggcgggggagucguucagcccgguagaucccucacccuuucuugcgccgcuucacaguucaacuuugcaaauuacggcaugcacugggugaggcaggccccugggaagggacuggaauggguagcgaguaucagcaacgacggcacuaaaaaguaucaugaggaauccguguggggucgguucacaauuucuaaagauaauucgaagaacacguuguuuuuacaaaugaacucacugcgcccagaggacaccgcucuauacuauugugccaaagaucuccgagaagacgagugcgaggaacguuggagcgauuacuaugacuucgggaagcagcugccguguagaaagaguaggggagucgcaggcguguuugauaauuggggccaggggacaaugguuacuguguccucu

SEQ ID NO: 24732 - RNA, 438 nt, Artificial Sequence
  derived and/or modified sequence opt3 from anti-HIV_cap256-119-133917_VR-Chain
cagaugcaacugguggagagcggcgggggagucguucagcccgguagaucccucacccuuucuugcgccgcuucacaguucacauuuaguaacuacggcaugcacugggugaggcaggcaccugggaagggacuggaauggguagccagcaucuccaaugacggcucuaaaaaguaucauggugauucggugugggcgcgguucacuauuucacgcgacaacagcaaaaauacguuguuuuuacaaaugaguucccugcgagucgaggauaccgcucuauacuucugugugcgugaccagagagaagaugagugcgaagagugguggucugacuauuacgauuuugggagggagcucccaugucggaaguuccgcggacugggccuugccggcauauuugacaucugggggcacggaacaaugguuacugugagcucc

SEQ ID NO: 24733 - RNA, 432 nt, Artificial Sequence
  derived and/or modified sequence opt3 from anti-HIV_cap256-119-132663_VR-Chain
caggcccaacugguggagagcggcgggggagucguucagcccgguagaucccucaggaucucuugcgcugugucacaguucaccuuuagucgguacggcaugcacuggguacgccaggcaccugggaagggacuugaauggguggccagcauuuccuucgacggccgagauaaauaucauucuccacuggucuggggucguuugacaauaucgagagacaacucaaagaauacuuuauuucuggagaugaacagccuaagggcggaagauacggcuguguacuauugugcccgggaccuccgcgagagugaaugcgaggaguggcaauccgauuacuaugcauucuacaaaaagcugccguguguuaaacccagagggguggccggaucucuugacaucuggggccagggcaccgucgugacaguaagcucc

SEQ ID NO: 24734 - RNA, 438 nt, Artificial Sequence
  derived and/or modified sequence opt3 from anti-HIV_cap256-119-132113_VR-Chain
caggugcaacuggucgagagcggcgggggacucguuaagcccgguggcucccuuagacugucuugcgccgcuucacaguucaacuuugcaaauuacgggaugcacugggugaggcaggccccuggaaaaggcuuggaauggguagcgaguaucagcaacgacgguaccaagaaauaucaugaggaauccgugugggggcgguucacaauuucuaaggauaauucgaaaucaacuuuauuucugcagaugaacagccuacgcauagaggacacggcucucuacuucugugucaaggaucaacgagaagacgagugcgaggaaugguggagugauuauuacgacuuuggacgugagcugccauguagaaaguccaggggccuuggccuggccgggaucuucgauauguggggacacgguaccauggugacaguuucuagc

SEQ ID NO: 24735 - RNA, 432 nt, Artificial Sequence
  derived and/or modified sequence opt3 from anti-HIV_cap256-119-131839_VR-Chain
caggugcaacuggucgagagcggcgggggaguugugcagcccgguagaucccucaggcuuucuugcgccgcuucaggcuucaccuuuaguagcuacgcaaugcacuggguacggcaggccccugggaagggacuggaauggguggcggucaucuccuaugacggcucuaacaaauacuaugcugauucggugaagggucgcuucacaauuucacgagacaauagcaaaaacacuuuguacuuacagaugaauagucugcgugccgaggauacggcaguuuauuacugugccagagaccaaagguauuacgaaugcgaggaaugggcuuccgauuacuaugacuuugggcgggagcagccaugucaggauccgcgcggaguggucggcguguucgacauguggggccaggggaccaugguaacaguuucuagc

SEQ ID NO: 24736 - RNA, 435 nt, Artificial Sequence
  derived and/or modified sequence opt3 from anti-HIV_cap256-119-130626_VR-Chain
gaggugcagcuggucgaaagcggcgggggacucauccaccccgguggcugccuuagacuguccugugccguuucuggguucaccuuuucagacuacccuaugcauugggugaggcaaaguccaggaaagggcuuggaguggguagcugugauuagcuaugaugguauaaacuacuauuacgcagacuccgucaaagggcgguucacaaucucucgcgauaauucgaagaacaauuuauuucugcagaugaacucacuacgacucgaagacacugcccuguauuacugcgcgcgugaucuuagagagcuggacugugaagaguggacguuguauaauuacuacgauuucggaagcaggggcccgugcguggacccccggggcguugggggaaguuuugauguguggggucagggcaccauggucacaguguccucu

SEQ ID NO: 24737 - RNA, 438 nt, Artificial Sequence
  derived and/or modified sequence opt3 from anti-HIV_cap256-119-130191_VR-Chain
gaggugcagcuggucgaaagcggcgggggacucauccaacccgguagaucccuuaggcugucuugcgccgcuucaggcuucaccguuaguagcaacuuuaugacaugggugcggcaggcaccugggaagggauuggaguggguagccuccauuucuaaugacggcacuaagaaguaccacgcggaaucggugugggaucgcuucucaauaagcaaagacaacaguaagaauacguuauuucugcagaugaacucccuacgagucgaggauaccgcucucuauuucugugugaaagaccagcgugaagaugagugcgaggaaugguggucugacuacuaugauuuugguagagagcugccauguaggaaaagccgggggcuuggacuggccggcaucuucgacauguggggccaugggacaaugguuacuguguccuca

SEQ ID NO: 24738 - RNA, 438 nt, Artificial Sequence
  derived and/or modified sequence opt3 from anti-HIV_cap256-119-129798_VR-Chain
caggugcaacuggucgagagcggcgggggaguugugcagcccgguaagucccucagacuuucuugcgccgcuucaggcuucaucuuuaguagcuacuucaugcacuggguaaggcaggcaccugggaaaggacuggaauggguggccgucgugaccgacgauggcuccaagaaauauuacgcggacucuguuaagggucgguuuacaauuucgcgcgauuauagcaaaaacacuuuguucuuacagaugaaucgacugcguguggaggacacggcucuauacuuuugugucaaggaucaaagagaagacgagugcgaagagugguggucagauuauuacgacuucgggagggagcucccaugucggaaguuucgcggacugggccuugccggcauauucgauaugugggggcauggaaccauggugacaguaaguucc

SEQ ID NO: 24739 - RNA, 432 nt, Artificial Sequence
  derived and/or modified sequence opt3 from anti-HIV_cap256-119-128745_VR-Chain
caggugcaacuggucgagagcggcgggggaguugugcagcccgguagaucccucaggcuuucuugcgccgcuucaggcuucaccuuuaguaacuacgcaaugcacuggguacggcaggccccugggaagggacuggaauggguggcgagcaucuccuucgcuggcacaaaaacucauuaugguaauucugucaaggggcgcuuuucgauuucacgagacaacagcauaaauacgguguacuugcagaugaacaguuuacgugccgaggauaccgcacuguauuacugugccaaagaccuaagagaauaugagugcgaagaguggacauccgauuacuaugacuucggaaggccacaaccguguaucgauucucggggcguugugggcauucucgacaucuggagccaggggacuauggucaccguguccuca

SEQ ID NO: 24740 - RNA, 438 nt, Artificial Sequence
  derived and/or modified sequence opt3 from anti-HIV_cap256-119-128593_VR-Chain
caggugcaacuggucgagagcggcgggggaguugugcagcccgguagaucccucaggcuuucuugcgccgcuucaggcuucaccuuuaguagcuacgcaaugcacuggguacggcaggccccugggaagggacuggaauggguggcguccaucucuuaugacggccgcgauuucuaccaugcucgaucggucuggggucguuuuacaauuucaagagacaacagcaaaaauacuuugcacuuacagaugaacagucugaggguggaggauacggcccuauauuucuguguuaaggaccaacgggaagaugagugcgaagaguggugguccgacuacuaugauuuugggcgcgagcucccauguagaaaaucuaggggacugggccuugcaggcauauucgacaucugggggcauggaaccauggugacagucagcucc

SEQ ID NO: 24741 - RNA, 438 nt, Artificial Sequence
  derived and/or modified sequence opt3 from anti-HIV_cap256-119-128152_VR-Chain
caggugcaacuggucgagagcggcgggggaguugugcagcccgguagaucccucaggcuuucuugcgccguaucaggcuucaccuuuacaaguuacccuaugcacugggugcggcaggcuccagggaagggacuggaaugggucgcaagcguguccaacgacggcacuaaaaaguaucauggugauucuguuugggaccgcuucacgaucucgcgagauaauagcaaaaacaccuuguuuuuacagaugucaagucugcgugccgaggacacagcgguguacuucugugucagagaugaaagggaggacgaaugcgaggaguggugguccgauuauuacgacuuugggcgggaacuaccgugucgcaaguucagaggacucggccuggcuggcauuuuugauauaugggggcacggaacucuugugaccguaucuagc

SEQ ID NO: 24742 - RNA, 438 nt, Artificial Sequence
  derived and/or modified sequence opt3 from anti-HIV_cap256-119-127693_VR-Chain
gaggugcagcugcucgaaagcggcgggggacuuguccaacccgguggcucccugagauugucuugcgccgcuucaggguucaccuuuaguagcuacgcaauggccuggguuaggcaggcgccuggaaagggcuuagaguggguggcuuccaucucuaacgacgguucgaaaaaguaucacggggauucaguaugggcccgguucauuauaagccgcgacaauaguaaaaacacacuguuucuacagauguccucucuccgaguggaagauacugcacuguacuucuguguccgugaccauagagaggaugaaugcgaggagugguggagcgacuauuacgauuuuggaagggaacuuccaugucggaaguuccgcggccugggcuuggccgggaucuuugacauuuggggacacgguacgauggugaccguuuccuca

SEQ ID NO: 24743 - RNA, 432 nt, Artificial Sequence
  derived and/or modified sequence opt3 from anti-HIV_cap256-119-126684_VR-Chain
caggugcaacuggucgagagcggcgggggagccguuagacccgguaggucccuccggcuuucuugcgcuaccucaggcuucacauuuaguaacuacgcaaugcacugggugcgccaggccccugggaagggacuggaauggguaacuggcaucagcuucgcggguacgaaaaccuauuacggggacuccgugcgaggacguuuuacagucucuagagauauuucgaagaauacuuuguucuuacagaugaacucacugaggccagacgauaccgcuauguauuacugugcccgggaccagcgcuauuacgagugcgaagagugggcaagcgauuauuacgacuuuggcagagaacaaccgugucuagaucccaggggcgugguugggauauucgaccucuggggacaggguacaauggugaccgucaguucc

SEQ ID NO: 24744 - RNA, 438 nt, Artificial Sequence
  derived and/or modified sequence opt3 from anti-HIV_cap256-119-126056_VR-Chain
gaggugcagcuggucgaaagcggcgggggacucguucaacccgguggcucccuuagacugucuugcgccgacucaggguucaccuuuaguagcuacuggauguccugggugaggcaggcuccuggaaagggcuuggaguggguagcaucuaucucgaaugaugguacuaaaaaguaucacgccgaaucagugugggaccgguucagcauuaguaaagauaauuccaagaacacauuauuucugcagaugaacucucuacgcgucgaggacacggcgcucuacuucugugugaaagaucagcgagaagacgagugcgaggaaugguggagcgauuauuacgacuuugggcgugagcugccauguagaaaguccaggggacuuggccuggcuggcauauucgauaugugggggcauggaaccaugguuacagugucaagu

SEQ ID NO: 24745 - RNA, 432 nt, Artificial Sequence
  derived and/or modified sequence opt3 from anti-HIV_cap256-119-125765_VR-Chain
caggugcaacugguccagagcggcgggggaguugugcagcccgguagaucccucaggcuuucuugcgccgcuucaggcuucaccuuuaguagcuacguaaugcacugggugcggcaggcaccugggaagggacuggagggcgucgccgugaucuccuucgacgguaacaaugaauauuacgcggauucuguuaaagggcgcuuuacaauuucgcgagacaacucaaagaauacuguguauuugcaaaugaacagcuuacgugucgaggauacggcucuguacuauugugccaaagacaugagagaauacgagugcgaagaguggaccagugauuauuacgacuucggaaggccacagccguguauagauucccggggcgugguaggcauccuagacauuugggggcagggaaucaugguuacagugucuagc

SEQ ID NO: 24746 - RNA, 438 nt, Artificial Sequence
  derived and/or modified sequence opt3 from anti-HIV_cap256-119-125106_VR-Chain
caggugcaacuggucgagagcggcgggggaguugugcagcccgguagaucccucaggcuuucuugcgccgcuucaggcuucaucuuucggaguuacgggaugcacuggguacgccaggcaccuggaaagggccuggaauggguggccagcauuuccaacgacgguaccaaacgauaucaugcggagucugucugggaucguuucucgauaucaaaggacaauagcaaaaacacauuguuuuuacagaugaauagucugagaguggaagauacugcucuauacuucuguguuaaggaccaaagggaggaugaaugcgaggaguggugguccgacuauuacgauuuugggcgggaacucccaugucgcaaaucuagaggacugggccuugccggcaucuucgacaugugggggcacggaacgauggugaccgucagcucc

SEQ ID NO: 24747 - RNA, 435 nt, Artificial Sequence
  derived and/or modified sequence opt3 from anti-HIV_cap256-119-124026_VR-Chain
caggugcaacuggucgagagcggcgggggaguugugcaguccgguagaucucucaggcuuaccugcucaggcagugccuuccgguuuagcuccuacacaguacacugggugcgccaggcucccgggaagggacuggaaugguuggcauuaaucucuuaugacggccagaaaaagcauuucgccgauucggucaaaggucgauuuacuauuucacgugacaacagcaagaauaaccuguuccuacaaaugaauagucucagacuggaggauacggcgcuuuacuauugugcuagggaccugcgggaauuggauugcgaggaauggacccucuacaacuauuacgacuuugggucccgcggaccuuguguggauccaagaggcguuggcgggucuuucgacguguggggacaggguacaauggucacugugagcucc

SEQ ID NO: 24748 - RNA, 432 nt, Artificial Sequence
  derived and/or modified sequence opt3 from anti-HIV_cap256-119-121783_VR-Chain
cugggcagacucguggccagcgggggaggugucguucccccuggcgggucccuuacccugucuugcgugacaucacaguucacuuuuaguggauguggcuugcacuggguaaggcaagcuccagguaagggguuagaguggguggcaagcaucuccuucgccggaacgaaaaagcauuacgggucuucgguccggggccgcuuuucaauuagccgagacaacaguaaaaauacccuguaucuacagaugaacucccuccguacagaagauacugcgcuguacuucugcgcuaaggaccuuagagaguaugaaugugaggaauggaccucugauuacuaugacuuuggcaggccgcagcccugcauagauagccggggagugguugguauccuggacauuuggggccaggggacaauggugaccgucuccuca

SEQ ID NO: 24749 - RNA, 432 nt, Artificial Sequence
  derived and/or modified sequence opt3 from anti-HIV_cap256-119-121208_VR-Chain
cugggccggcucguggccagcgggggaggugucguucccccuggcaagucccuuacccugucuugcguggcuucacaguucacauuuaguggguguggauugcacuggguaaggcaagcaccaggcaaagguuuagaguggguggccagcaucuccuucgcggggacuaagaaacauuacggaaauuuuguccggggccgcuucacgauuucucgagacaauucgaagaacacccuguaucuacagaugaacucacuccgugcugaagauacagcccuguacuauugcgcaaaagaccuuagagaguacgaaugugaggaauggacuagcgauuauuacgacuuuggcaggccgcagcccugcauagauaguagaggggugguuggaauccuggacauuuggggucagggcaccauggugacagucuccucu

SEQ ID NO: 24750 - RNA, 432 nt, Artificial Sequence
  derived and/or modified sequence opt3 from anti-HIV_cap256-119-120945_VR-Chain
caggugcaacuggucgagagcggcgggggaguugugcagcccgguggcucccuccggcuuucuugcguagccucaggguucaccuuuaguaacuacggaaugcacugggugaggcaggcuccuggcaagggucuggcaugggucgccuucauccgguaugacgggagcaauaaauacuauguggauuccguuuggggacgcuuuacaauuucucgagacaacucgaagaauacuuugcauuuacagaugaacucacugcguccagaagauacggcgcuauacuucugugcuagagaccucagggagagcgaaugcgaggaaugggagaguuauuacuaugauuuuggcaauaaaggcccgugugugaagcccagaggggucgugggaguacuggacauauggggucaaggcacccuuguuacaguguccucu

SEQ ID NO: 24751 - RNA, 432 nt, Artificial Sequence
  derived and/or modified sequence opt3 from anti-HIV_cap256-119-118229_VR-Chain
caggugcaagucguugagagcggcgggggagugguacagcccgguagaucccugaggcucucuugcgccgcuucaggcuucaccuuuaguaauuacgcaauccacugggugcggcaggccccugggaagggacuugaaugggucgcgcugauuagcuaugacggcuacaauaaauauuacgcugauuccgugcgcggucgauucacaauaucucgugacaacucgaauaacacuguuuauuugcagaugaacucauuaaagccagaggauacggccguguacuauugugcaagagaccugagggaaagcgagugcgaagagugggagaguuacuacuaugauuuugggaaaaagggaccgugugucaaaccccggggcgugguaggcguucuagacaucugggggcaaggaacccucgugacagucuccucu

SEQ ID NO: 24752 - RNA, 432 nt, Artificial Sequence
  derived and/or modified sequence opt3 from anti-HIV_cap256-119-118025_VR-Chain
gaggugcagcuggucgaaagcggcgggggaguugugcaacccgguaagucccucagacuuucuugcaccgccucacaguucacauuuaguaacuucggcaugcacuggguaaggcaggcuccugggaaaggacuggaguggguggcaagcaucuccuuugucggcauuaagacucauuacgccaauucugugcggggucgcuucacgauaucgcgagaccagucaaagaacaccuuguauuuacaaaugaauagcguucguaucgaagauacagcgagauacuuuugugcuagggacaugcgggaguaugaaugcgagcugugggccagugauuacuaugacuucgggaaaccacagccgugugaggauccccgcggaguggucggcacuuuugacauguggggccuagggacccucgugacaguauccucu

SEQ ID NO: 24753 - RNA, 432 nt, Artificial Sequence
  derived and/or modified sequence opt3 from anti-HIV_cap256-119-117418_VR-Chain
caggugcaacuggucgagagcggcgggggaguugugcagcccgguagaucccucaggcuuucuugcgccgcuucaggcuucaacuuucggaauuacgacaucaacuggguacgccaggugccugggaagggacuggaaugggucgcagccauuaguuucgauggcgcggacaaauaucacgcugauaauguguggggucgauugagcauaucccgugacaacucuaagucgaccuuauaccugcagaugaacucacuaagaccagaggauacagccguuuauuuuugugcaaaagaccucagggaagaugagugcgaggaacgguggagcgacuacuaugauuucgggaagcaacugccgugucgcaaaaguagaggaguggccggcaucuuugacaauuggggccaggggacuauggucacgguguccgcu

SEQ ID NO: 24754 - RNA, 432 nt, Artificial Sequence
  derived and/or modified sequence opt3 from anti-HIV_cap256-119-117250_VR-Chain
caggugagacuggucgagagcggcgggggaguugugcaacccgguggcucccucaggcuuucuugcgccgcuucacaguucaccuuuagugcauacgggaugcacuggguacggcaggccccuggaaagggccuggaauggguggcgagcaucuccuucgacgguacagauaaauuucaugcugacaaggucugggggcgcuuggugauuucucgagauaacucgaaaaauacuuuauaucugcagaugaacucacuacguccagaggacacggccguuuacuauugugcaaaggaucucagagaagacgagugcgaagagagguggagcgauuacuaugacuucggaaaacaacugccgugucggaagagucgcggcguggccggcgucuuugauaauugggggcagggaaccauggugacaguauccucu

SEQ ID NO: 24755 - RNA, 432 nt, Artificial Sequence
  derived and/or modified sequence opt3 from anti-HIV_cap256-119-117230_VR-Chain
caggugcaacuggucgagagcggcgggggagguguucagcccggcagaucccucaggcuuucuugcgccgcuucaggguucacccugaguagcuacggaaugcacugggugcggcaggcaccuggcaaggguuuggaauggguagccuccaucucuuuugacgggcgcgauuauuaccauucgccacacguguggggacgauuaacaauuucacgugacaacagcaaaaauacucuguaucuacagaugaacagucucagagcggaggauacggcucuguacuauugugccagggaccuucgggaauccgagugcgaagagugggagucugauuacuaugacuucggcaagaaaggcccgugugucaagccccgcgggguggcaggaagccuggauauguggggucaaggcaccaugguuauaguguccuca

SEQ ID NO: 24756 - RNA, 432 nt, Artificial Sequence
  derived and/or modified sequence opt3 from anti-HIV_cap256-119-116999_VR-Chain
caggugcaacuggucgagagcggcgggggaguugugcagcccgguaccucccucagaaucucuugcgccgcuucacaguucacauuuaguagguacggcaugcacuggguacggcaggcaccugggaagggacuugaauggguggccagcauuuccuaugacggccgcgauuacuaucaugcgggucgagucugggggcguuucacuauaucuagagacaacucgaaaaauacgcuguacuugcaaaugaacucauuaaggccagaggauaccgcucuguauuuuugugugcgggacagccgcgaaagugagugcgaagagugggaguccgauuacuaugacuucggaaagaaacuaccguguguuaagcccagaggcguggucggcgugcucgaucugugggggcagggaacacuuguaacuguuucuagc

SEQ ID NO: 24757 - RNA, 432 nt, Artificial Sequence
  derived and/or modified sequence opt3 from anti-HIV_cap256-119-116558_VR-Chain
caggugcaacuggucgagagcggcgggggaguugugcagcccgguagaucccucaggcuuucuugcgccgcuucaggcuucaccuuuaaccgguacagucugcacuggguacgccaggcaccugggaagggauuggaauggguggccuucacaagcuaugacggcuccaauaaauacuauccagauucugucaagggucgauuuacuaucucgcgugacucaagcaaaaacacguuauaccuggagaugaauagucuaagaccggaagauaccgcgcucuauuacugugcuaaggacaugaggggguaugagugcgaagaguggacauccgauuacuacgacuucggacggccccagccuuguauugauucucgcggcgugguuggcacuuuugacgugugggggcaaggaaccauggucacagugagcucc

SEQ ID NO: 24758 - RNA, 432 nt, Artificial Sequence
  derived and/or modified sequence opt3 from anti-HIV_cap256-119-116484_VR-Chain
gacgugcagcugcucgagagcggcggggaucuuguccaacccggagguucccugagauugucuugcgccgcuucaggcuucaccuuuacaaaguacgaaaugacuuggguuaggcaggcaccugggaaaggauuagaguggguggccaguaucagcuaugacggcuccgauaaguaccacacgucuucgcuguggggucgguucauuguaucacgcgacaacagcaaaaauacccuauaucuccagaugaacagucugcgaccagaagauacagcgcuuuacuauugugugcgugacagaagggaguccgaaugcgaggagcgguggucugauuacuaugacuuugggaagcagcugccgugugucaaaccccgcggaguggcuggcauauucgauaucuggggccaagggacuaugguuaccgugagcucc

SEQ ID NO: 24759 - RNA, 438 nt, Artificial Sequence
  derived and/or modified sequence opt3 from anti-HIV_cap256-119-114844_VR-Chain
gaggugcagcuggucgaaagcggcggggaccucguucaacccggaagaucccuuaggcugucuugcgccgcuucagguuucaccuuuaguagcuacuggauguccugggugcggcaggcaccuggcaagggguuggaguggguagccucuaucucgaacgauggaacuaaaaaguaucacgaagagucaguguggggccgcuucacaauuagcaaagacaauaguaaguccacguuauuucugcagaugaacucucuacgagucgaagauaccgcgcucuacuucugugugaaagaccagcgugaggaugagugcgaagagugguggagcgacuauuacgauuuugguagagaacugccauguaggaagucccgggggcuuggacuggcuggcauauucgacauguggggccaugggacaaugguuacugugucaagu

SEQ ID NO: 24760 - RNA, 438 nt, Artificial Sequence
  derived and/or modified sequence opt3 from anti-HIV_cap256-119-114141_VR-Chain
ggcgggagaagcggagguggcggggugggaaccacacccaggcggggcccucugcgccucuccugcgccgcuucugguuucacucuugacgauuacgcaaugcacuggguccgacaggccccagggaagggacuggaguggguugcgucaaucaguaaugacggcacgaaaaaguaucaugcugaaagcgugugggaucguuuuuccauuucuaaagacaauucgaagaacaccuuguucuuacaaaugaacucacugagaguagaggauacagcccuauacuuuugugugaaagaccagagggaagaugagugcgaagagugguggagcgacuauuacgucuucugggagcgggcaccgugucgcacugugcccggcagagggccuggaugguauuuugauaugguugguaggcggaccauggugacagucaguucc

SEQ ID NO: 24761 - RNA, 432 nt, Artificial Sequence
  derived and/or modified sequence opt3 from anti-HIV_cap256-119-111917_VR-Chain
gaggugcaccuggucgaaagcggcgggggacucguucagcccgguggcucccuuagacugucuugcgccgcuucaggguucaccuuuaguagcuacggaaugcauugggugaggcaagcaccuggcaaggguuuggaguggguagccacaaucuccuucgacggggcggauaaauaucacgcugacgauguguggggacgguuuucuauuucgcgcgacaacucaaagaauacuuuauaccugcagaugaacaaucuacgaccagaagauacggcccucuauuacugugcaaaagaccugcgugaggaugaaugcgaggagagauggagcgacuauuacgauuucggcaagcagcuuccguguaggaaaagucggggcgucgccgggguguuugacaacuggggacaggguaccaugguuacaguguccucu

SEQ ID NO: 24762 - RNA, 432 nt, Artificial Sequence
  derived and/or modified sequence opt3 from anti-HIV_cap256-119-111862_VR-Chain
caggugcaacuggucgagagcggcgggggaguugugcagcccgguggcucccucaggcuuucuugcgccgcuucaggguucaccuacagugacuauggaaugcacuggguaaggcaggcaccuggcaagggucuggaauggguggccagcaucuccuuugcggggacaaaacagcauuacggaaacucugucaagggccgguucacuauuucgcgcgauaauucaaagaacacgguguauuugcaaaugaauagcuuacgaguugaggacaccgcucuguacuauugugccaaagauaugcgugaauacgagugcgaagaguggacaagugacuauuacgauuuuggcagaccacagccguguauagacuccagagggguggucggaauccuagauauuuggggucagggcaucauggugacuguaucuagc

SEQ ID NO: 24763 - RNA, 432 nt, Artificial Sequence
  derived and/or modified sequence opt3 from anti-HIV_cap256-119-110064_VR-Chain
cugggcagacucguggccagcgggggaggugucguucccccuggcaggucccuucggcugucuugcguggcuucacaguucaccuuuaguggguguggauugcacuggguacgccaagcaccaggcaaggguuuagaguggguggccagcaucuccuucgcggggacaaaacagcauuacggaaacucugucaagggccgauuuacuauuucgcgugacaauucaaagaacacgguguaucugcagaugaauagccuaagaguugaagauaccgcucucuacuauugcgccaaagacaugagggaguacgaaugugaggaauggacaagugauuauuacgacuucggccggccgcagcccugcauagauucccgcgggguggucggaauccuggacauuuggggucaaggcacuauggugaccguaucuuuu

SEQ ID NO: 24764 - RNA, 432 nt, Artificial Sequence
  derived and/or modified sequence opt3 from anti-HIV_cap256-119-109192_VR-Chain
caggugcaacuggucgagagcggcgggggaguugugcagcccgguagaucccucaggcuuucuugcgccgcuucaggcuucaccuuuaguaacuacgcaaugcacuggguacggcaggccccugggaagggacuggaauggguggcggucaucgcuuaugacggcgauaauaaguacuaugccgacagcgugaagggucgcuucacaauuucccgagauaacucuaaaaauacuuuguacuuacagaugaacucgcugcgugcagaggacacggcccuauauuacugugcuaaggaucucagagaagacgagugcgaagagugguggucagauuauuacgaccuggggaaacaacuuccauguaggaaaagccggggaguugcaggcgugcuggauaaguggggcuuggggaccauggucacagugaguucc

SEQ ID NO: 24765 - RNA, 435 nt, Artificial Sequence
  derived and/or modified sequence opt3 from anti-HIV_cap256-119-108793_VR-Chain
caguuccaacugguggagagcggcgggggagucguucagcccgguagaucccucaggcuuucuugcgccgcuucaggcuuuaccuucaguagcuacccuaugcacugggugcggcaggcaccagggaagggacuggaauggguagccuugaucuccuaugacggcacagauaaauacuaugcggacucugugaagggucgcuuuacuauuucgcgagauaacagcaaaaauacguuauaccugcagaugaacucacuacgugucgaggacaccgcuguguaucauugugccaaggaucucgggggaaguaaauccgacgaaugggcaacagauuacuauuacgacuggucuaaggccuacccgguucacgaucccagagcuguggucggcguguucgacauauggggccaagggacucugguaaccguuagcucc

SEQ ID NO: 24766 - RNA, 432 nt, Artificial Sequence
  derived and/or modified sequence opt3 from anti-HIV_cap256-119-108127_VR-Chain
caggugcaacuggucgagagcggcgggggaguugugcagcccgguagaucccucaggaucucuugcgccgcuucacaguucaccuuuaaucgguacggcaugcacuggguacgccaggcaccugggaagggacuugaauggguggccaguauuagcuaugacggcuccgauaaauaccaugcgggucuggucugggggcgauucauaaucucucgugacaauucgaagaacacauuguauuuacaaaugaacucacugagagcugaggauacugcccuauacuauugugugagggaccggcgcgaaagcgagugcgaagagagauggagugauuacuaugacuuuggaaaacagcucccauguguuaagccgaggggcguggcaggcauuuucgauaucugggggcagggaacgauggucaccguguccucu

SEQ ID NO: 24767 - RNA, 438 nt, Artificial Sequence
  derived and/or modified sequence opt3 from anti-HIV_cap256-119-107758_VR-Chain
gaggugcagcuggucgaaagcggcgggggacucguuaagcccgguggcucccuuagacugucuugcgccgcuucaggguucaccuuuaguaacgcauggaugagcugggugaggcaagccccuggaaaaggcuuggaguggguagcguccaucucuaaugacgguacaaagaaauaccacgaagagucggugugggggcgguucacuauuucaaaggauaacagcaaaaauacguuauuucugcagaugaacagucuacgcauagaagacaccgcucucuauuucugugucaaggaucagcgagaggacgagugcgaagaguggugguccgauuacuaugacuuuggacgugaacugccauguagaaagucuaggggccuuggccuggccgggaucuucgauauguggggacaugguacaauggugacuguuagcucc

SEQ ID NO: 24768 - RNA, 432 nt, Artificial Sequence
  derived and/or modified sequence opt3 from anti-HIV_cap256-119-107209_VR-Chain
gaggugcagcuggucgaaagcggcgggggacucguucaacccgguagaucccuuaggcugucuugcaccgccucaggcuucacauuuggggacuacggaaugcacugggugcggcaggcuccuggcaaggguuuggaguggguagcagccaucaguuucgauggggcggacaaauaucaugcugauaacguguggggacgcuuaagcauuucccgagacaauucuaagucgacucuguaccuacagaugaacucacuccguccagaagauacggccgucuauuuuugugcaaaagaccugagagaggaugaaugcgaggagagguggagcgacuacuaugauuucggcaagcagcuuccgugucggaaaagucgcggcguggccgggauauuugacaauuggggacaagguaccaugguuacaguguccgcu

SEQ ID NO: 24769 - RNA, 432 nt, Artificial Sequence
  derived and/or modified sequence opt3 from anti-HIV_cap256-119-107184_VR-Chain
caggcccaacugguggagagcggcgggggagucguucagcccgguagaucccucggccuuucuugcgcugcaucaaaguucagucugagcuccuacgggaugcacugggugaggcaggccccuggacggggcuuggaauggguagcggguaucucuuuugcugggaccaaaaaguauuacgccgacucggugcgcggacgauucucagucagcacagauauuaguaaaaauacuuuauaucugcagaugaacucccuacguccagcagacacggcccucuacuuuugugcuagagaucugagguauuacgagugcgaagagugggcaucugacuauuacgauuucggcaaggaacaaccgugucuugacccccggggcgugguugggauauuugaucuguggggacaggguaccauggugacagucagcucc

SEQ ID NO: 24770 - RNA, 438 nt, Artificial Sequence
  derived and/or modified sequence opt3 from anti-HIV_cap256-119-106827_VR-Chain
gccgugcagcuggucgagagcggcgggggacucguucaacccgguggcucccuuagacugucuugcucagugagucaguucaccuuugggagguacggaauguauuggguacggcaggcuccuggcaaggguuuggaauggguggcagucaucagcuacgacgggggaaaccgcuauuacgccgauuccgugaaaaaucgauucucuauuucgcgugacaacucaaagaauacauuauuucugcagaugagcagucuaagagcggaggauacugcucucuauuucuguguuagggaccaccgggaagaugagugcgaagaguggugguccgacuacuaugauuuuggccgcgagcugccauguagaaaauucaggggccuugggcuggccggaauauuugacaucuggggucauggcacgauggugaccgucucuagc

SEQ ID NO: 24771 - RNA, 432 nt, Artificial Sequence
  derived and/or modified sequence opt3 from anti-HIV_cap256-119-106511_VR-Chain
caggugcaacuggucgagagcggcgggggaguugugcagcccgguagaucccucaggcuuucuugcguagccucacaguucaguuuugaccgguacggcaugcacugggugcgccaggcuccugggaagggacuggaaugggucgcaagcaucuccuucgauggcaccgacaaauaucaugccgauaagguguggggucgauuuacaauuucucgugacaacucgaaaaauacuuuguacuuacaaaugaacucacugagaccagaggauacggcgcuauauuacugugcuaaggacaugagggaagaugagugcgaagccugguggagcgacuauuacgaucucgggaaacagcugccgugucgggagagucgcggaguugcaggcauauucgacgaguggggccaggggaccauggugacagucuccucu

SEQ ID NO: 24772 - RNA, 432 nt, Artificial Sequence
  derived and/or modified sequence opt3 from anti-HIV_cap256-119-106327_VR-Chain
caggugcaacuggucgagagcggcgggggaguugugcagcccggucggucccucaggcuuucuugcgccgcuucaggcuucaccuuuaguagcuacgcaaugcacuggguacggcaggccccugggaagggacuggaauggguggcggcuaucuccggcggugggggaaacacauaugucgccgacucugugaaaggccgcuucacuauuucgcgagauaauucaaagaacacgguuuacuugcagaugaauagcuuacgucuggaggacaccgcacuauauuacugugccaaagaucucagagaauaugagugcgaagaguggacaagugacuacuaugauuuuggcaggccacaaccguguauagacuccagagggguggucggaauccuggauauuuggggucagggcacuauggugaccguaucuagc

SEQ ID NO: 24773 - RNA, 438 nt, Artificial Sequence
  derived and/or modified sequence opt3 from anti-HIV_cap256-119-105486_VR-Chain
caggugcaacuggucgagagcggcgggggaguugugcagcccgguggcucccucagacuuucuugcgccgcuucaggguucaccguaaguggauacggcaugcacugggugaggcaggccccugcaaagggucuggacugggucgcguuuaucagccaugauggguccaacaaauauuacgcugacucugugcggggacgcuucauuauaucgcgagauaauucaaacaauacauuguauguucagaugagcaguuuacgugccgaagacacugcacuguacuuuugugugagagaucacagggaggacgaaugcgaggaauggugguccgauuauuacgacuucggccgggagcuaccaugucgcaaguuuagaggccucgggcuggccggaaucuucgauauuuggggucauggcacgauggucaccgugucuagc

SEQ ID NO: 24774 - RNA, 432 nt, Artificial Sequence
  derived and/or modified sequence opt3 from anti-HIV_cap256-119-105197_VR-Chain
caggugcaacuggucgagagcggcgggggaguugugcagcccgguagaucccucaggcuuucuugcgccguaucacaguucaccuuuggccgguacgggaugcacugggugcgccaggcuccuggaaagggccuggaaugggucgguaguaucagcuaugacggguccgauaaauaccauacaaacucuuuguggggacgauucauugugucgcgugacaauucaaagaacacuuuauaucugcaaaugaauaaccuaagaccagaggauacggcacucuacuauuguguuagggaccggcgcgaaagcgagugcgaagagagauggagugauuacuaugacuuuggcaaacagcugccgugugugaagcccaggggcgucguggggguacuugauauauggggacaggguacccugguuacaguguccucu

SEQ ID NO: 24775 - RNA, 432 nt, Artificial Sequence
  derived and/or modified sequence opt3 from anti-HIV_cap256-119-104946_VR-Chain
caggagcaacugguggaaagcggcgggggagucguucagcccgguagaucccucaggcuuucuugcguggccucacgguucaccuuuagugcuuucggcaugcacuggguacgccaggcaccugggaagggacuggaguggguggccagcaucuccuuugcgggcauuaaaaaguacuauggugacucugucaaagggcgauucacaauaucgcgugauaacucaaagaauacuuuguacuuacagauggacggacugagaggcgaagauacggcucuauauuacugugccaaagaccucagggagcuggaaugcgaggagugggcaagcgauuauuacgacuuuggccggccacaaccguguaucgauagucgcggggugguugguauucuugacaucuggggacagggcauuauggugaccgucuccucu

SEQ ID NO: 24776 - RNA, 432 nt, Artificial Sequence
  derived and/or modified sequence opt3 from anti-HIV_cap256-119-103667_VR-Chain
caggugcaccuggucgagagcggcgggggaguugugcaacccgguaagucccucagacuuucuugcgccgcuucacaguucaccuuuaauagguucggcaugcauuggguacggcaggcaccugggaaaggacuggaauggguggccggcaucaguuacgacgguagcgauaaguaucacgcggacaaagucugggggcgcuuuacaauuucccgagauaauucuaagaacacuuuguacuuacagaugaacucgcugcgugcugaggacacggcccuauauuacugugcaaaagaucucagagaagacgagugcgaagagugggccucagauuauuacgacuucggaaaggagcaaccaugucuggauccgaggggcgugguuggcauauuugacaucugggggcagggaaccauggugacagucagcagu

SEQ ID NO: 24777 - RNA, 438 nt, Artificial Sequence
  derived and/or modified sequence opt3 from anti-HIV_cap256-119-103385_VR-Chain
gaggugcagcuggucgaaagcggcgggggacucguucaaaccgguggcucccuuagacugucuugcgccgcuucaggguucacauuuaguagguacgacaugaacugggugcggcaggcacccggaaagggcuuggaguggguagccagcaucuccaaugaugguucuaaaaaguaucacggggacucggugugggcgcgcuucacuauuucacgagauaacagcaaaaauacguuauuucugcagaugaguucccuacgugucgaagacaccgcucucuacuucugugugagagaucagagggaggacgaaugcgaggagugguggucugauuauuacgacuuuggacgggaacugccuugucgcaaguucagaggccuuggccuggccgggauauuugauaucuggggacaugguacaaugguuacugugagcucc

SEQ ID NO: 24778 - RNA, 438 nt, Artificial Sequence
  derived and/or modified sequence opt3 from anti-HIV_cap256-119-103267_VR-Chain
gaggugcccagcgucgaauccggcgggggacugguucagaccgguggcucucucacacuuucaugcgccgcuagucaauucacuuuuagcaacuacgggaugcacugggugagacaggcaccuggaaagggccuggaguggguagccuccaucucuaaugacgguucgaaaaaguaucauggggauucagugugggcgagguucauuauaagccgggacaacaguaaaaauacguuguuuuuacagauguccucucugcgcgcugaagauaccgcccuauacuucuguguccgagaccaccgugaggaugaaugcgaggagugguggagcgacuauuacgauuuuggaagagaacucccauguaggaaguuccggggccugggccuugcagggaucuuugacauuuggggacaugguacaauggugacuguuuccuca

SEQ ID NO: 24779 - RNA, 432 nt, Artificial Sequence
  derived and/or modified sequence opt3 from anti-HIV_cap256-119-103011_VR-Chain
caggugcaacuggucgagagcggcgggggaguugugcagcccgguggcucccucagacuuucuugcgccaccucaggguucacauuuggaacuuucggcaugcacuggguaaggcaggcuccugguaaggggcuggacuggguggcagccaucaguuuugcgggaacgaaaaagaacuacgcugauagcguccggggccgcuucaccauuucccgagacucuucgaaaaauacauuguauuuacagaugaacucacugcguccagaagauacugcccuauacuauugugugaaggacaugagaggcuacgagugcgaagaguggaccagcgauuauuacgacuuugggaggccgcaacccuguauagauagucggggaguuguggguacauucgacgucuggggccaggggaccauggugacuguauccucu

SEQ ID NO: 24780 - RNA, 438 nt, Artificial Sequence
  derived and/or modified sequence opt3 from anti-HIV_cap256-119-102072_VR-Chain
gaggugcagcuggucgaaagcggcgggggacucguucaacccgguggcucccuuagagugucuugcgccguaucaggguucaccuuuaguaacuacgagaugaauugggugaggcaggcuccuggaaagggccuggaaugggucgcaagcaucuccaacgacgguacuaaaaaguaucacgccgagucugugugggaucgguucucgauuucaaaagacaauagcaagaacacauuguuuuuacagaugaauagucugcgcguugaagauacggcgcuauacuucugugugaaagaccagcgagaggaugagugcgaagaguggugguccgacuauuacgauuuugggcgugaacucccauguagaaagucuaggggacugggccuugcuggcauauucgacaucugggggcauggaaccauggucacagugagcucc

SEQ ID NO: 24781 - RNA, 438 nt, Artificial Sequence
  derived and/or modified sequence opt3 from anti-HIV_cap256-119-101945_VR-Chain
gaggugcagcuggucgaaagcggcgggggacucguucaacccgguggcucccuuagacugucuugcgccgcuucaggguucaccuuuaguagcuacgugaugcacuggguaaggcaggcaccuggaaagggcuuggaguggguggccuccaucucuaacgacgguacuaaaaaguaucaugaagagucggucugggggcgguucacaauuucaaaagauaauagcaagaacacguuauuucugcagaugaauagucuacgcauagaagacaccgcgcucuacuucugugugaaagaucagcgagaggacgagugcgaagaguggugguccgauuauuacgacuuuggacgugaacugccauguagaaagucuaggggccuuggccuggcugggaucuucgauauguggggacacgguacaaugguuacugugagcucc

SEQ ID NO: 24782 - RNA, 432 nt, Artificial Sequence
  derived and/or modified sequence opt3 from anti-HIV_cap256-119-101319_VR-Chain
caggugcaacuggucgagagcggcgggggaguugugcagcccgguaagucccucagacuuucuugcguaggcucaggguucaccuuugacgauuacggaaugcacugggugaggcaggccccuggcaaaggucuggaaugggucgcuaguaucagcuaugacgggcgggauuucuaccaugcacgcuccguguggggacgauuuacaauuucucgugacaacucgaagaauacuuugcacuuacagaugaacucacugagaccagaggauacggcccuauauuucugugcgagggaccuccgggaaagcgagugcgaagagugggagaguuacuauuacgauuuuggcaaaaagggcccguguguuaaaccccgcgggguggucggagugcuggacauauggggucaaggcacccuuguaacaguuuccucu

SEQ ID NO: 24783 - RNA, 432 nt, Artificial Sequence
  derived and/or modified sequence opt3 from anti-HIV_cap256-119-100871_VR-Chain
caggugcaacuggucgagagcggcgggggaguugugcagcccggugaaucccucagaaucucuugcgccgcuucacaguucaccuuuaguagguacggcaugcacuggguacggcaggcaccugggaagggacuugaguggguggccagcauuuccuucgacggccgcgauaaauaucauucuucgcuggucuggggucgauugacaauaucacgugacaauagcaagaguacuuuauuucugcaaaugaacucccuaagagcggaagauacggcucucuacuauugugccagggaccugcgggagucugaaugcgaggagugggaaagcgauuacuaugacuucgggaaaccacagccgugugaggauccccgcggagugguuggcaccuuugacauguggggccuugggacacuggugacugucuccuca

SEQ ID NO: 24784 - RNA, 432 nt, Artificial Sequence
  derived and/or modified sequence opt3 from anti-HIV_cap256-119-100838_VR-Chain
gaggugcagcuggucgaaagcggcgggggaguugugcaacccgguggcucccucagacuuucuugcgccgcuucaggguucaccuuuaguagcuacggaaugcacuggguaaggcaggcaccuggcaagggucuggaguggguggccuucauccgguaugacggguccaacaaauacuaugcggauucugucaagggacgcuuuacaauuucgcgagacaauucaaaccauacuuuguacaugcaguuagauagccugcgugcugaagacacggcccuauauuacugugcaaaagaucucagagaguaugaaugcgaggaguggaccagugacuacuacgauuucggcaggccacagccguguauagacucccggggcgugguugggauccuggauauuuggucucaaggaacaauggugacugucagcucc

SEQ ID NO: 24785 - RNA, 438 nt, Artificial Sequence
  derived and/or modified sequence opt3 from anti-HIV_cap256-119-100025_VR-Chain
caggugcaacuggucgagagcggcgggggaguugugcagcccgguagaucccucaggcuuucuugcgccgcuucaguauucaccuuuaguuacuauggcaugcacugggugcggcaggcaccugggaagggacuggaaugggucgccuucaucagccaugacggcuccaacaaauacuaugcggauucugugcgcggucgauuuauuauaucgcgugacaauucaaacaauacauuguacguucagaugaacagcuuaagagcugaggauacugcccuguauuucugugugaaggaccaaagggaagaugagugcgaagagugguggagugacuacuaugauuuugggcgggagcuaccaugucgcaaauucagaggacucggccuggcaggcacguuugacaucugggggcacggaaccaugcuuauugucuccucu

SEQ ID NO: 24786 - RNA, 432 nt, Artificial Sequence
  derived and/or modified sequence opt3 from anti-HIV_cap256-119-100000_VR-Chain
cagaugcaacugguggagagcggcgggggagucguucagcccgguagaucccucacccuuucuugcgccgcuucacaguucacauuuaguaacuacggcaugcacugggugaggcaggcaccugggaagggacuggaauggguagccagcaucuccaaugacggcaacaaaaaguaucauggugauucugugugggcgcgguucacuauuucgcgcgacaauagcaaaaacacguuguuuuuacaaaugucaagucugcgaaccgaggauacagcucuauacuucuguguccgugacagaagggaauccgagugcgaggaacgguggucugauuauuacgacuuugggaagcagcucccaugugugaaaccgcgcggaguugccggcauauucgauaucuggggccaggggacuauggugaccgucagcucc

SEQ ID NO: 24787 - RNA, 432 nt, Artificial Sequence
  derived and/or modified sequence opt3 from anti-HIV_cap256-119-098890_VR-Chain
caggugcaacuggucgagagcggcgggggaguugugcagcccggugaaucccucagaaucucuugcguagccucacaguucaccuuuggcagguacgggaugcacugggugcggcaggcuccuggaaagggccuugagugggucgcaaguauuagcuucgacggucgcgauaaauaucauuccccacuggugugggggcgauugacaauaucucgugacaacucgaagaauacuuuauuucugcaaaugaacucacuaagaacggaagauaccgcccucuacuauugugcgagggaccugcgggagagcgaaugcgaggagugggaaagugauuacuaugcuuucuggcgcaaacuuccguguguuaagcccagaggaguggccggcacacuggacaucuggggccaggggacuauggucuccgugucuagc

SEQ ID NO: 24788 - RNA, 435 nt, Artificial Sequence
  derived and/or modified sequence opt3 from anti-HIV_cap256-119-098715_VR-Chain
caggugcaacuggucgagagcggcgggggaguugugcagcccgguagaucccucaggcuuucuugcgccgcuucaggcuucaguuuuaacaaucacgggaugcauuggguacggcaggcaccuggaaagggccuggaauggguggccgguaucagcuucgcggggauuaaaaaguacuauggaaccuccgucaaaggccgcuuuacaauaucucgagacaacucgaagaauaacuuguucuuacagaugaacucacugcguguggaggauacugcucuauacuauugugccagagaccucagggaaauggagugcgaagaguggacgcuguacaauuauuacgauuuuggcagccgggggccauguguugacccgcgcggaguggucgguaguuucgauguguggggccaagggaccaugguaacaguuuccucu

SEQ ID NO: 24789 - RNA, 438 nt, Artificial Sequence
  derived and/or modified sequence opt3 from anti-HIV_cap256-119-098632_VR-Chain
cagaugcaacugguggagagcggcgggggagucguucagcccgguagaucccucacccuuucuugcgccgcuucacaguucaauuuugcaaauuacgacaugcacugggugaggcaggccccuggcaaggggcuggaauggguagcguucauccgguaugauggaaacaauaaauacuaugcugacagugugaagggccgcuuuacaauuagccgagauaacuccaaaucuacuuuguucuuacaaaugaacucgcugcguauagaggacacggcccuauacuuuugugucaaggaucagagagaagacgagugcgaagagugguggucagauuauuacgacuucgguagggagcucccaugucggaaaagccgcgggcugggacuugcaggcaucuuugauauguggggccaugggaccauggugacaguuaguucc

SEQ ID NO: 24790 - RNA, 432 nt, Artificial Sequence
  derived and/or modified sequence opt3 from anti-HIV_cap256-119-097199_VR-Chain
caggugcaacuggucgagagcggcgggggaguugugcagcccgguagaucccucaggcuuucuugcgccgcuucaggcuucgcauuuaguagcuacgccuuccacuggguacggcaggcgccugggaagggacuggaauggguggcuuauaucccauuucauggcaaccagcaauacuauggugacuccgucaaagggcgcuucaccauuucucgagauaauucgcgugacacauuguuuuuagagaugaacucacugagaccggaagauacugcccuauacuucugugcaagggaccagcgguauuacgagugcgaagagugggccagcgauuauuacgacuuuggacgcgagcagcccugucucgauccuagaggcgugguuggcauauucgaccugugggggcagggaacgauggugaccgucaguucc

SEQ ID NO: 24791 - RNA, 432 nt, Artificial Sequence
  derived and/or modified sequence opt3 from anti-HIV_cap256-119-096189_VR-Chain
caggugcaacuggucgagagcggcgggggaguugugcagcccgguagaucccucaggcuuucuugcgccgcuucaggcuucaaguuugggaguuucggaaugcacuggguacggcaggcaccuggcaaaggucuggaauggguggccgucaucagcuacgacggguccgauaaguauuacggaucuucggugcgcggccgauuuucaauuagccgugacaacaguaaaaauaccuuguauuuacagaugaacucccugagaacagaggauacugcgcuauacuucugugcuaaggaccucagggaauaugagugcgaagaguggacgucugauuacuaugacuuuggccggccacaaccguguauagauagccgcgggguugugggaauccuggacauuuggggucagggcaccauggucacaguguccuca

SEQ ID NO: 24792 - RNA, 432 nt, Artificial Sequence
  derived and/or modified sequence opt3 from anti-HIV_cap256-119-094581_VR-Chain
caggugcaccuggucgagagcggcgggggaguugugcaacccgguagaucccucaggcuuucuugcgccgcuucaggcuucaacuuuaguaauuacgcaauccauuggguacggcagaccccugggaagggacuggaaugggugacauugauuagcaacgacggcuccaauaaauauuacgccgauucuuuaaagggucgcuucacuauaucgcgagacaacagcaaaaauacgcuguaucuacagaugaacucacuccgugcggaggauaccgcucuguacuauugugccaaggaccuuagagaagaugagugcgaagagugguggagugacuacuaugauuuugggaaacagcugccauguaggaagucccggggagucgcaggcaucuucgacggcugggggcaaggaacaauggugacuguuucuagc

SEQ ID NO: 24793 - RNA, 432 nt, Artificial Sequence
  derived and/or modified sequence opt3 from anti-HIV_cap256-119-094200_VR-Chain
gaggugcagcuggucgaaagcggcgggggacucguucaacccgguggcucccuuagacugucuugcgccgcuucaggguucaucuuuaguagcuacgcauugcacugggugaggcaggccccuggaaagggcuuagaguggguagcguccauuucuuucgcugguaccaaaaaccauuauggaaauucggugaaggggcgguuuacaauaucacgcgacaacagcaaaaauacugucuaccugcagaugaacagucuacgagccgaagauacggcacucuauuacugugccaaggaccugcgugaguaugaaugcgaggaguggaccuccgauuacuaugacuucggcagaccacagccguguaucgauucuaggggcgugguugggauucuugacaucuggagccaaggaacaauggugacugucuccuca

SEQ ID NO: 24794 - RNA, 432 nt, Artificial Sequence
  derived and/or modified sequence opt3 from anti-HIV_cap256-119-094158_VR-Chain
cagaugcaacugguggagagcggcgggggagucguucagcccgguuccucucucacccuuucaugcgccgcuagucaguucacauuuagcaacuacggcaugcacugggugagacaggcaccugggaagggacuggaauggguagccuccaucucuaaugacggcacuaaaaaguaucauggugauucggugugggacagguucacgauuucacgggauaacagcaaaaauaccuuguuuuuacaaaugaacagucugcgcgcggaggacacagcucuauacuucugugucaaggaucagcgagaagacgagugcgaagaguggugguccgauuauuacgacuuugggaaacagcucccaugucguaagucuagaggaguggccggcauauucgauagcuggggccaggggacuaugguuaccguguccuca

SEQ ID NO: 24795 - RNA, 432 nt, Artificial Sequence
  derived and/or modified sequence opt3 from anti-HIV_cap256-119-092814_VR-Chain
caggugcaacuggucgaguucggcgggggaguugugcagcccgguggcagccucagacuuuccugcgccgcuucuggguuuuacuucaccgacuauggaaugcacuggguaaggcaggcaccuggcgaaggucugcaguggguggccuuuaucucauacgaugggaauacaaagacuacggcggacaguguccggggacgcuucaccuugagccgagauaauuccaaaaacacauuauaucugcaaaugaacucugugcguguugaggacacugcuagauacuuuugugccagggauaugcgggaauaugagugcgaacuaugggcaucggacuacuaugauuucggcaagccacagccgugugaggacccccgcggcguggucgggaccuuugauauguggggacucgguacacuggugaccguaucaagc

SEQ ID NO: 24796 - RNA, 432 nt, Artificial Sequence
  derived and/or modified sequence opt3 from anti-HIV_cap256-119-092808_VR-Chain
caggugcaacuggucgagagcggcgggggaguugugcagcccgguagaucccucaggcuuucuugcgccgcuucacaguucaguuuuggcaacuacgggaugcacuggguacggcaggcaccuggaaagggccuggaauggguggccgcgaucagcuucgcugguaccaaaacaaauuaugccgacuccgucaaggggcgcuuuacuauuucucgagauaacucgaaaaauacgguguacuugcaaaugaacucauuacgugcagaggacaccgcccuguauuucugugcuaaggauauaagagaauacgagugcgaauauuggacaagcgacuacuaugauuuuggaaggccacagccguguaucgacagucggggcguugugggcacuuucgaugucugggggcagggaaccauggugacaguauccucu

SEQ ID NO: 24797 - RNA, 432 nt, Artificial Sequence
  derived and/or modified sequence opt3 from anti-HIV_cap256-119-092573_VR-Chain
caggagcaacugguggaaagcggcgggggagucguucagcccgguaccucccucagacuuucuugcucagccaguggcuucacauuuagcaacuucgcuaugaauugggugaggcaggcaccugggaagggacuggaguggguauccuuuaucucuucggacggcaaaaacaagaauuacguggauucagucaaaggucgguucacuauuagccgcgacaacuauaagaauacguuguacuuacagaugaacagucugcgaaccgaagauacagccguguauuacugugcgaaagaccuagggggaacuaaggaugacgagugggcuaccgauuauuacgacugguccacagccuauccaguucaagauccgcgugcaguggccggcggcuuugaccucugggggcugggaaccauggucacugugucuagc

SEQ ID NO: 24798 - RNA, 432 nt, Artificial Sequence
  derived and/or modified sequence opt3 from anti-HIV_cap256-119-090815_VR-Chain
caggugcaacuggucgagagcggcgggggaguuguggaacccgguagaucccucaggcuuucuugcgccgcuucacaguucaguuuuagcuccuacggcaugcacuggguacggcaggcaccugggaagggacuggaguggguggccgcgaucucuuucgacggcgcugauaaauaucaugccgacaacgucuggggucgcuugucgauuucacgagauaauagcaagaguaccuuauaccugcagaugaacucccuacguccagaagacacagcaguguauuuuugugccaaagaucucagagaggacgaaugcgaggagagguggucugauuacuaugacuucgggaagcaacugccgugucggaaaagccgcggaguugcuggcauauuugauaauuggggccaggggacuauggugacggucuccgca

SEQ ID NO: 24799 - RNA, 438 nt, Artificial Sequence
  derived and/or modified sequence opt3 from anti-HIV_cap256-119-090368_VR-Chain
caggugcaacuggucgagagcggcgggggaguugugcagcccgguagaucccucaggcuuucuugcgccgcuucaggcuucgcauuuagucacuacgggaucuucuggguacggcaggccccuggaaagggccuggaauggguggcgagcauuuccaacgacgguaccaaaaaguaucaugcugagucugucugggaucgcuuuucgauaucaaaagacaauagcaagaacacauuguucuuacagaugaauagucugcgaguggaagauacugcccuauacuuuuguguuaaagaccaacgugaggaugaaugcgaggaguggugguccgacuauuacgauuucgggagagaacucccauguaggaagucucggggacugggccuugcaggcaucuuugacaugugggggcacggaacgauggugaccgucagcucc

SEQ ID NO: 24800 - RNA, 432 nt, Artificial Sequence
  derived and/or modified sequence opt3 from anti-HIV_cap256-119-089710_VR-Chain
caggugcaacuggucgagagcggcgggggaguugugcagcccgguagaucccucaggcuuucuugcaccgccucaggcuucggguuuaguaacuacgcuaugcacuggguacggcuggcaccuggaaagggcuuggaauggguggccagcaucuccuaugacggucgcgauuaccaucacgcgggggcugucuggggacgauucauuauaucucgugacaauucgaaaaacucauuacaucugcagaugaauagccuaagaccagaggauacagcccucuauuuuugugcaagggaccugcgggaaagugagugcgaagagugggaguccgauuacuauaacuucuggaagaaacuuccgugugugaagccccgcggcguugugggcauccuggacauuugggggcagggaacugucgugacgguaucuagc

SEQ ID NO: 24801 - RNA, 432 nt, Artificial Sequence
  derived and/or modified sequence opt3 from anti-HIV_cap256-119-088555_VR-Chain
caggugcaacuggucgagagcggcgggggaguugugcaggccgguagaucccucaggcuuucuugcgcugcaucacaguucaccuuuagucgguacggcaugcacuggguacgccaggcccccgggaagggacuggaauggguggcgggcaucagcuaugacggucgagauaaauaccaugcucacuucgucugggggcguuuuauuauauccagagacaacucuaagaauacauuguauuuacaaaugaacucgcugagggccgaggauacugcacuauacuauugugugcgggaccuccgcgaaucagagugcgaacugugggagagcgauuacuaugacuucggaaaaagacuuccuuguguuaagccaaggggcguggccggcacguuugaucugugggggcagggaaccauggucacagugaguucc

SEQ ID NO: 24802 - RNA, 432 nt, Artificial Sequence
  derived and/or modified sequence opt3 from anti-HIV_cap256-119-087962_VR-Chain
gagaugcagcugguggaaagcggcgggggacucgucaagcccgguagaucccuuaggcugucuugcgccgcuucaggcuucaccuuuaguagcuacgcaauccacuggguucggcaagccccugggaaaggauuggaguggguggcgguaauuuccuaugacggcucuaacaaguacuaugcugauucggugaaaggucgcuucacaauaucacgagacaauagcaagaacacugucuacuuacagaugaauagucugcguguggaagauacggcccuauauuacugugcaaaagaccucagagaguaugaaugcgaggaguggaccuccgauuacuacgacuuugggaagccacagccguguaucgauucuaggggaguugugggcauucuggacaucuggggccaggggauuauggucacagugagcucc

SEQ ID NO: 24803 - RNA, 432 nt, Artificial Sequence
  derived and/or modified sequence opt3 from anti-HIV_cap256-119-086903_VR-Chain
caggugcaccuggucgagagcggcgggggaguugugcaacccgguaagucccucagacuuucuugcgccgcuucacaguucaccuuugacagguacggcaugcauuggguacggcaggcaccugggaaaggacuggaauggguggccaguaucagcaacgauggcacagacaaguaucacgcggauaaugucuggggucgcuucacuauuucccgagacaacucuaaaaauacguuguacuuagagaugaacucgcugcguggggaagauaccgcucuauauuacugugccaaggacaugagagaggaugaaugcgaggagugguggucagacuauuacgauuuuggaaggccacagccguguauagacagccggggcgugguuggcacauuccaugugugggggcaaggaacuauggucaccgugaguucc

SEQ ID NO: 24804 - RNA, 432 nt, Artificial Sequence
  derived and/or modified sequence opt3 from anti-HIV_cap256-119-086804_VR-Chain
gaggugcagcuggucgaaagcggcgggggaguugugcaacccgguagaucccucaggcuuuucugcgccggcucuggguuuaccuucucaaguuacggacugcacuggguacggcaggcuccuggcaaggguuuggagugggugagcuuuaucuccuaugacgggucuacaacuaaauacgcagauucguuaaagggacgcuucacggucucacgagacaacagcaaaaauaccguguaucuggaaaugaacagucuacgugccgaggauacagcgcucuacuauugugcuaaggaccugagagaauacgagugcgaggaauggacuuccgauuauuacgacuuuggcaggccacagccguguauugauucucggggcguuguggggauacuugacaucuggggacaggguaccauggucacagugagcucc

SEQ ID NO: 24805 - RNA, 432 nt, Artificial Sequence
  derived and/or modified sequence opt3 from anti-HIV_cap256-119-085910_VR-Chain
gaggugcagcugcucgaaagcggcgggggacuuguccaacccgguggcucccugagauugucuugcgccgcuucaggguucaccuuuaguagcuacggaaugcacuggguuaggcaggcagccggcaaggguuuagaguggguggcguccaucucuuaugacgggcgggauuaccaucacgcuggagccguauggggccgcuucauuauaucgcgagacaacagcaaaaauucacugcaucuacagaugaacagucuccguccugaagauacagcacuguauuuuugugccagagaccuuagggaguccgaaugcgaggagugggaaucugauuacuauaauuucuggaagaaacugccaugugugaagccgcggggcgucguggggaucuuggacauuuggggacaggguacuguugugacggucagcucc

SEQ ID NO: 24806 - RNA, 432 nt, Artificial Sequence
  derived and/or modified sequence opt3 from anti-HIV_cap256-119-085772_VR-Chain
gaggugagacuggucgaaagcggcgggggacucauccagcccgguggcucccuuaggcugucuugcgccgcuucaggguugaccguuaguagcaaucacauguccugggugcggcaagcaccuggaaagggcuuagaguggguagccgugauuucuuacgacgguucgaauacauucuauggggauucagucaaaggacgcuuuacugugagccgagacauaaguaagaacacgcuguaccuacagaugaacucccuccguccagaagauaccgcgauguauuacugugcuagagaccagagguauuacgagugcgaagagugggccucugauuauuacgacuucggccgggagcagccgugucaagauccccgcggcguugugggggucuuugacauguggggacaggguacaauggugacuguaagcucc

SEQ ID NO: 24807 - RNA, 432 nt, Artificial Sequence
  derived and/or modified sequence opt3 from anti-HIV_cap256-119-084603_VR-Chain
caggugcaacuggucgagagcggcgggggaguugugcaguccgguagaucucucaggcuuucaugcgccgcuaguggcuuccccuuuagcgacuucgcaaugcacuggguacggcaggccccugggaagggacuggaauggguggcguccaucucuuuugucggcauuaaaacccauuacgcuaacucggugcgcggucgauucacaauaucacgugaucagagcaagaauacuuuguauuuacaaaugaacaguguuagaguggaggacacggggagguacuauugugcccgggauaugcgcgaauacgagugcgaacugugggcauccgacuauuacgauuuuggaaaaccacagccgugugaggaccccagaggcgucgugggcaccuucgauaugugggggcuaggaacacucguaacuguuucuagc

SEQ ID NO: 24808 - RNA, 432 nt, Artificial Sequence
  derived and/or modified sequence opt3 from anti-HIV_cap256-119-084276_VR-Chain
caggugcaacuggucgagagcggcgggggaguugugcagcccgguagaucccucaggcuuucuugcgccgcuucacgguucaccuuuaguagcuacgcaaugcacuggguacgccaggccccuggcaaggggcuggaauggguggcggucaucugguaugacggauccaacaaauacuaugcugauucugugcgaggccguuucucgguuucaacagacauuagcaagaauacuuuguacuuacagaugaacagucugagaccagccgauacggcacuauauuuuugugccagggaccuccgguacuaugagugcgaagagugggcuuccgauuacuacgacuucgguaaagaacaaccgugucuggauccccgcgggguggucggaauauuugaccuuuggggccagggcaccauggugacaguaucuagc

SEQ ID NO: 24809 - RNA, 432 nt, Artificial Sequence
  derived and/or modified sequence opt3 from anti-HIV_cap256-119-082288_VR-Chain
cagguguaccuggucgagagcggcgggggaguugugcaacccgguagaucccucaggcuuucuucagccgcuagucacuucagccuguccucuuauggcaugcauuggguacggcaggcaccugggaagggauuggaauggguggccggcaucucguuugcggguaccaaaacauacuauggggacucagucaagggacgcuucacugugagcacggauauuaguaaaaacaccuuauaccugcagguuaauucccuacgaccagaggacacagcuauguauuacugcgcccgugaucagagauauuacgaaugugaggaaugggcaucugacuacuaugauuuuggcaaggagcaaccgugccucgaccccaggggcguggucgggauauucgauaucuggggacaggguacuauggugaccguaagcucc

SEQ ID NO: 24810 - RNA, 432 nt, Artificial Sequence
  derived and/or modified sequence opt3 from anti-HIV_cap256-119-080383_VR-Chain
caggugcaacuggucgagagcggcgggggaguugugcagcccgguagaucccucaggaucucuugcgccgcuucacaguucaccuuuagucgguacggcaugcacuggguacgccaggcaccugggaagggacuugaauggguggccagcauuuccuaugacggcacagauaaauaccaugcgcgacuggucuggggucguuucacuauaucuagagacaacucgaagaauacguuguauuuacaaaugaacucacugagggcugaggauaccgcccuauacuauugugugcgggacgaacgcgagagcgaaugcgagcucugggagagugauuacuaugacuuugggaaaaagcugccauguguuaaaccgagaggagugacaggcucccuugauauguggggccaggggacucaggucaccgugucuagc

SEQ ID NO: 24811 - RNA, 438 nt, Artificial Sequence
  derived and/or modified sequence opt3 from anti-HIV_cap256-119-079333_VR-Chain
gaggugcagcuggucgaaagcggcgggagacucguucaacccggauccccucuuaggcugucuugcgccgcuucacaguucaacuuugcaaguuacgguaugcacugggugcggcaggccccaggcaagggguuggaguggguagcgagcaucuccaaugacggaaccaaaaaguaucaugcugaaucugugugggaucgcuucucgauuucaaaagacaacagcaagaauacauuauuucugcagaugaacagucuacgagucgaggauacugcccucuacuucugugugaaagaccaacgugaagaugagugcgaggaauggugguccgacuauuacgauuuuggcagagagcugccguguaggaagucucggggucuugggcuggcaggaauauucgacauguggggccacggcacgaugguuaccgugagcucc

SEQ ID NO: 24812 - RNA, 441 nt, Artificial Sequence
  derived and/or modified sequence opt3 from anti-HIV_cap256-119-078618_VR-Chain
cagaugcaacugguggagagcggcgggggagucguucagcccgguagaucccucacccuuucuugcgccgcuucacaguucaacuuugcaaguuacggcaugcacugggugaggcaggccccugggaagggacuggaauggguagcgagcaucuccaaugacggcacuaaaaaguaucaugcugagucugugugggaucgguucucgauuucaaaagacaacagcaagaauacauuguuuuuacaaaugaacagucugcgcgucgaagauacgacccuauacuucugugugaaagaccagcgagaggaugaaugcgaggaguggugguccgacuauuacgauuuuggucgugaacucccauguagaaagucuagggggcugggacuugccggcaauuucugcauauguggcgcagacgggacaaugguuacugugagcucc

SEQ ID NO: 24813 - RNA, 432 nt, Artificial Sequence
  derived and/or modified sequence opt3 from anti-HIV_cap256-119-077466_VR-Chain
caggugcaacuggucgagagcggcgggggaguugugcagcccgguuccccucucagaaucucuugcgccguaucacaguucaccuuuaguagguacggcaugcacugggugcggcaggcuccagggaagggacuugaaugggucgcaagcauuuccuucgacggccgcgauaaauaucauucuucgcugguguggggucgauugacaauaucacgugacaauagcaagaguacuuuauuucugcaaaugaacucccuaagagccgaggauacggcgcucuacuauugugcuagggaccugcgggaaucugagugcgaagagugggagagcgauuacuaugccuucuaccgcaaacuuccguguguuaagcccagagggguggcaggaacccuggacaucuggggccagggcacaauggucacuguguccuca

SEQ ID NO: 24814 - RNA, 423 nt, Artificial Sequence
  derived and/or modified sequence opt3 from anti-HIV_cap256-119-076284_VR-Chain
caggugcaacuggucgagagcggcgggggaguugugcagcccgguagaucccucaggcuuucuugcgccgcuucaaacaccuacgcaaugcacuggguacggcaggccccuggcaaggggcuggaauggauggcguugaucaguuaugagggaagcgacaaauacuauguggauuccgucaagggccgcuucacaauuucucgagacaauucgaaaucaacuuuauaccugcagaugaacagccuaagugcugaagauacggccguguauuuuugugcaaaggaccucggugggaauaaagaugacgaguggaccacagauuacuauuacgacugguccaaggcccguccaguucaagauccgagaguggucgcuggaacuuucgacauauggggccagggcaccauggugacaguaucuagc

SEQ ID NO: 24815 - RNA, 432 nt, Artificial Sequence
  derived and/or modified sequence opt3 from anti-HIV_cap256-119-074680_VR-Chain
gaggugcagcuggucgaaagcggcgggggacucguucaacccgguagaucccuuaggcugucuugcgccggcucaggguucaccuuuguggacuacgcuaugcacuggguacgccaggugccuggaaagggcuuggagugggucgguaguaucagcuaugauggguccgacaaauaccauacaaacucuguguggggacgguucauuguuucgcgagauaauucaaagaacacuuuauaucugcagaugaauagccuacguccagaagacacggcacucuacuauugugugagagauaggcgggagagugaaugcgaggagcgcugguccgacuacuaugauuuuggcaaacagcugccgugugucaagcccagaggcguggccgggauauucgacaucuggggacaagguaccaugguaacaguuucuagc

SEQ ID NO: 24816 - RNA, 432 nt, Artificial Sequence
  derived and/or modified sequence opt3 from anti-HIV_cap256-119-074081_VR-Chain
gaggugcagcuggucgaaagcggcgggggacucguucaacccgguggcucccuuagacugucuugcgugguaucaggggugaccgucaguagcaacuacauguccugggugaggcaggccccuggaaagggcuuggaguggguugcuucuaucucguaugacgguucagauaaauaccacgcagaccgggugugggggcgcuucacaauuagccgagauaauaguaagaacacuuuauaucugcagaugaacucccuacgugccgaagacacggcgcucuacuauugugucagagaugcuagggagucugaaugcgagcugugggagagcgacuacuauaauuuuggacggaaacuuccaugugugaagccgcgcggcguagccggcacccuggauauaugggggcagggaacaaugguuacuguguccuca

SEQ ID NO: 24817 - RNA, 432 nt, Artificial Sequence
  derived and/or modified sequence opt3 from anti-HIV_cap256-119-071704_VR-Chain
cagaugcaacugguggagagcggcgggggagucguucagcccgguggcucccucagacuuucuugcgccgugucacaguucaccuuuacaaguuacgggaugcacuggguaaggcaggcuccuggaaagggccuggaauggguggcaacuaucagcuccgacgguucuaaaaaguaucauggggauucggucuggggacgguugacgauuucacgcgacaacagcaaaaauaccuuauuccugcaaaugaacaaucuacgagccgaggauacagcgcucuacuuuugugugaaggaccagcgugaagaugagugcgaagagugguggagugacuauuacgauuucggcaaaaagcugccauguagaaaguccccgggccuugcugggauauuugacguuuggggacacgguacuauggugaccgucucuccc

SEQ ID NO: 24818 - RNA, 432 nt, Artificial Sequence
  derived and/or modified sequence opt3 from anti-HIV_cap256-119-071266_VR-Chain
caggugcaacuggucgagagcggcgggggaguugugcagcccggugaaucccucagacuuucuugcgccgcuucaggcuucaccuuuaguagcuucgggaugcacuggguaaggcaggcaccuggaaagggccuggaguggguggguuccaucucuuacgacgggucggauaaauaucauacaaauucagucuggggacgguuuauugugagccgcgacaauaguaagaacacuuuguacuuacagaugaacucccugcgaccagaagauacggcccuauauuacuguguucgugacagaagggagucugaaugcgaggagcgguggagcgauuauuacgacuucggcaaacaacucccgugugugaagccccgcggcgucgcggggauauuugauaucuggggacaggguaccauggugacaguauccuca

SEQ ID NO: 24819 - RNA, 432 nt, Artificial Sequence
  derived and/or modified sequence opt3 from anti-HIV_cap256-119-069667_VR-Chain
gaggugcagcuggucgaaagcggcgggggacucguucaacccgguagaucccuuaggcugucuugcgccgcuucaggcuucaguuuuaacaccuacgggaugcacugggugcggcaggcaccuggaaagggcuuggaguggguagccuucauccgcuaugacgguagcaauaaauacuaugcggauuccgugaaggggcgauuuacaauuucucgugacaacucgaaaaauacuuuauaccugcagauggauggacuaagaggcgaagacacggcucucuauuacugugccaaggaucugagggagcuugaaugcgaggagugggcaucagacuauuacgauuucggccggccacagccgugucuggacccccgcggggucagcggaauaaguaacguguggggucaaggcaccaugguuacaguguccucu

SEQ ID NO: 24820 - RNA, 432 nt, Artificial Sequence
  derived and/or modified sequence opt3 from anti-HIV_cap256-119-069591_VR-Chain
caggugcaacuggucgagagcggcgggggaguugugcagcccgguagaucccucaggcuuucuugcgccgcuucaggcuucaccuuuaguagcuacgcaaugcacuggguacggcaggccccugggaagggacuggaauggguggcgggcaucuccuaugacgguucugauaaauaccaugcugacaaggucugggggcgcuucacaauuucgcgagauaacagcaaaaauacuuuguauuuacagaugaacucacugcgugccgaggacacggcacuauacuauugugccaaggaucucagagaagacgagugcgaagagugguggagugauuacuaugacuuuggaaaaaggcugccaugucggaagucccgcggcguggcuggcguuuucgauaagugggggcaaggaaccauggugacagucucuagc

SEQ ID NO: 24821 - RNA, 432 nt, Artificial Sequence
  derived and/or modified sequence opt3 from anti-HIV_cap256-119-068691_VR-Chain
cagggccaccugguggccagcgggggaggugucguucccccuggcagaucccucacccuuucuugccuggcuucacaauucacauuuaguggguacggauuccauugggugaggcaggcaccaggcaaggguuuggaguggguagccagcaucuccuuugcggggacuaaaaagcacuauggaaacucugugaaaggccgguucacgauuucgcgcgacaauucaaagaacaccuuauaccuggaaaugaauagccuacgaccggaggauacagcucucuauuacugugccaaagaccguagagaauaugagugcgaagaguggaccagugauuacuaugacuuuggcaggccccagccuuguauagauucccgcggggucgugggaauccuggacauuuggggucggggcacuaugguuacagugucuagc

SEQ ID NO: 24822 - RNA, 432 nt, Artificial Sequence
  derived and/or modified sequence opt3 from anti-HIV_cap256-119-068488_VR-Chain
cagaugcaacugguggagagcggcgggggagucguucagcccgguaugucccucacccuuucuugcgccgcuucacaguucacauuuaguaacuacggcaugcacugggugagacaggcaccugggaagggacuggaauggguagccagcaucuccaaugacggcucuaaaaaguaucauggugauucggugaaagggagguucacuauuucacgggacaacagcaagaauacguuguacuuacaaauggauggacugcgcggcgaggacaccgcgcuauauuacugugcuaaagaucuccgagaacuggagugcgaagagugggccagugacuauuacgauuuuggccguccacagccgugucuugaccccagaggggucuccggaauaucuaacguguggggucagggcacaaugguuacugugagcucc

SEQ ID NO: 24823 - RNA, 432 nt, Artificial Sequence
  derived and/or modified sequence opt3 from anti-HIV_cap256-119-067536_VR-Chain
caggugcaacuggucgagagcggcgggggaguugugcagcccgguagaucccucaggaucucuugcgccucaagucaguucaccuuuagccgguacggcaugcacuggguacgccaggcuccugggaagggacuugaauggguggcauccauuucuuaugacggccgagauuaccaucacgccggugcggucugggggcguuucauaaucucgagagacaacagcaaaaauucacugcauuugcaaaugaacaguuuaaggccagaggauacagcucuguauuuuugugcccgggaccuacgcgaauccgagugcgaagagugggagucugauuacuaugcauucuacagaaagcucccgugugugaaacccaggggaguugccggcacucuggacauuuggggccaggggacgauggugaccgucagcucc

SEQ ID NO: 24824 - RNA, 432 nt, Artificial Sequence
  derived and/or modified sequence opt3 from anti-HIV_cap256-119-065852_VR-Chain
caggugcaccuggucgagagcggcgggggagccguucccuccgguagaucucucaggcuuucaugcguggcuaguggcuucaccuuugggguauacgacauccauugggugcggcaagcaccuggaaagggccuggaaugggucgccagcauuuccuaugauggucgcgacaaauaccacucuucguuggugugggggcgauuaacaauaucacgugauaauagcaagaguacucuguuccuacagaugaacucccucagagcggaggacacggcucuguauuacugugccagggaucuucgggaaucugagugcgaagaguggcagagcgacuauuacgcauuuuauaaaaagcugccauguguuaaaccgcgcggaguggccggcaccuuggauaucuggggccaggggacaauggucacuguguccuca

SEQ ID NO: 24825 - RNA, 432 nt, Artificial Sequence
  derived and/or modified sequence opt3 from anti-HIV_cap256-119-065457_VR-Chain
cugggcagacucguggccagcgggggaggugucguucccccuggcagguccccacggcuuucuugcguggcuucacaguucaccuuuaguggguguggacugcacuggguacgccaagcaccgggcaaggguuuggaguggguggccgcgaucagcuucgacgggacagauaaauaccauuccgacgaugucuggggacgauuuacuauuucucgugacaacucgaagaauacguuauaucugcagaugaacucacuaagacccgaagauaccgcucucuacuauugcgccaaagaccugcaggaggaugaaugugaggaaugguggagcgacuacuaugauuucggcaagcagcuuccuugcaggaaaagucggggcguggcagggauauuugacgauuggggacaagguacaaugguuacuguguccucu

SEQ ID NO: 24826 - RNA, 432 nt, Artificial Sequence
  derived and/or modified sequence opt3 from anti-HIV_cap256-119-064501_VR-Chain
caggugcaacuggucgagagcggcgggggaguugugcagcccgguagaucccucaggcuuucuugcgccgcuucaggcuucaccuuuaguagcuacgcaaugcacuggguacggcaggccccugggaagggacuggaauggguggcgggcaucuccuaugacggucgcgauaaauaccaugcucacucugucugggggcgauugucgauuucacgugacaacagcaagaauacauuauaucugcagaugaacagucuaagaacugaggauacggcccucuaccauugugugagggaccugcgggaauccgagugcgaacuuugggagucugauuauuacgacuucggcaaaaagcugccauguguuaaaccgcgcggaguggcaggcaccuuugauuugugggggcaaggaacaauggucacugugagcucc

SEQ ID NO: 24827 - RNA, 432 nt, Artificial Sequence
  derived and/or modified sequence opt3 from anti-HIV_cap256-119-063568_VR-Chain
caggugcaacccgucgagagcggcgggggaguuguguggccugguagaucccugaggcucucuugcaccacaucaggcuucacuuuuaguaacuacgccauccacuggguacggcaggcuccagggaagggacuucaguggguggcagucauuagcuaugacggcuccaauaaauucuacgccgauucugugaagggucgcuuuacgauaucgcgagacaacagcaaaaauacccuguauuugcagaugaacucauuacguccggaagauacagcgcuguacuauugugcuaaggaccuaagagaggaugaaugcgaggaaagguggagugacuacuaugauuucgggaaacaacuccccugucggaagucccgcggaguugccggcguguuugacaauuggggccaggggacuauggucaccgugucuagc

SEQ ID NO: 24828 - RNA, 435 nt, Artificial Sequence
  derived and/or modified sequence opt3 from anti-HIV_cap256-119-063103_VR-Chain
caggugcaacuggucgagagcggcgggggacucguucagcccgguaagucccuuagacugucuugcgccgcuucaggcuucaccuuuaguacauacgggaugcacugggugaggcaggcaccuggaaaaggcuuggaauggguagccuuaaucagcuaugacgguuccuacacuuauuacgcggauucugugaaggggcgguucacgauuucgcgcgacaacucaaaaagcacccuggaucuacagcucaauacacugcgaccagaggacacugcucuuuauuacugugcccgugaucugagagaaauggagugcgaagaguggaaguuguauaacuacuacgacuuuaggacccggggaccgugugucgauccccgcggcgugguuggcaguuucgacgugugggggcaaggaacagucgugaccguauccucu

SEQ ID NO: 24829 - RNA, 432 nt, Artificial Sequence
  derived and/or modified sequence opt3 from anti-HIV_cap256-119-061027_VR-Chain
caggugcaacuggucgagagcggcgggggaguugugcagcccgguagaucccucaggcuuucuugcucagccaguggcuucacccugagcuccuacgggauccacuggguacggcaggcuccuggaaagggcuuggaauggguggcagucaugucuaaugacgguucgaaucaguuuuauggggauucagugaaaggacgcuucacaauuagccgagacauaaguaagaacacuuuauaccugcaaaugaacucccuacguccagaggauacggccauguauuacugugcgagagaccagagguauuacgaaugcgaggaaugggcuucugauuauuacgacuuuggccgggagcagccgugucaggauccccgcggcguugugggggucuucgacauguggggacaagguaccauggugacaguaagcucc

SEQ ID NO: 24830 - RNA, 432 nt, Artificial Sequence
  derived and/or modified sequence opt3 from anti-HIV_cap256-119-058232_VR-Chain
caggugcaacuggucgagagcggcgggggaguugugcagcccgguaagucccucagacuuucuugcaaagccucacaguucaccuuuaauagguacggcaugcacuggguacggcaggcuccugggaagggacuggaauggguggcagccaucaguuucgacggcacagauaaauaucaugcggacaaggucuggggucgcuuuacuauuagccgagaugacuccaaaucuacguuguacuuacaaaugaacucgcugcgugcugaggauaccgcccuauauuacugugcaaaggaccucagagaagaugagugcgaagagugguggucagacuauuacgauuucgggaagcagcugccauguaggaaaagccggggaguggccggcauauuugacggcugggggcagggaacaaugguuacugugaguucc

SEQ ID NO: 24831 - RNA, 432 nt, Artificial Sequence
  derived and/or modified sequence opt3 from anti-HIV_cap256-119-057341_VR-Chain
caggugcaacuggucgagagcggcgggggaguugugcagcccgguagaucccucaggcuuucuugcgccgcuucacacuucagucugagcuccuacggcaugcauuggguacggcaggcaccugggaagggauuggaauggguggccggcgagucuuuugcggcuaccaacaaauauuacgccgacucggucaagggucgcuucaucgugucacgagauauuagcaaaaauacauuauaucuggaaguuaacagucuacgugcagaggacacugcccucuacuauugugcuagagaucagagguacuaugaaugcgaggagugggcauccgacuacuacgauuuugggcgggaacaaccaugucaggacccgcgcggaguggccggcauauucgauaucuggggccaggggacgauggucaccgugucuagc

SEQ ID NO: 24832 - RNA, 438 nt, Artificial Sequence
  derived and/or modified sequence opt3 from anti-HIV_cap256-119-056895_VR-Chain
cagaugcaacugguggagagcggcgggggagucguucagcccgguagaucccucaggcuuucuugcgccgcuucacaguucaccuuuggcaguuacgggaugcacugggugcggcagaucccuggaaagggccuggaauggguagcaacaauuagcuaugacgguacuaaaaaguaccaugccgauuccgugugggaccgcuucauaaucucucgagauaacucgaaaaauacguuguuuuuacaaaugaacucacugcguccagaggacaccgcgcuauauuucugugucaaggaucagagacaggacgaaugcgaggaaugguggagcgauuacuaugacuuugggagggagcucccgugucggaaaagucgcggacugggccuugcuggcauuuucgauaugugggggcacggaacaauggugacuguuuccucu

SEQ ID NO: 24833 - RNA, 432 nt, Artificial Sequence
  derived and/or modified sequence opt3 from anti-HIV_cap256-119-056402_VR-Chain
caggugaagcuggucgagagcggcgggggaguugugcaacccgguaaaucccucagacuuucuugcaccgccucacaguucacauuuaguaacuucggcaugcacuggguaaggcaggcuccugggaagggacuggaauggguggcaagcaucuccuuugucggcauuaaaaagcauuacgccaauucugugcggggucgcuucacuauaucgcgagaccagucaaagaacacguuguauuuacaaaugaauagcguucguguggaggauaccgcgagauacuuuugugcuagggacaugcgggaauaugagugcgaacugugggccagugauuacuaugacuucgggaaaccacagccgugugaggauccccgcggagucgugggcacauuugacauguggggccuagggacucucguaaccguuuccucu

SEQ ID NO: 24834 - RNA, 432 nt, Artificial Sequence
  derived and/or modified sequence opt3 from anti-HIV_cap256-119-056034_VR-Chain
caggugcaacuggucgagagcggcgggggaguugugcagcccgguagaucccucaggcuuucuugcgccgcuucaggcuucaccuuuaguagcuacgcaaugcacuggguacggcaggccccugggaagggacuggaauggguggcggcuaucuccuucgccggcacaaaaacucauuaugcagacucugucaagggucgcuuuacgauuucgcgagauaacagcaaaaaugccuuguacuuacagaugaacaaucugcgugcugaggacaccgcacuauauuacugugccaaggaucucagagaagacgagugcgaagagagguggucagauuauuacgacuucgggaaacaacugccaugucggaagagucgcggaguggcuggcguuuuugauaacuggggccaggggacaauggugacugucuccucu

SEQ ID NO: 24835 - RNA, 432 nt, Artificial Sequence
  derived and/or modified sequence opt3 from anti-HIV_cap256-119-055042_VR-Chain
caggugcaacuggucgagagcggcgggggaguugcccagcccgguagaucccucaggcuuucuugcgcugcaucaggcuucaccuuucggaguuacgggaugcacugggugcgccaggccccuggaaagggccuggaauggguagcggugaucagcuuggacgguuccaacaaauauuacgcugauucugucaaggggcgauucucgauuucacgugacaauagcaaaaacacauuauaucugcagaugaauagucuaagaccagaggauacugccguguacuauugugcaaaggaccucagggaagaugagugcgaggaacggugguccgacuacuaugauuuuggaaaacaacugccgugucgcaagucuagaggcguugccggcguguucgacaacugggggcagggaacgauggucaccgugagcucc

SEQ ID NO: 24836 - RNA, 438 nt, Artificial Sequence
  derived and/or modified sequence opt3 from anti-HIV_cap256-119-054776_VR-Chain
caggugcaacugauggagagcggcgggggagucguucagcccgguagaucccucaggcuuucuugcaccgccucaggcuucacauuuaguagcuacuccaugcacugggugcggcaggcuccugggaagggacuggaauggguagcaaucauuucuuaugacgagucgaacaaauacuaugccgauucagugcagggccgcuucacuauaagccgagacaauaguaagaacacguuguuuuuacaaauguccucucugcgugcggaagauaccgcucuauacuucugugucagagaccauagggaggaugaaugcgaggagugguggagcgacuauuacgauuuuggucgggaacucccaugucgcaaauucagagggcugggacuugccggcaucuuugacauuuggggccacgggacaauggugacuguuuccuca

SEQ ID NO: 24837 - RNA, 432 nt, Artificial Sequence
  derived and/or modified sequence opt3 from anti-HIV_cap256-119-054539_VR-Chain
cagaugcaacugguggagagcggcgggggagucguucagcccgguggcucccucagacuuucuugcgccgcuucacaguucaccuuugggaguuacgcaaugcacugggugaggcagccuccaggagaacggccggaguggguagccacaaucagcuucgacggcacuaagaaauaucaugcggauuccguguggggucgcuuuacgauuucucgagacaacucgaagaauacccuguucuugcaaaugaacucauuacgucccgaagauacagcucuguacuuuugugucaaagaccagagagaggaugccugcgaagagugguggagcgacuauuacgauuucgggaagaauugucuagcagagaguccuggagccuggcucgaauuuuucuauguguggggccacggcacuaugguuaccguguccucu

SEQ ID NO: 24838 - RNA, 432 nt, Artificial Sequence
  derived and/or modified sequence opt3 from anti-HIV_cap256-119-054112_VR-Chain
caggugcaacuggucgagagcggcgggggaguugugcaggccgguagaucccucaggcuuucuugcgcugcaucaggcuucaccuuuaguacauacgccaugcacuggguacggcaggcgcccgggaagggacuggaauggguggcugucaucagcuaugacggcuccaacaaauacuaugccgauucugugcgcggucgauucacuauuucgcgugacaauucaaagaacacguuguacuuacagaugaauagccugagagcagaggauaccgcccuauauuacugugcuaaagacaugagggaauaugagugcgaagaguggacaagugauuacuacgacuuugggcggccucaaccauguauagauucccgcggaguugugggcacuuuccaugucuggggccaggggaccauggugacaguaucuagc

SEQ ID NO: 24839 - RNA, 432 nt, Artificial Sequence
  derived and/or modified sequence opt3 from anti-HIV_cap256-119-053339_VR-Chain
caggugcaccuggucgagagcggcgggggaguugugcaacccgguagaucccucaggcuuucuugcgccgcuucacauuucagucugagcuccuacggcaugcacuggguacggcaggcaccugggaagggauuggaaugggugaccggcaucucuuuugccgguacaaaaacuuauuacggggacucgguccgcggacgauucacggugucacgugauauuagcaagaacaccuuacugcuacagaugaauagucucagaccagacgauacagcgauauauuacugugcuagggaccagcgguauuacgagugcgaagagugggccuccgauuauuacgacuuuggcaaagaacaaccgugucuggauccccgcggcguuguggggaucuucgaccuuuggggacaggguacuauggucaccgugucuagc

SEQ ID NO: 24840 - RNA, 432 nt, Artificial Sequence
  derived and/or modified sequence opt3 from anti-HIV_cap256-119-052404_VR-Chain
cagaugcaacugguggagagcggcgggggagucguucagcccgguagaucccucacccuuucuugcaucgccucacaguucaacuuugcuaguuacggcaugcacugggugaggcaggcaccugggaagggacuggaauggguagccagcauuucccaugacggcacuaaaaaguaucacgcggagucuguguggggucgguucacaauaucgaaagauaauucaaagaacacguuguuuuuacaaaugaauagccugcgcgucgaagacaccgcucuauacuucugugugaaagaucagcgagaggacgaaugcgaggagugguggagugauuauuacgacuuugggaagcagcucccaugucguaaguccagaggaguugccggcguguucgauaacuggggccaggggacaauggucacugugucuagc

SEQ ID NO: 24841 - RNA, 432 nt, Artificial Sequence
  derived and/or modified sequence opt3 from anti-HIV_cap256-119-051123_VR-Chain
caggugcaacuggucgagagcggcgggggaguugugcagcccgguggcucccucagacuuucuugcguagggucacaguucauccuguacagguauggaaugcacugggugcggcaggccccuggcaaggguuuggaaugggucgcugcagugaguuuugacgggaccgauaaauaccaugccgacgauguuuggggacgcuucacaauuagccgagacaacuccaagaauauauuauaucugcaaaugaacucucuacgugcggaggauacugcucucuacuauugugccaaagaccugagagaagaugagugcgaagagugguggucggacuacuaugaucuuggcaagcagcugccauguaggaaaucacggggcguggcaggggucuuugacaaguggggauuggguacgauggugaccguaagcagu

SEQ ID NO: 24842 - RNA, 438 nt, Artificial Sequence
  derived and/or modified sequence opt3 from anti-HIV_cap256-119-051077_VR-Chain
gaggugcagcuggucgaaagcggcgggggaguugugcaauccgguagaucucucaggcuuucaugcgccgcuagucacuucaccuuuagccgguacggcaugcauuggguacgccaggcacccgggaagggacuggaguggguggccuccaucucuuaugacggccgagauuucuaccacgcgcguucggucugggguagauuuacaauuucaagggacaacagcaaaaauacuuuguucuuacagaugaacagucugcggauagaagauacggcucuauauuuuugugugaaggaccagcgcgaggaugaaugcgaggaguggugguccgacuacuaugauuucgggagagaacucccuuguaggaaaucucggggacugggccuugccggcaucuuugacaugugggggcauggaaccaugguuacagugagcucc

SEQ ID NO: 24843 - RNA, 432 nt, Artificial Sequence
  derived and/or modified sequence opt3 from anti-HIV_cap256-119-050442_VR-Chain
caggcccaaaugguggagagcggcgggggagucguucagcccgguagaucccugaggcucucuugcgcugcaucaggcuucaguuuuagcuacuucgccaugcacugggugcggcaggcgccugggaaaggacuugaauggguagcuggcaucuccuuugccgcaaccaaaacauauuacggugggucugugaagggacgcuucacugucucgcgagacauuucaaagaacacgcuguauuugcagaugaauagcuuacguccagaggauaccgccauguacuauugugcuagagaccaaagguacuaugaaugcgaggaaugggcaagugauuacuacgacuuuggccgggagcagccgugucaggauccccgcggcgugguugggguguucgacauguggggacaggguacaauggucacuguguccucu

SEQ ID NO: 24844 - RNA, 432 nt, Artificial Sequence
  derived and/or modified sequence opt3 from anti-HIV_cap256-119-049433_VR-Chain
caggugcaacuggucgagagcggcgggggaguugugcagcccgguagaucccucaggguaucuugccgggccucaggcuucgcuuuuaguagcuacgcaaugcacugggugcgccaggccccugucaaggggcuugaauggguggcgcugaccuccucugacggagcugauaaauaucaugccgacgauguuuggggccgauucacaaucucgcgugacaacucaaagaauacuuuguacuuacagaugaacagccugagaccagaggauacggcacuauauuacugugccaaagaccucagggaagaugagugcgaggaacgguggagugacuauuacgauuuugguaagcaacugccgugucgcaaauccagagggguggcuggagucuucgacaauuggggccagggcaccauggugacaguaucuagc

SEQ ID NO: 24845 - RNA, 432 nt, Artificial Sequence
  derived and/or modified sequence opt3 from anti-HIV_cap256-119-047532_VR-Chain
cugggccggcucguggccagcgggggaggugucguucccccuggcaggucccuuacccugucuugcguggcuucacaguucacauuuaguggguguggauugcacuggguacggcaagcaccaggcaaggguuuagaguggguggccagcaucuccuucgcggggacuaaaaagcauuacacgaacucuguccgcggacgauuuaccauuucgcgugacaauucaaagaacacaguguaucugcagaugaauagccuaagagcugaagauacugcccucuacuauugcgcaaaagacaugggcgaguacgaaugugaggaauggaccagugauuauuacgacuucggcaggccgcagcccugcauagauuccagagggguugugggaauccuggacauuuggggucagggcacaauggucaccgugucuagc

SEQ ID NO: 24846 - RNA, 432 nt, Artificial Sequence
  derived and/or modified sequence opt3 from anti-HIV_cap256-119-047489_VR-Chain
caggugcaccuggucgagagcggcgggggaguugugcaacccgguaagucccucagacuuucuugcgccgcuucacaguucaccuuuaacagguucggcaugcauuggguacggcaggcaccugggaaaggacuggaauggguggccggcaucaguuacgacgguagcgauaaguaucacgcggacaaagucugggggcgcuuuacaauuucccgagauaauucuaagaacacuuuguacuuacagaugaauagccugcgugcugaggacacggcccuauauuacugugcaaaagaucucagagaagacgagugcgaagagugguggucagauuauuacgacuucggaaagaggcugccaugucggaagucgcgcggcguggccggcguuuuugauaaaugggggcaaggaaccauggugacagucaguucc

SEQ ID NO: 24847 - RNA, 438 nt, Artificial Sequence
  derived and/or modified sequence opt3 from anti-HIV_cap256-119-046020_VR-Chain
gaggugcagcugcuccaaagcggcgggggacuuguccagcccgguggcucccugagauugucuugcgccgcuucaggguucaguuuuagcuccuacgcaaugucuuggaucaggcaggccccuggaaagggcuuagaauggguugcgucgauuucacacgacgguaccaaaaaguaucaugcugagagcgugugggggcgguucacaauaaguaaagauaacuccaagaauacucuguuucuacagaugaacucucuccgcguagaagacacggcccuguacuucugugugaaagaucaacgagaggacgaaugcgaggagugguggagcgauuauuacgacuuuggacgugaacuuccauguagaaaguccaggggccugggcuuggcagggaucuucgauauguggggacacgguaccauggucacagugucaagu

SEQ ID NO: 24848 - RNA, 432 nt, Artificial Sequence
  derived and/or modified sequence opt3 from anti-HIV_cap256-119-044746_VR-Chain
caggugcaacuggucgagagcggcgggggaguugugcagcccgguagaucccucaggcuuucuugcgccgcuucaggcuucaccuuuaguagcuacgcaaugcacuggguacggcaggccccugggaagggacuggaauggguggcggucaucuccuaugacggcucuaacaaauacuaugcugauucggugaagggucgcuucacaauuucacgagacaauagcaaaaacacuguuuacuuggagaugaauaguuuacgugccgaagauacggcacuguauuacugugccaaggaccuaagagaguaugaaugcgaggaguggaccuccgauuacuacgacuuugggaggccacagccguguauagauucucggggaguggucggcauccucgacauuuggggccaagggacaauggugacuguaagcucc

SEQ ID NO: 24849 - RNA, 432 nt, Artificial Sequence
  derived and/or modified sequence opt3 from anti-HIV_cap256-119-044740_VR-Chain
cagaugcaccugguggagagcggcgggggagucguucaacccgguaugucccucagacuuucuugcgccgcuucacaguucaacuuuggcaguuucgggaugcauugggugaggcaggcaccuggaaagggccuggaauggguagccaccaucagcuacgacgguacuaaaaaguaucacuccgauucugugugggggcgguugucgauuucacgcgacaauagcaaaaacacauuauuucugcagaugaauagucuacgaacggaggauaccgcgcucuacuucuguguccgugaccaaagagaagaugacugcgaggaauggugguccgauuauuacgacuuuggaaagaaacugccauguaggaagucucggggccuugcuggcauauucgauaucugggggcauggaacaauggugacuguuagcucc

SEQ ID NO: 24850 - RNA, 432 nt, Artificial Sequence
  derived and/or modified sequence opt3 from anti-HIV_cap256-119-043790_VR-Chain
cugcuccagcuuguggagagcggcgggggagucguucaacccgguaacucccugagauugucuugcgccgcugcaggcuucaccuuuucagacuacaguuuacacugggugaggcaggccccugggaagggacuggaauggguagcgaugaucagcgaugacggcaaucuagauuucuaugcugccuccgugaaaggucgguuuacaauuucucgcgacaacucgauaaauacugucuaccuccagaugaacucacugcgagcagaggauacggcccuuuauuacugugcuaaggaccugcgugaauaugagugcgaagaguggaccagcgauuacuaugacuucgggagaccacagccguguaucgauaguaggggagugguuggcauuuuggacaucuggucccaaggcacaauggugacugucucuagc

SEQ ID NO: 24851 - RNA, 432 nt, Artificial Sequence
  derived and/or modified sequence opt3 from anti-HIV_cap256-119-042880_VR-Chain
gaggugagacuggucgaaagcggcgggggacucguucagcccgguggcucccuuaggcugucuugcgccgcuucaggguucaccuugagugacuacuauaugagcuggauccggcaagcaccuggaaagggcuuagaguggguggccgcgauuuccuuugcugguacuaaaaagcacuacgggaacucuguaaaaggacgcuucacaauaucgcgagauaauucaaagaacacgcuguaucuagaaaugaauagccuccguguggaggacaccgcccuguacuauugugcaaaagaucuuagagaauacgagugcgaggaauggacaagugacuauuacgauuuuggcaggccacagccguguaucgacucccggggcgucguggggauucuggauaucuggggacaggguacuaugguuaccgugucuagc

SEQ ID NO: 24852 - RNA, 432 nt, Artificial Sequence
  derived and/or modified sequence opt3 from anti-HIV_cap256-119-042606_VR-Chain
cagaugcaacugguggagagcggcgggggagucguucagcccgguagaucccucaggcuuucuugcgccgcuucacaguucaccuuuggcaguuacgggaugcacugggugcggcagaucccuggaaagggccuggaauggguaacagguauuagcuucgcagccacuaaaacguauuacggggacuccgugcgcggacgauuuaccgucucucgugauauaucgaagaauacauuguauuuacaaaugaacucacugagaccagaggacacugcgauguacuauugugcuagggaucagcgguacuaugaaugcgaggaaugggccagcgacuacuacgauuucggccgcgagcagccgugucaggaccccagaggcgugguugggauccuagaucucuggggacaagguaccauggugacagucaguucc

SEQ ID NO: 24853 - RNA, 432 nt, Artificial Sequence
  derived and/or modified sequence opt3 from anti-HIV_cap256-119-042444_VR-Chain
caggugcaacuggucgagagcggcggggacguugugcaccccggagguucccucagacuuucuugcgccgcuucaggcuucaccuuuaguagcuacgggauccauuggguaaggcaggcaccuggaaagggccuggaauggguggccgcgauuuccuaugaugguucugacaaauaccacacaaacucggucugggggcgguucacugugucacgcgauaauagcaagaacacgguuuauuugcagaugaauaguuuacgagcugaggacaccgcccuguacuuuugugugcgugauagaagggaauccgagugcgaacuaugggagucugacuauuacgauuucggaaaacggcucccaugugucaagccgcgcggcguggcaggcguauuugacauaugggggcagggaacaaugguuacugugagcucc

SEQ ID NO: 24854 - RNA, 432 nt, Artificial Sequence
  derived and/or modified sequence opt3 from anti-HIV_cap256-119-040328_VR-Chain
caggugcaacuggucgagagcggcgggggaguugugcagcccgguggcucccucagacuuucuugcgccgcuucaggguucaccuuuaguagcuacuccaugaacuggguaaggcaggcaccuggaaagggccuggaauggguggccucuaucucguucgcggguacaaaacagcacuauggaaauucagucaaggggcgguuuacuauuagccgcgacaacaguaaaaauacgguguacuugcaaaugaacuccuuacgacuggaggauaccgcucuauauuacugugccaaggaccuccgugaauaugagugcgaagaguggacaucugauuacuaugacuucggcagaccacagccguguauagauagcaggggcguuguggggauccuggacauuuggggacaggguacuauggucaccguguccuca

SEQ ID NO: 24855 - RNA, 432 nt, Artificial Sequence
  derived and/or modified sequence opt3 from anti-HIV_cap256-119-040164_VR-Chain
cagaugcaccugguggagagcggcgggggagucguucaacccgguaugucccucagacuuucuugcgccgcuucacaguucaacuuuggcaguuucgggaugcauugggugaggcaggcaccuggaaagggccuggaauggguagccaccaucagcuacgacgguacuaaaaaguaucacuccgauucugugugggggcgguuuucgauuucacgcgacaauagcaaaaacacauuguacuuacagaugaauagucugcgaacggaggauaccgcgcuauauuucugugcuaaggaccuccgugaauacgagugcgaagaguggacauccgauuauuacgacuuuggaagaccacaaccguguauagauucuaggggcgucgugggcauccuggacauuugggggcagggaacuaugguuaccgugagcucc

SEQ ID NO: 24856 - RNA, 432 nt, Artificial Sequence
  derived and/or modified sequence opt3 from anti-HIV_cap256-119-039130_VR-Chain
gaggaacagcugguggagagcggcgggggacucguccaacccgguagaucccuuaggcugucuugcaccggcucaggguuccgguuuggagacuacgccaugaacuggguucgccaggcuccuggcaaggguuuggaaugggugacauucaucaguuaugaugggagcaauaaacacuacgcagacuccguaaagggacgauuuacugugucucgugauaacucgaaaaauacguuacaucugcagaugaacucacuaagaccagaggacaccgcccucuauuucugugcgagggaucugcgggaaagcgagugcgaggaaugggagaguuacuauuacgacuuuggcaagaaaggcccgugugucaagccccgcggggugguuggagugcuugauauuuggggucagggcacacuggucacuguguccucu

SEQ ID NO: 24857 - RNA, 432 nt, Artificial Sequence
  derived and/or modified sequence opt3 from anti-HIV_cap256-119-038138_VR-Chain
caggugcaacuggucgagagcggcgggggaguugugcagaccgguaggucccucaggcuuucuugcacaggcucacaguucacuuuugggcgguacggaauguauuggguacgccaggcccccggcaagggucuggaauggguggcuaguaucagcuacgacgggcgagauuucuaucacgcacguuccgucuggggaagauuuacgauuucuagggacaacucgaaaaauaccuugcauuuacaaaugaacucacugcggccugaggauacagcccuauacuucugugcgcgcgaccucagagaaagcgagugcgaagagugggagaguuauuacuaugauuuuggcaagaaaggcccaugugugaagccgagagggguugugggaguccuggacauauggggucagggcacucuugugaccguauccucu

SEQ ID NO: 24858 - RNA, 432 nt, Artificial Sequence
  derived and/or modified sequence opt3 from anti-HIV_cap256-119-037868_VR-Chain
caggugcaacuggucgagagcggcgggggaguugugcagcccgguagaucccucaggcuuucuugcgccgcuucacaguucaccuuuaguaaguacggcaugcacuggguacggcaggcaccugggaaaggacugcaauggguggccggcaucagcuaugacgguuccgauaaguaccaugcgcacuucgucugggggcgcuuuucuauuucgcgagacaacagcaaaaaugcuuuguauuuacagaugaacucacugcguacagaagauacugcccuauacuucugugugagagaccucagggagagugaaugcgaggaauggaaguccgauuauuacgacuuuggacggaaaggcccaugucugaagccgcgcggcguugcagggucuuucgauauauggggacaggguacgguggucaccgugagcucc

SEQ ID NO: 24859 - RNA, 432 nt, Artificial Sequence
  derived and/or modified sequence opt3 from anti-HIV_cap256-119-037102_VR-Chain
caggugaagcuggucgagagcggcgggggaguugugcaacccgguaaaucccucagacuuucuugcaccgccucacaguucacauuuaguaauuucggcaugcacuggguaaggcaggcuccugggaagggacuggaauggguggcaagcaucuccuuugucggcauuaaaaagcauuacgccaauuucgugcggggucgcuuuacuauaucucgagaccagucgaaaaacacguuguauuuacaaaugaacucaguucguguggaggauaccgcgagauacuauugugcuagggacaugcgggaauacgagugcgaacugugggccagcgauuauuacgacuucgggaagccacagccgugugaggauccccgcggagucgugggcacauuugacauguggggccuagggacucucguaaccguuaguucc

SEQ ID NO: 24860 - RNA, 438 nt, Artificial Sequence
  derived and/or modified sequence opt3 from anti-HIV_cap256-119-036683_VR-Chain
ggcgugcagcuggucgagagcgggggagccguugugagacccgguggcucccucacccuuucuugcgcugcaucacaauucauccugaguagcuacgggaugcacuggguaaggcaggccccuggaaagggcuuggaauggguggcguccauuucuaaugacgguacuaaaaaguaucaugcugagucggucugggaucgguuuucaauaagcaaagacaauaguaagaacacauuauuccugcagaugaacucccuacgcguggaagauacggcccucuacuuuuguguuaaagaccagcgagaggaugaaugcgaggagugguggucugacuauuacgauuucgggcgugaacugccauguagaaagagcaggggacuuggccuggcaggcaucuuugacaugugggggcacggaaccauggugacagucuccuca

SEQ ID NO: 24861 - RNA, 432 nt, Artificial Sequence
  derived and/or modified sequence opt3 from anti-HIV_cap256-119-036495_VR-Chain
caggugcaacuggucgagagcggcgggggaguugugcagcccgguagaucccucaggcuuucuugcgccgcuucaggcuucaguuuuagcuccuacgggaugcacuggguacggcaggcaccuggaaagggccuggaauggguggccucuaucucguucgucgguauuaaaacccauuaugcgaacucagugcgcgggcgauuuacaauaagccgugaccagaguaagaauacuuuguacuuacaaaugaacuccguuagaaucgaggauacggcuagguauuucugugcccgggacaugcgcgaauacgagugcgaacugugggcaucugauuauuacgacuuuggaaaaccacagccgugugaggaucccagaggcguggucggcaccuucgacaugugggggcuaggaacacucgugacuguaagcucc

SEQ ID NO: 24862 - RNA, 438 nt, Artificial Sequence
  derived and/or modified sequence opt3 from anti-HIV_cap256-119-035375_VR-Chain
gaggugcagcuggucgaaagcggcgggggacucguucaacccgguagaucccuuaggcugucuugcgccgcuucaggcuucaccuuggaggacuacgggaugcacugggugcggcaggcaccuggaaagggcuuagaauggguagccaguaucagcaacgaugguacuaaaaaguaucaugcggaguccgugugggaccgcuuuucuauuucgaaagauaauucaaagaacacacuguuccuacagaugaauagccuccgagucgaagacacggcucuguacuuuugugugaaagaucagcgugaggacgagugcgaagagugguggagugauuauuacgacuucgggagagaacuuccauguaggaagucccggggacugggcuuggccggcauauuugauaugugggggcacggaaccaugguuacagugucuagc

SEQ ID NO: 24863 - RNA, 438 nt, Artificial Sequence
  derived and/or modified sequence opt3 from anti-HIV_cap256-119-035165_VR-Chain
caggugcaccuggucgagagcggcgggggaguuggucaacccgccagaucccucaggcuuucuugcgcugcaucaggcuucauccugaguagcuacggguugcauugggugcggcaggccccuggaaagggcuuagaauggguagcgcugauuuccuaugacgguaacaaugaguacuaugcugaaucugugugggggcgcuuuaccauaucgaaagauaacucaaagaauacacuauuccuccagaugaacagccugcgagucgaggacacugcccuuuacuuuugugugaaagaucagcgugaagacgagugcgaggaaugguggagugauuauuacgacuucggaagagagcugccauguaggaagucccggggcuugggccucgcagggaucuuugauauguggggacacgguacgaugguuaccgugucuagc

SEQ ID NO: 24864 - RNA, 432 nt, Artificial Sequence
  derived and/or modified sequence opt3 from anti-HIV_cap256-119-035109_VR-Chain
caggugcaacuggucgagagcggcgggggaguugugcagcccgguagaucccucaggcuuucuugcgccaccgcuggcuucacauuuucaaguuacgcaaugcacuggguacggcaggccccugggaagggacuggaauggguggcgagcaucuccuaugacggcucugauaaauaccaugcugacuuggucuggggucgcuucacuauuucgcgagauaacucaaagaauacguuauaucugcagaugaacagccuacgugccgaggacaccgcacucuacuauugugugagagaugccagggaaagugagugcgaacugugggaguccgacuacuauaauuuugggcggaaacuuccauguguuaagccgcgcggaguggcuggcacacuggauauauggggccaagggacuauggucaccgugucuagc

SEQ ID NO: 24865 - RNA, 339 nt, Artificial Sequence
  derived and/or modified sequence opt3 from anti-HIV_cap256-119-033789_VR-Chain
cagguguaccuggucgagagcggcgggggaguugugcaacccgguagaucccucaggcuuucuugcgccgcuucacacuucagucugagcuccuauggcaugcauuggguacggcaggcaccugacaucucuaagaacaccuuguacuuacaggucaauucgcugcgcccagaagauacagccauguauuacugugcgcgagaccagcguuauuacgagugcgaagagugggcuucagauuauuacgacuuugggaaagaacaaccgugucuagaucccagaggaguggugggcauuuucgacauauggggucaggggacuaugguuacggugagcagu

SEQ ID NO: 24866 - RNA, 432 nt, Artificial Sequence
  derived and/or modified sequence opt3 from anti-HIV_cap256-119-033641_VR-Chain
caggugcaacuggucgagagcggcgggggaguugugcagaccgguagaucccucaggcuuucuugcacaggcucacaguucacuuuugggcgguacggaauguauuggguacgccaggcccccggcaagggucuggaauggguggcugcaaucaguuacgacgggagcgauaaauaucacacgaacuccgucuggggacgauucaccgugucucgugacaauucgaagaacacaguuuacuugcaaaugaauagcuuaagagccgaggauacugcgcuguauuuuugugugagggaccggcgcgaaucagagugcgaacuaugggagagugauuacuaugacuucggcaaaagacucccuugugucaagccaaggggcguggcugggguauuugauauuuggggacaggguaccaugguuacaguguccucu

SEQ ID NO: 24867 - RNA, 432 nt, Artificial Sequence
  derived and/or modified sequence opt3 from anti-HIV_cap256-119-032113_VR-Chain
caggugcaacuggucgagagcggcgggggaguugugcagcccgguagaccucucaggcuuuccugcguaggcucuggguucucauuuaucaccagugccaugcacugggugcggcaggcuccagacaagggacuggaaugggucgcaauuauaagcgauggcgguaacaaucgccauuacgccgacuccgugaaagggcgauucacaaucucucgugauaacucgaagaauacuguguuuuuggagguuaacaauuuaagaccggaagacacggcgauguauuacugugcuagggaucagcgguauuacgagugcgaagagugggccucagacuauuacgauuucggacgcgagcaacccugucaggacccuagaggcgucgugggcguauuugauaugugggggcagggaaccaugguuacagugagcagu

SEQ ID NO: 24868 - RNA, 432 nt, Artificial Sequence
  derived and/or modified sequence opt3 from anti-HIV_cap256-119-031739_VR-Chain
caggugcaacuggucgagagcggcgggggaguugugcagcccgguagaucccucaggaucucuugcgccgcuucacaguucaccuuuaaucgguacggcaugcacuggguacgccaggcaccugggaagggacuugaauggguggccaguauuagcuaugacggcuccgauaaauaccaugcgggucuggucugggggcgauucauaaucucucgugacaauucgaagaacacauuguauuuacaaaugaacucacugagagcugaggauacugcccuauacuauugugugagggacgaacgggagagcgaaugcgagcucugggagagugauuacuaugacuuuggcaaaaagcugccauguguuaaaccgcgcggaguggcaggcacgcuugauauuugggggcagggaaccagagucacaguguccucu

SEQ ID NO: 24869 - RNA, 432 nt, Artificial Sequence
  derived and/or modified sequence opt3 from anti-HIV_cap256-119-030932_VR-Chain
gaggugcagcugcucgaaagcggcgggggagucguucaacccgguagaucccuuaggcugucuugcgccgcuucaggcuucgcauuuagucacuacgggaucuucugggugcggcaggccccuggaaagggcuuggaguggguaaccgugauuagcggugacggguccacacagugguaugcggauucuguccagggacgcuuuacuauaucgcgagacucaagcaaaaacacguuauaccugcaaauggauggccuacguggcgaagacaccgcucucuauuacugugccaaggaucugagagagcuugaaugcgaggagugggcaagugacuauuacgauuucgggaggccacagccgugucuggacccccggggaguguccgguaucucuaauguuuggggccaggggacaauggugacugucagcucc

SEQ ID NO: 24870 - RNA, 438 nt, Artificial Sequence
  derived and/or modified sequence opt3 from anti-HIV_cap256-119-030740_VR-Chain
caggugcaacuggucgaguucggcgggggaguugugcagaccgguagaagccucaggcuuuccugcgccgcuucuggcuuuacauucucagacuacgggaugcacuggguacggcaggcacccggaaagggccuggaauggguggccaguaucagcaacgaugguuccaaaaaguaucauggggacucugucugggcgcgcuuuauuauaucgcgagauaauagcaaaaacacuuuguucuuacagaugucaagucugcgugcugaggacacggcccuauacuuuugugugagagaucacagggaagacgagugcgaagaguggugguccgauuauuacgacuucggacgggagcucccuugucgcaaguuuagaggccugggccuugcagggaucuucgauauuuggggacaugguaccaugguuacagugucuagc

SEQ ID NO: 24871 - RNA, 438 nt, Artificial Sequence
  derived and/or modified sequence opt3 from anti-HIV_cap256-119-030197_VR-Chain
caggugcaccuggucgagagcggcgggggaguugugcaacccgguaagucccucagacuuucuugcgccgcuucacaguucaccuuuuguagguacggcaugcauuggguacggcaggcaccugggaaaggacuggaauggguggccaguaucagcaacgacggcacagauaaguaucacgcggacaaugucuggggucgcuucacuauuucccgagauaacucuaaaaauacguuguacuuagagaugaacucgcugcguggggaagacaccgcucuauauuacugcgccaaggauaugagagaggacgaaugugaggagugguggucagauuauuacgacuuuggaaaagaacucccaugcaggaaguggaagacacggggcguggcaggcauacuggauaauugggggcagggaacuaugguuaccgugagcagu

SEQ ID NO: 24872 - RNA, 438 nt, Artificial Sequence
  derived and/or modified sequence opt3 from anti-HIV_cap256-119-027047_VR-Chain
cagaugcaacugguggagagcggcgggggagucguucagcccgguagaucccucacccuuucuugcgccgcuucacaguucacauuuaggaacuacggcaugcacugggugcggcaggcaccugggaagggacuggaauggguagccaguaucagcaaagacggcacuaagaaauaucauggugauuccgugugggggcgcuucauuauaucucgagacaauucgaagaacacguuguuuuuacaaaugucaagccugcgugcggaggauaccgcucuauacuucugugucagagaccagagggaagccgagugcgaagagugguggagugauuauuacgacuuuggacgggagcucccaugucgcaaauucagaggccugggccuugcagggaucuuugauauuuggggacacgguacaauggugacuguuuccucu

SEQ ID NO: 24873 - RNA, 432 nt, Artificial Sequence
  derived and/or modified sequence opt3 from anti-HIV_cap256-119-026950_VR-Chain
caggugcaacuggucgagagcggcgggggaguugugcagcccgguaagucccucagaaucucuugcgccgcuucaagguucaccuuuggccgguucgggaugcacuggguacgccaggcaccuggaaaaggccuugaauggguggccaguauuagcuacgacgguuccgauaaguaucaugcggggcuggucuggggacgauuuauaaucucucgugacaacucgaaaaauacauuguacuuacagaugaacucacugagagcugaggauacugcccuauauuacugugugagggacgaacgggagagcgaaugcgagcucugggagagugauuauuacaauuucggcaagaacuauccauguguuaaaccgcgcggcguggcagggacgcuggacauuuggggacaagguaccacagucaucguguccucu

SEQ ID NO: 24874 - RNA, 438 nt, Artificial Sequence
  derived and/or modified sequence opt3 from anti-HIV_cap256-119-026279_VR-Chain
cagaugcaacugguggagagcggcgggggagucguucagcccgguaccucccucacacuuucuugcgccgcuucacaguucaguuuuacuagcuacggcaugcacugggugagacaggcaccugggaagggacuggaauggguagccuccaucucuaacgacggcacgaaaaaguaucaugcggagucggugugggguagguucaccauuucaaaagauaauagcaagaacacauuguuuuuacaaaugaauagucugcgggucgaagacacugcucuauacuucugugugaaagaucagcgcgaggacgaaugcgaggaguggugguccgauuauuacgacuuugggcgagaacucccaugucguaagucuagaggacugggccuugccggcauauucgauaucugggggcacggaaccguugugauugucagcucc

SEQ ID NO: 24875 - RNA, 432 nt, Artificial Sequence
  derived and/or modified sequence opt3 from anti-HIV_cap256-119-025355_VR-Chain
gaggugcagcuggucgaaagcggcgggggacucguucaacccgguagaucccuuaggcugucuugcgccgcuucaggcuucaguuuuagcgacuacgcaaugcacugggugcggcaggccccugggcagggauuggaguggguagcguucaucuccuaugauggcaccaagaaauaccauucugacucgguguggggucgcuuaacaauuucacgagauaacagccguaauacucuguuucuacagaugaacagucucagaacggaagacaccgcucuguauuucugugucagggaucaacgggaggacgauugcgaagaguggugguccgacuacuaugauuuugggaagaaacuuccaugucgcaagucuagaggacuggccggcauauucgacaucuggggccacgggacaauggugacuguuagcucc

SEQ ID NO: 24876 - RNA, 432 nt, Artificial Sequence
  derived and/or modified sequence opt3 from anti-HIV_cap256-119-025301_VR-Chain
caggugcaccuggucgccagcggcgggggaguugugcccccugguagaucccucaggcuuucuugcguagcuucacaauucaccuuuaguggcuucgggcuguacugggugcggcaggcaccaggaaagggcuuggagugggucgccgcgaucagcuuugcugguacuaaaaagcauuaugccaauuccgugaaagggcgcuucacaauuucucgagacaauucgaagaacacguuauaccugcagaugaacucacuacguccggaugacaccgcacucuauuacugugccaaagaucugagagaauaugagugcgaagaguggacaagcgacuacuaugauuuuggaaggccccagccuuguauagacagucggggcguugugggcauccuugauauuuggucccaagggacuauggucaccgugucuagc

SEQ ID NO: 24877 - RNA, 438 nt, Artificial Sequence
  derived and/or modified sequence opt3 from anti-HIV_cap256-119-025010_VR-Chain
caggugcaacuggucgagagcggcgggggaguugugcagcccgguagaucccucaggcuuucuugcccugccucaggcuucaguuuuagcaccuacgggaugcacuggguacggcaggcuccaggaaagggccuggaauggguggcauccaucucuaacgacgguaauaaaaaguaucauggggagucggucugggaucgcuucacaauuucacgagacaacagcaaaaauacuuuguuuuuacagaugaaccgucugagaguggaagauacggcccuauacuucuguguuaaggaccaaagggaggaugaaugcgaggagugguggagugacuauuacgauuuuggacgggaacucccgugucgcaaauucagaggccugggccuugcggggauauuugacguguggggacacgguaccauggucacaguguccucu

SEQ ID NO: 24878 - RNA, 432 nt, Artificial Sequence
  derived and/or modified sequence opt3 from anti-HIV_cap256-119-024631_VR-Chain
caggugcaacugauggagagcggcgggggagucguucagcccgguggcucccucagacuuucuugcgccgcuucaggguucaccuuuaguagcuacggaaugcacugggugaggcaggcaccuggcaagggucuggaauggguagccgggaucuccuaugacggaucugauaaauaccaugcgcacuucguguggggccgguuuauuauaucgcgcgacaacucaaagaaugcuuuguauuuacagaugaacagccugcgaccagaggauacagcccuauacuucuguguccgugaccucagagaaagugagugcgaagaguggcaauccuauuacuaugauuuuggcaggaaagggccgugucugaagccccggggaguggcagguucuuucgacaucuggggccaggggacuguugugacggucagcucc

SEQ ID NO: 24879 - RNA, 432 nt, Artificial Sequence
  derived and/or modified sequence opt3 from anti-HIV_cap256-119-024467_VR-Chain
gaggugcagcuggucgaaagcggcgggggacucguucaacccgguggcucccuuaaugugucuugcgccgcuucaggguucaccuuuagaacauacgcaaugcacuggguaaggcaggccccuggaaagggccuggaguggguggcggcuaucaguuaugacggugauaauaaauacagcgccgacuccgucaaggggcgguucacuauuucucgcgaucagucgaaaaacacguuguauuuacagaugaacucagugcgaguugaagacaccgcacguuacuauugugccagagauaugagggaguacgaaugcgagcugugggcuagcgacuauuacgauuuuggaaagccacaaccgugugaggacccccggggcguggucggcacauucgauaugugggggcuaggaacucucgugaccguaaguucc

SEQ ID NO: 24880 - RNA, 432 nt, Artificial Sequence
  derived and/or modified sequence opt3 from anti-HIV_cap256-119-023805_VR-Chain
caggugcaacuggucgagagcggcgggggaguugugcagcccgguaagucccucagacuuucuugcgccgcuucacaguucggcuuugggaguuacggaaugcacuggguaaggcaggcaccuggcaagggucuggaauggguggccaccaucagcuucgacggggcggauaaguaucaugcugacgaugucuggggacgguuuuccauuucucgcgacaacucgaaaaauacauuguacuuacaaaugaacaaucugcgaccagaggauacugcccuauauuacugugcaaaggaccuccgugaagaugagugcgaagagagauggucagacuauuacgauuucggcaaacagcugccguguaggaaaagccggggcguggccgggguuuuugacaacuggggacaggguacgauggugaccgucaguucc

SEQ ID NO: 24881 - RNA, 432 nt, Artificial Sequence
  derived and/or modified sequence opt3 from anti-HIV_cap256-119-021736_VR-Chain
caggugcaacuggucgagagcggcgggggaguugugcagcccgguagauccguaaggcucucuugcguggccucacaguucaguuuugaccgguacggcaugcacuggguccgccaggcuccugggaagggacuugaauggguggcaagcaucuccuaugauggcaccgacaaauaccaugccgauaagguuuggggucgauucacaauuucucgugacaauucgaaaaagacucuguauuugcaaaugaacucauuaagaccagaggaugcggcucuguacuauugugccaaagaccuaagggaagaugagugcgaagagugguggagcgacuacuaugauuuugggaagcagcucccgugucggaagagucgcggaguggcaggcauauucgacuccuggggccaggggacgauggucaccgugucuagc

SEQ ID NO: 24882 - RNA, 438 nt, Artificial Sequence
  derived and/or modified sequence opt3 from anti-HIV_cap256-119-021203_VR-Chain
cagaugcaacugguggagagcggcgggggagucguucagcccgguagaucccucacccuuucuugcgccgcuucacaguucacauuuaguaacuacggcaugcacugggugaggcaggcaccugggaagggacuggaauggguagccagcguguccaaugacggcacuaaaaaguaucauggugauucugucugggaccgguucacgaucucgcgcgauaacagcaaaaauaccuuguuuuuacaaaugucaagucugcgagcggaggacacagcuguguacuucuguguucgugaugaaagagaggacgaaugcgaggaguggugguccgauuauuacgacuuugggagggaacuaccaugucggaaguuccgcggacucggccuggccggcauuuuugauauaugggggcacggaacucuugugaccgucucuagc

SEQ ID NO: 24883 - RNA, 432 nt, Artificial Sequence
  derived and/or modified sequence opt3 from anti-HIV_cap256-119-020569_VR-Chain
caggugcaacuggucgagagcggcgggggaguugugcagcccggugaaucccucagaaucucuugcgccgcuucacaguucaccuuuaguagguacggcaugcacuggguacggcaggcaccugggaagggacuugaguggguggccagcauuuccuucgacggccgcgauaaauaucauucuucgcuggucuggggucgauugacaauaucacgugacaauagcaagaguacuuuauuucugcaaaugaacucccuaagaccagaagauacggcgcucuacuauugugcuagggacgugcgggagucugaaugcgaggaguggcagagcgauuacuaugccuucuaccgcaaacugccguguguuaagcccagagggguggcaggaacccuugacaucuggggccagggcacaauggucacuguguccuca

SEQ ID NO: 24884 - RNA, 432 nt, Artificial Sequence
  derived and/or modified sequence opt3 from anti-HIV_cap256-119-019432_VR-Chain
caggugcaacugguccagagcggcgggggaguugugcagcccgguagaucccucaggaucucuugcgccgcuccuuacuucaccuuuggccgguauggguuccacuggguacgccaggcaccaggaaagggccuugaguggguggccucaauuaguuuugacggucgagauuacuaucauagcccgcacgucugggggcgucugacaauauccagagacaacucuaaaaauacuuuguacuuacaaaugaacucgcugagggcggaagauacggcucuauauuacugugcccgggaccuccgcgagucagaaugcgaggaaugggagagcgauuauuacgacuucggaaagaaaggccccugugugaagccuagaggcguugcagggagucuggauauguggggacaggguaccauggugacagucuccucu

SEQ ID NO: 24885 - RNA, 432 nt, Artificial Sequence
  derived and/or modified sequence opt3 from anti-HIV_cap256-119-018827_VR-Chain
caggcccaacugguggagagcggcgggggagucguucagcccgguaggucccucaggcuuucuugcgcugcaucacacuucaguuuuaaucgguacggcaugcauugggugcgccaggccccugggaagggacuggaauggguagcgggcaucagcuaugacggucgagauuucuaccacgcugacauugugugggggcguuugaccauauccagagauaauucuaaaaacacagucuauuuacagaugaacucgcugagggccgacgauacuggacuauacuauugugcacgggacgugcgcgagucagaaugcgaggaaugggagagcuacuauuacgauuuuggcagaaagggcccaugucucaaaccgagagggguugccggaacguucgacauguggggucaaggcaccaucgugagugucuccgcu

SEQ ID NO: 24886 - RNA, 432 nt, Artificial Sequence
  derived and/or modified sequence opt3 from anti-HIV_cap256-119-018483_VR-Chain
cuggugcagcucgucgagagcggcgggggaguugugcaacccgguaagucccuuagacugucuugcguagccucacaguucaccuuuaauagguacggcaugcacugggugcggcaggcuccugggaaaggauuggaaugggucgcaggcaucaguuaugacggucgcgauaaguaccaugcccacuucgugugggggcgaauuacaauaagccgugacaauuccaaaaacacuuuauaucugcagaugaacucucuaagagcggaggauacggcucucuaccauuguguuagggaccugcgggaaucggagugcgaacuuugggagucagauuauuacgacuuuggaaagaaacugccaugugugaagccgcgcggcgucgccggcaucuucgauuugugggggcaaggaaccauggugacaguaagcagu

SEQ ID NO: 24887 - RNA, 432 nt, Artificial Sequence
  derived and/or modified sequence opt3 from anti-HIV_cap256-119-018118_VR-Chain
caggugcaccuggucgccagcggcgggggaguugugcccccugguagaucccucacccuuucuugcguagcuucacaauucacauuuaguggcugugggcugcauugggugaggcaggcaccaggaaagggcuuggagugggucgccagcaucuccuucgcggguacuaaaaagcacuacgggaacucugugaaaggacgguuuacgauuucgcgcgacaauucaaagaacaccuuauaucugcagaugaauagccuacgaccggaagauacagcucucuacuauugcgccaaagaccugcgugaguacgaaugugaggaauggaccagugauuauuacgacuucggcagagaucagcccugcauagacuccaggggcguuguggggauccuugauauuuggggacaagguacuauggucacagugucuagc

SEQ ID NO: 24888 - RNA, 432 nt, Artificial Sequence
  derived and/or modified sequence opt3 from anti-HIV_cap256-119-017782_VR-Chain
caggugcaacuggucgagagcggcgggggaguugugcagcccgguaagucccucagacuuucuugcgccgcuucaggcuucccuuuuaguaacuacgcaaugcacuggguaaggcagaccccagggcggggacuggaauggguggccggcaucagcuucgcggcuacuaaaaaguauuaccgcccguccguccgaggucguuuuacagugucuacggacauuucgaaaaauaccuuguauuuagagaugaacucacugagacccgaagauacagcccuauacuucugugcaagggaccagcgguauuacgagugcgaagagugggccagcgauuauuacgacuuugggcgcgagcaaccuugucucgauccaagaggaguugugggcauauucgaccuguggggccaggggacuauggucaccgugaguucc

SEQ ID NO: 24889 - RNA, 432 nt, Artificial Sequence
  derived and/or modified sequence opt3 from anti-HIV_cap256-119-017669_VR-Chain
caggugcaacuggucgagagcggcgggggaguugugcagcccgguuccucucucagacuuucaugcgccgcuagucacuucgcauuuaacagguacggcaugcauuggguacggcaggccccugggaagggacuggaauggguggcgggcaucagcuucgacggugcugauaaauuucacgccgacaaggucugggggcgcuucaccauuucccgagauaauucuaaaaacacauugucguuacagaugaacucacugcguccagaggacacugcacuauauuacugugccaaggaucucagagaagacgagugcgaagagugguggagcgauuauuacgacuuuggaaggcggcugccgugucgcaaaaguagaggcguguccggcauauucgauaauugggggcaaggaacgaugguuaccgugucuagc

SEQ ID NO: 24890 - RNA, 432 nt, Artificial Sequence
  derived and/or modified sequence opt3 from anti-HIV_cap256-119-016976_VR-Chain
caggugcaacuggucgagagcggcgggggaguugugcagcccgguagaucccucaggcuuucuugcgccgcuucacaguucaguuuuggcgacuucgggaugcacuggguacggcaggcaccuggaaagggccuggaauggguggccgcgaucagcuuugcugguaccaaaaagaacuacgccgauuccguccgcgggcgauucacaauuucucgugacucgagcaaaaauacuuuguauuuacaaaugaacucacugagaccagaggauacggcacuauacuauugugugaaggacaugaggggauacgaaugcgaggaauggaccagugauuauuacgacuuuggccggccgcagcccuguauagauucccgcggcguuguggggacauucgacgucuggggacaggguacuauggugaccguaucuagc

SEQ ID NO: 24891 - RNA, 432 nt, Artificial Sequence
  derived and/or modified sequence opt3 from anti-HIV_cap256-119-015432_VR-Chain
gaggugcagcugcucgaaagcggcgggggacuuguccaacccgguggcucccugagauugucuugcgccgcuucaggguucaccuuuaguggauacagcuuaaacuggguuaggcaggcaccuggcaagggucuggaguggguggccuccaucucuuaugacgggucggauaaauaccacgcggaccggguauggggacgcuucacaauuucacgagauaauagcaagaacacucuauaucuccagaugaauagucugcgugcugaagacacggcccuuuacuauugugugagagaugcaagggaguccgaaugcgagcugugggagucugacuacuauaacuuuggccggaaauugccaugugucaagccgcgcggcguggccgggacccucgauauauggggacaggguacaaugguuacugugagcucc

SEQ ID NO: 24892 - RNA, 432 nt, Artificial Sequence
  derived and/or modified sequence opt3 from anti-HIV_cap256-119-015281_VR-Chain
cugggcagacucguggccagcgggggaggugucguucccccuggcaggucccuucggcugucuugcguggcuucacaguucaccuuuaguggguguggauugcacuggguacgccaagcaccaggcaaggguuuagaguggguggccagcaucuccuucgcggggacuaaaaagcauuacggaaacucugucaaaggccgauuuacaauuucgcgugacaauucaaagaacacgguguaucuggaaaugaauagccuaagagcugaggauaccgcccucuacuauugcgcaaaagaccugagggaauacgagugugaagaguggacaagugauuauuacgacuucggccggccgcagcccugcauagauucccgcgggguugugggaauccuugacauuuggggucagggcacuauggucaccgugucuagc

SEQ ID NO: 24893 - RNA, 432 nt, Artificial Sequence
  derived and/or modified sequence opt3 from anti-HIV_cap256-119-014957_VR-Chain
caggugcaagucguugagagcggcgggggagugguacagcccgguaccucccugagacucucuugcacagugucaggcuucaguuuuagcaacuacgaccuucacugggucaggcagacuccugccaaggggcuggaauggguggcuguuguguccuaugauggaucucgggaguacuauacggacucggucaaaggccgcuucaucauuucacgagaucagagcaagaauaccuuguacuuacaaaugaacagugugcgucuggaagacacagcaagauauuacugugccagggauaugcgggaguaugaaugcgagcuaugggcguccgacuacuacgauuuugguaaaccacagccgugugaggacccccgcgggguaguuggaacuuucgauauguggggccucggcacccuggugacagucucuagc

SEQ ID NO: 24894 - RNA, 432 nt, Artificial Sequence
  derived and/or modified sequence opt3 from anti-HIV_cap256-119-014777_VR-Chain
caggugcaccuggucgagagcggcgggggaguugugcaacccgguagaucccucaggcuuucuugcgccgcuucacauuucagucugagcuccuacggcaugcacuggguacggcaggcaccugggaagggauuggaauggguggccggcaucucuuuugcggcuaccaaaacauauuacggugggucggucaagggacgcuucacugugucacgagacauuagcaaaaacacguuauaucugcagaugaauagucuacguccagaggauaccgccauguacuauugugcaagagaccagagguacuaugaaugcgaggaaugggccuccgauuacuacgacuuuggccgggagcaaccgugucaggauccccgcggcguugugggggucuucgacauguggggacaggguacaauggugacuguaucuagc

SEQ ID NO: 24895 - RNA, 432 nt, Artificial Sequence
  derived and/or modified sequence opt3 from anti-HIV_cap256-119-014313_VR-Chain
caggugcaacuggucgagagcggcgggggaguugugcagcccgguagaucccucaggaucucuugcgccgcuucacaguucaccuuuagucgguacggcaugcacuggguacgccaggcaccugggaagggacuugaauggguggccagcauuuccuaugacggccgagauuaccaucacgcgggugcugucugggggcguuucauaaucucuagagacaacucgaaaaauucacugcauuugcaaaugaacagcuuaaggccagaggauacagcccuguauuuuugugcacgggaccuacgcgaaagugagugcgaagagugggaguccgauuacuauaauuucuggaagaaacucccgugugugaagcccagaggaguugugggcauucuggacaucuggggccaggggacugucgugacgguaucuagc

SEQ ID NO: 24896 - RNA, 438 nt, Artificial Sequence
  derived and/or modified sequence opt3 from anti-HIV_cap256-119-014219_VR-Chain
cagaugcaacugguggagagcggcgggggagucguucagcccgguuccucucucacccuuucaugcgccgcuagucaguucacauuuagcaacuacggcaugcacugggugagacaggcaccugggaagggacuggaauggguagccuccaucucuaaugacggcacuaaaaaguaucauggugauucggugugggacagguucacgauuucacgggauaacagcaaaaauaccuuguuuuuacaaaugaacagucugcgcgcggaggacacagcucuauacuucugugucaaggaucagcgagaagacgagugcgaagaguggugguccgauuauuacgacuuugggcgugagcucccauguagaaaauucaggggacugggccuugccggcacuuuugauauaugggggcacggaaccaugcugaucgugucuagc

SEQ ID NO: 24897 - RNA, 432 nt, Artificial Sequence
  derived and/or modified sequence opt3 from anti-HIV_cap256-119-013631_VR-Chain
caggugcaacuggucgagagcggcgggggaguugugcagcccgguagaucccucaggcuuucuugcgccgcuucacaguucaccuuuggcaguuacgggaugcacuggguacggcagaucccuggaaagggccuggaauggguggcaacaauuagcuaugacgguacuaaaaaguaccaugccgauuccgucugggaccgcuucauaaucucucgagauaacucgaaaaauacguuguuuuuacaaaugaacucacugcguccagaggacaccgcgcuauauuucugugugaaggaucagagacaggacgaaugcgaggaaugguggagcgauuacuaugacuuugggaggcggcucccgugucgcaaaaguagaggacuggcuggcauuuucgauguuuggggccacgggacaauggugacugucuccucu

SEQ ID NO: 24898 - RNA, 432 nt, Artificial Sequence
  derived and/or modified sequence opt3 from anti-HIV_cap256-119-012924_VR-Chain
caggugacccuggucgagagcggcgggggauucguucaacccgguggcucccucagacuuucuugcgccacaucaggguuuacuuucaguagcuacgcuaugcacugggugaggcaggcaccuggaaagggccuggaauggguagccgcgaucuccuuugacggugcugauaaauaucaugccgacaacgugugggggcgguugucuauuucgcgcgauaauucaaagagcacguuauaccugcagaugaacagucuacgaccagaggacaccgcagucuauuucugugccaaagaucuccgugaagacgagugcgaagagagaugguccgauuacuaugacuuuggaaagcagcugccguguaggaaaucucggggcguggcuggcauauucgauaauugggggcaaggaacaaugguuacugugagcgca

SEQ ID NO: 24899 - RNA, 432 nt, Artificial Sequence
  derived and/or modified sequence opt3 from anti-HIV_cap256-119-011793_VR-Chain
caggugcaacuggucgagagcggcgggggaguugugcagcccgguggcucccucagacuuucuugcguagccucacaguucaccuuuaguagguacgggaugcacugggugcggcaggcuccuggaaagggccuggaaugggucgcaagcaucuccuaugacggucgcgauaaauaccaugccgacuucgugugggggcgauugacaauuucucgugaugacucgaagaaaacuuuauaucugcaaauggauucacuaagaguugacgauacggcgcucuacuauugugugagggacaugcgggagagcgaaugcgagcugugggaaagugauuacuaugacuuuggaaagcgccuuccaugugucaaaccgagaggcguggcuggcauauucgauaucugggggcagggaaccaugguaacaguuuccucu

SEQ ID NO: 24900 - RNA, 432 nt, Artificial Sequence
  derived and/or modified sequence opt3 from anti-HIV_cap256-119-011413_VR-Chain
caggugcaacuggucgagagcggcggggacguugugcagcccggaagaucccucaggcuuucuugcgccgcuucagguuucaccuuuaguacauacggcaugcacuggguacggcaggcaccugggaagggacuggaauggguggccgcgaucagcuucgcuggcacuaaaaagaacuaugccgauuccguccgcggucgauuuacgauuucucgugacucgaguaaaaauaccuuguacuuagagaugaacagccugagaccagaagauacagcacuauauuacugugccaaggacaugaggggguaugagugcgaagaguggacuucagauuacuaugacuucggacggccgcagcccuguauagauucccgcggcgugguuggcaccuuugacgugugggggcaaggaacaauggucaccgugucuagc

SEQ ID NO: 24901 - RNA, 432 nt, Artificial Sequence
  derived and/or modified sequence opt3 from anti-HIV_cap256-119-011323_VR-Chain
caggugaagcuggucgagagcggcgggggaguugugcccccugguaaaucccucagacuuucuugcaccgccucacaauucacauuuaguaacuucggcaugcacuggguaaggcaggcuccagggaagggacuggaauggguggcaagcaucuccuuugucggcauuaaaacucauuacgccaauucugugcggggucgcuucacgauaucgcgagaccagucaaagaacaccuuguauuuacagaugaauagcguucguguggaggauacagggagauacuauugugcgagggacaugcgggaauacgagugcgaacugugggcuagugauuauuacgacuuuggaaaaccgcaacccugugaggauccucgcggcgucgugggcacuuucgacaugugggggcuaggaacccucguaacaguuuccucu

SEQ ID NO: 24902 - RNA, 432 nt, Artificial Sequence
  derived and/or modified sequence opt3 from anti-HIV_cap256-119-011233_VR-Chain
caggugcaccuggucgagagcggcgggggaguugugcaacccgguagauccguaaggcucucuugcgccgcuucacauuucagucuuagcuccuacggcaugcacugggugcggcaggcaccugggaagggacuggaaugggucaccggcaucucuuuugccgguacaaaaacuuauuacggggacucggugcgcggacgauucacgguuucacgugauauuagcaagaacaccuuguuuuuacagaugaauagucugagaccagacgauacagcgauguauuacugugcuagggaccagcgguauuacgagugcgaagagugggccuccgauuauuacgacuucggccgcgaacaaccgugucuagaucccagaggcguggucgggauauuugaccucuggggacaggguacuauggugaccguaucuagc

SEQ ID NO: 24903 - RNA, 432 nt, Artificial Sequence
  derived and/or modified sequence opt3 from anti-HIV_cap256-119-009038_VR-Chain
caggagcaacugguggaaagcggcgggggagucguucagcccgguagaucccucaggcuuucuugcguggccucacgguucaccuuuagugcuuucggcaugcacuggguacgccaggcaccugggaagggacuggaguggguggccagcaucuccuuugcgggcauuaaaaaguacuauggugacucugucaaagggcgauucacaauaucgcgugauaacucaaagaauacuuuguacuuacagauggacggacugagaggcgaagauacggcucuauauuacugugccaaagaccucagggagcuggaaugcgaggagugggcaagcgauuauuacgacuuuggccggccacaaccgugucuugauccccgcggggugaguggaaucuccaacguuuggggucagggcaccauggugacagucucuagc

SEQ ID NO: 24904 - RNA, 432 nt, Artificial Sequence
  derived and/or modified sequence opt3 from anti-HIV_cap256-119-008756_VR-Chain
caggugcaacuggucgagagcggcgggggaguugugcagcccgguaagucccucagacuuucuugcguagugucacaguucaccuuuggcagguacgggaugcacuggguccggcaggccccuggaaaaggccuggaauggguggcuaguaucagcuaugacgguuccgauaaguaccauacaucuucguugugggggcgcuucauuguuucacgagacaacagcaaaaauacuuuauaucugcaaaugaacagucuacguccagaggauacggcacucuacuauugugugagagacaggcgggaauccgagugcgaggaacgcuggucugauuacuaugacuuuggaaagcagcugccgugugucaaacccagaggcguggccggcauauucgauaucugggggcagggaaccaugguaacaguuagcucc

SEQ ID NO: 24905 - RNA, 438 nt, Artificial Sequence
  derived and/or modified sequence opt3 from anti-HIV_cap256-119-008055_VR-Chain
cagaugcaacugguggagagcggcgggggagucguucagcccgguagaucccucacccuuucuugcgccgcuucacaguucaguuuugcaaacuacggcaugcacugggugaggcaggccccugggaagggacuggaauggguagcgagcaucuccaaugacggcacuaaaaaguaucaugaggaaucuguguggggucgguucacaauuucgaaagauaacucaaagaauacguuguuuuuacaaaugaacagccugcgcauagaggacaccgcucuauacuucugugucaaagaucagcgagaagacgagugcgaggaaugguggagugauuauuacgacuuugggcgugagcucccauguagaaaguccaggggacugggccuugccggcaucuucgauaugugggggcacggaacaauggugacuguuucuagc

SEQ ID NO: 24906 - RNA, 435 nt, Artificial Sequence
  derived and/or modified sequence opt3 from anti-HIV_cap256-119-006949_VR-Chain
caggugcaccuggucgagagcggcgggggaguugugcaacccgguagaucccucaggcuuucuugcgccgcuucaggcuucaguguaagcaacaauuacaugaacugggugcggcaggcaccuggggaaggacuggagugggucgccuugaucuccuuugacggccgccagaaggauuuagcggacucugugaaaggucgauucgcuauuucgcgugauaauucaaagaacacccuguaucuacagaugaauagccucagacuggaagacacagcccuuuacuauugugcaagggaucugcgggaguuggacugcgaagaguggacucucuacaacuauuacgauuuugggagucgcggaccauguguugacccgagaggcgugggcggguccuucgaugucuggggacaagguacgauggugaccguaucuagc

SEQ ID NO: 24907 - RNA, 432 nt, Artificial Sequence
  derived and/or modified sequence opt3 from anti-HIV_cap256-119-006685_VR-Chain
caggugcaacuggucgagagcggcgggggaguugugcagcccgguagaucccucaggguaucuugcgccgcuucacacuucaccuuuagucgguacggcaugcauugggugcgccaggcaccugggaagggacuugaaugggucgccagcaucuccuaugacggccgagauuucuaccacgcgcguucugugugggguagauuuacaauuucgagggacaacagcaaaaauacucugcauuugcagaugaacucauuacggccagaggauacggcucuguauuucugugcccgcgaccuaagagaaagugagugcgaagagugggaguccuacuauuacgauuuugggaagaaaggaccguguguuaagcccaggggcguggucggcgugcucgacauaugggggcaaggaacccugguaacaguuucuagc

SEQ ID NO: 24908 - RNA, 432 nt, Artificial Sequence
  derived and/or modified sequence opt3 from anti-HIV_cap256-119-006015_VR-Chain
caggugcaacuggucgagagcggcgggggaguugugcagcccgguaagucccucagacuuucuugcgccgcuucaagguucaccuuuaaccgguacggcaugcacuggguacgccaggcaccugggaaaggacuggaauggguggccgcgaucaguuucgacggcacagauaaguaucauagcgacgaugucuggggucgauuuacuauuucccgugacaauucuaaaaacacguuguacuuacagaugaauagccugagaccagaggauaccgcucuauauuacugugccaaggaccuccaagaagaugagugcgaagagugguggucagacuauuacgauuucgggaaacagcugccguguaggaagucgcggggaguggcaggcauauuugacgauuggggccaggggacaaugguuacugugaguucc

SEQ ID NO: 24909 - RNA, 432 nt, Artificial Sequence
  derived and/or modified sequence opt3 from anti-HIV_cap256-119-005841_VR-Chain
caggugcaacuggucgagagcggcgggggaguugugcagcccgguagaucccucaggcuuucuugcgccgcuucacaguucaguuuuggcaauuucgggaugcacuggguacggcaggcaccuggaaagggccuggaauggguggccgcgaucagcuuugcugguaccaaagagaauuacgccaacuccguccgcgggcgauucacaauuucucgugacaauucgaagaacacuuuguauuuacaaaugaacucacugagagcagaagauacggcccuauacuauuguaccaaagacaugagggaguacgaaugcgaggaguggacaagcgauuauuacgacuuuggacggccacagccguguauagauagucgcggcgugguuggcacuuucgacgugugggggcagggaaccauggucacaguguccucu

SEQ ID NO: 24910 - RNA, 432 nt, Artificial Sequence
  derived and/or modified sequence opt3 from anti-HIV_cap256-119-005824_VR-Chain
caggugcaacuggucgagagcggcgggggaguugugcagcccgguggcucccucagacuuucuugcgccgcuucaggguucaccuuuaggcgguacgcaaugcacuggguacgccaggccccuggaaagggccuggaauggguggcgaguaucagcuaugacgguuccgauaaauaccauacaucuucguugugggggcgauucauugucucacgugacaacagcaagaauacuuuauaucugcagaugaacagucuaagaccagaggauacggcucucuacuauugugugagggaccggcgcgaauccgagugcgaagagagauggucugauuacuaugacuuuggaaaacaacugccguguguuaagcccaggggcguggccggcauauucgauaucugggggcagggaaccauggucacagugagcucc

SEQ ID NO: 24911 - RNA, 432 nt, Artificial Sequence
  derived and/or modified sequence opt3 from anti-HIV_cap256-119-005494_VR-Chain
caggugagacuggucgagagcggcgggggaguugugcaacccgguaggucccuccggaucucuugcgccgcuucacaguucauguuuaacaaguacggcaugcacuggguacgccaggcaccugggaaaggacuugaauggguggccaguauuagcuaugacggcuccgauaaguaccaugcggaccuggucuggggucgauucaccauaucucgugauaauucgaaaaacacauuguauuuacagaugaacucacugagagcugaggacacugcccuauacuauugugugagggaugcacgggaaagcgagugcgaacucugggagagugacuacuauaauuuugggcgcaagcugccauguguuaaaccgagaggaguggccggcacgcuugauaucuggggccaagggaccauggucacaguguccucu

SEQ ID NO: 24912 - RNA, 432 nt, Artificial Sequence
  derived and/or modified sequence opt3 from anti-HIV_cap256-119-004949_VR-Chain
caggugcaacuggucgagagcggcgggggaguugugcagcccgguagaucccucaggcuuucuugcgccgcuucaaaguucagucugagcuccuacggcaugcacuggguacggcaggcaccugggcgcggauuggaauggguggccggcaucucuuuugcggcuaccaaaaaguauuaccgaccaucgguccgugguagauucacagugucaacugacauuagcaaaaacacguuauaucuggagaugaauagucuaaggccggaagauaccgcccucuacuuuugugcacgggaccagcgcuauuacgagugcgaagagugggccuccgauuauuacgacuucgggagagagcaacccugucuggauccuaggggaguugugggcauauuugaccuuuggggccaggggacaauggucacugugucuagc

SEQ ID NO: 24913 - RNA, 432 nt, Artificial Sequence
  derived and/or modified sequence opt3 from anti-HIV_cap256-119-004422_VR-Chain
cacgugcagcuggucgagagcggcgggggaguugugcaacccgguagaucccucaggcuuucuugcgccgcuucaggccugaguuucagcuccuacgcaaugcauuggguacggcaggccccugggaagggauuggaauggguggcggucgugucuuaugacggcaccacaaaauuuuacgcugauucgguuaagggucgcuucacuaucucacgagacaacagcaaaaauacguuauaucugcagaugaacagucuacguggggaggauaccgcccucuacuauugugcaaaggaccugagagaauacgagugcgaagaguggacauccgauuauuacgacuuuggaaggccacagccguguauugauucucggggcguggucggcauacuugacaucuggagccaagggacuauggugaccguauccuca

SEQ ID NO: 24914 - RNA, 432 nt, Artificial Sequence
  derived and/or modified sequence opt3 from anti-HIV_cap256-119-003932_VR-Chain
caggugcaacugcucgagagcggcgggggagucguucagcccgguggcucccuuagacugucuugcaaggccucacacuucaguuuugacagguacgggaugcauugggugcggcaggcuccuggaaaaggcuuggaauggguagcagccaucagcuucgauggugcggacaaguaucacgcugauaacgugugggggcgcuuauccauuucucgagacaauucgaaaucaacccuguaccuacagaugaacagccuccguccagaggauacagccgucuauuuuugugcaaaggaccugagagaagaugagugcgaagagagguggagugacuacuaugauuucggaaaacaacuuccgugucggaagucccgcggcguggccggcauauuugacaauugggggcagggaacuaugguuacggugucugcu

SEQ ID NO: 24915 - RNA, 438 nt, Artificial Sequence
  derived and/or modified sequence opt3 from anti-HIV_cap256-119-003577_VR-Chain
caggugcaacuggucgagagcggcgggggagguguucagcccggcagaucccucaggcuuucuugcgccgcuucaggguucaccuuucggaguuacgcaaugcacugggugcgccaggccccuggaaagggccuggaauggguagcggugaucagcaacgacgguacuaaaaaguaucaugcugaguccgucugggaucgauucucuauuucgaaagacaauucaaagaacacauuguuuuuacagaugaauagccugcguguggaagauacggcccuauacuucuguguuaaagaccaaagagaggaugaaugcgaggagugguggagugacuauuacgauuuugggagggaacucccaugucggaagucccgcggacugggccuugcaggcauauucgacaugugggggcacggaaccauggugacagucucuagc

SEQ ID NO: 24916 - RNA, 432 nt, Artificial Sequence
  derived and/or modified sequence opt3 from anti-HIV_cap256-119-002155_VR-Chain
cugggcagacucguggccagcgggggaggugucguucccccuggcaggucccuucggcugucuugcguggcuucacaguucaccuuuaguggguguggauugcacuggguacgccaagugccaggcaaggguuuagagugggucgcaagcaucuccuucgccgggacaaaaacucauuacggaaacucugugaagggccgauuuucgauuucacgugacaauagcauaaacacgguuuaucugcagaugaauagucuaagagcggaagauaccgcucucuacuauugcgccaaagaccugagggaguacgaaugugaggaauggacauccgauuauuacgacuucggccggccgcagcccugcaucgauucucgcgggguggucgguauucuugacaucuggagccagggaacuauggugaccguauccuca

SEQ ID NO: 24917 - RNA, 432 nt, Artificial Sequence
  derived and/or modified sequence opt3 from anti-HIV_cap256-119-002017_VR-Chain
caggugcaacuggucgagagcggcgggggaguugugcagcccgguagaucccucaggcuuucuugcgccgcuucaggcuucaccuuuaguuacuaugggauccacuggguacggcaggcaccuggaaagggccuggaauggguggccagcauuuccuacgacgagcgcgauuucuaucaugcgcgaucugucuggggucguuuugcuauaucgagagacaacagcaaaaauacauugcacuuacagaugaacucacugaggccagaagauacugcccuauacuucugugcacgggaccuccgcgagagugaaugcgaggagugggaauccuauuacuaugauuuugggaagaaaggaccgugugugaagcccagaggcguugugggcguccuggacaucugggggcaaggaacgcuugugaccguaucuagc

SEQ ID NO: 24918 - RNA, 432 nt, Artificial Sequence
  derived and/or modified sequence opt3 from anti-HIV_cap256-119-001312_VR-Chain
caggugcaacugauggagagcggcgggggagucguucagcccgguagaucccucaggcuugccugcgcugcaucuggcuucaccuuuucaaguuacgccauccacugggugcggcaggcgccugggaagggacuggaauggguagcugccauuagcuucgcaggcacuaaaaagaacuaugccgacuccgugcgcggucgauuuacaauaucucgugauucgagcaaaaauacguuguacuuagagaugaacucacugagaccagaagacaccgcucuauauuacugugcaaaggauaugaggggguaugagugcgaagaguggacaagugacuacuaugauuucggacggccgcagcccuguaucgacucccgcggcgucgugggcacuuuugauguuugggggcaaggaaccauggugacagucucuagc

SEQ ID NO: 24919 - RNA, 438 nt, Artificial Sequence
  derived and/or modified sequence opt3 from anti-HIV_cap256-119-001017_VR-Chain
cagaugcaacugguggagagcggcgggggagucguucagcccgguagaucccucacccuuucuugcgccgcuucacaguucaguuuuacaaacuacggcaugcacugggugaggcaggcaccugggaagggacuggaauggguagccagcaucuccaaugacggcaacaaaaaguaucauggugagucugugugggaucgguucacuauuucgcgcgacaauagcaaaaacacguuguuuuuacaaaugaaucgacugcgugucgaagauaccgcgcuauacuucugugugaaggaccagagagaggaugaaugcgaggagugguggucagacuauuacgauuuugggagggaacucccaugucggaaauuccgcggacugggccuugcuggcauauuugacguuugggggcacggaacaauggugacugucaguucc

SEQ ID NO: 24920 - RNA, 432 nt, Artificial Sequence
  derived and/or modified sequence opt3 from anti-HIV_cap256-119-000594_VR-Chain
caggugcaacuggucgagagcggcgggggacucguucagcccgguaccucccuucggcugucuugcgccgcuucagcauucacauuuaagaacuacggcaugcacugggugaggcaggccccugggaaaggauuggacuggguagcgaguaucagcuaugauggccgggacaaguaccauuccucuuuaguguggggucgccugacuauuucgcgagauaauucaaaaagcacgcuauuccuccagaugaacagucugcgugcugaagacaccgcccuuuauuacugugcaagagaucugagggaguccgaaugcgaggaauggcaaucugacuauuacgccuuuuauaagaaauugccaugugucaagccgagagggguggcuggaacacucgauauauggggccagggcacuaugguuaccgugagcucc

SEQ ID NO: 24921 - RNA, 432 nt, Artificial Sequence
  derived and/or modified sequence opt3 from anti-HIV_cap256-059-241099_VR-Chain
caggugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguggccgucaucuccuaugacgguucuaacaaauacuauguggauucgguucaggggcgcuucacaauuucacgagacaauagcaagaacacuauguuuuugcaaaugaauaguuuacguacggaggauaccgcgguguacuauugugcuagagaccugggagaauccgaggucgaagagugggccacagauuacuaugacuucucuauagcauacccaguggagggcccgaggggcguaguugggaucuuugauauuuggggacaggguacuauggugaccgucagcucc

SEQ ID NO: 24922 - RNA, 432 nt, Artificial Sequence
  derived and/or modified sequence opt3 from anti-HIV_cap256-059-207529_VR-Chain
caggugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguggccgguaucuccuucgcggggauuaacaaauauuacggaaauucugucaagggccgcuuuacaauaucgcgagacaacucacguaauacuuuguauuuacagaugaacagccugagagcugaggauacggcccuauacuauugugcaagggaccuccgggaaauggagugcgaagagugggccagugauuacuaugacuucggccgcgggggaccaugucaagauccgagaggugugguuggcaccuuugacaucugggggcagggaacaauggugacugucuccucu

SEQ ID NO: 24923 - RNA, 435 nt, Artificial Sequence
  derived and/or modified sequence opt3 from anti-HIV_cap256-059-205541_VR-Chain
cagaugcaacugguggagagcggcgggggagucguucagcccgguggcucccucagacuuucuugcgccgcuucaggguucaguuuuagcuacuaugcaauggacugggugaggcaggccccuggaaagggccuggaauggguagcguucaucuccucugaugguucggacaaaaacuacgcugauucagugaaggggcgguuuaccauuagccgcgacaauaguaaaaacacauuguauuuacagaugaacucccugcgagccgaggauacugcagucuacuauugugccaaggacgugggaggccacaaaaaugaugaaugggcuacgaauuacuauuacgacauaucuaucgcauacccaauucaagauccgcgugccguugcuggcgccuucgacgugugggggcagggaaccauggucacagugagcucc

SEQ ID NO: 24924 - RNA, 432 nt, Artificial Sequence
  derived and/or modified sequence opt3 from anti-HIV_cap256-059-188439_VR-Chain
caggugcaacuggucgagagcggcgggggaguugugcagcccgguagaucccucaggcuuucuugcgccgcuucacaguucaccuuuaguaacuacggcaugcacuggguacggcaggcaccugggaagggacuggaauggguggccgcgaucagcuucgcuggcauuaauaaauauuacacagacuccgucaagggucgcuuuacuauaucucgagauaacucgaaaaauacguuguauuuacaaaugaacucacugcgugccgaggacaccgcacuauacuauugugccaaggaucucagaggguucgaaugcgaggaaugggcuagcgacuacuaugauuuuggaagggaccugccaugucaggauccgcggggcgugguuggcacauucgacgugugggggcagggaacuaaagucaccgugaguucc

SEQ ID NO: 24925 - RNA, 432 nt, Artificial Sequence
  derived and/or modified sequence opt3 from anti-HIV_cap256-059-187234_VR-Chain
caggugcaacuggucgagagcggcgggggaguugugcaggccgguagaucccucaggcuuucuugcgcugcaucacaguucaccuuuggcaguuacgggaugcacuggguacggcaggcccccggaaagggccuggaauggguggcggcuaucagcuucgccgguacaaaaauucauuaugcagacuccgucaaggggcgcuuuacuauaucucgagauaacucgaaaaaugccuuguacuuacaaaugcacucacugcgugcugaggacacggcacuauauuacugugccaaggaucucagagaauaugagugcgaagagugggcuagcgacuacuaugauuucggaagggaccagccuugucaggauccacggggcgugguuggcaucuuugacauuugggggcagggaaccauggugacagucaguucc

SEQ ID NO: 24926 - RNA, 432 nt, Artificial Sequence
  derived and/or modified sequence opt3 from anti-HIV_cap256-059-187047_VR-Chain
caggugcaacuggucgagagcggcgggggaguugugcagcccgguagaucccucaggcuuucuugcgccguaucacagcugaccuucaguagcuacggcaugcacugggugcggcaggcuccugggaagggauuggaaugggucgcagccaucuccuuugugggcauuaaaaaguauuacgcggacucuguuaaaggucgcuucacaauaucgcgagauaacucaaagaauacuuuauaucugcaaaugaacagccuacguguggaggacacggcucucuacuauugugccaaagaucugagagaauacgagugcgaagagugggcaagugacuauuacgauuuugggagggaccagccaugucaggaugcccggggagucgugggcaccuccgacaucuggggccaggggacaaugguaacuguuucuagc

SEQ ID NO: 24927 - RNA, 432 nt, Artificial Sequence
  derived and/or modified sequence opt3 from anti-HIV_cap256-059-186068_VR-Chain
caggugcaacuggucgagagcggcgggggaguugugcagcccgguagaucccucaggcuuucuugcgccgcuucacaguucaguuuuagcaacuacggcaugcacuggguacggcaggcaccugggaagggacuggaauggguggccggcaucuccuucgcggcuaccaaaaaguauuacgccgacucugucaaaggucgcuuuucggugucacgagauaauagcaagaacgcauuguauuuacaaaugaauagucugcgugccgaggacacagcucuauacuauugugcaagagaucucagggacuacgaaugcgaggaaugggccuccgauuauuacgacuucgggcgggaguacccaugucaggauccgcgcggaguugugggcacuuuugacauuuggggccaggggacgauggucaccgugucuaca

SEQ ID NO: 24928 - RNA, 435 nt, Artificial Sequence
  derived and/or modified sequence opt3 from anti-HIV_cap256-059-182835_VR-Chain
caggugcaacuggucgagagcggcgggggacucguucagcccgguagaucccuuaggcugucuugcgccgcuucaggcuucaguuuuaacaauuucgcaauggacugggugcggcaggccccugggaagggauuggaauggguagcguuugugagcuccgauggcucuaacaaaaauuacgcugacucggucaagggucgcuucaucauuucacgagauaacagcaaaaauaccguguauuuacagaugaacagucugcguguugaggacacagccguguacuauugugcaaaggaucuaggggccaauaaagacgaugaaugggcuacugacuacuauuacgaucucuccgucgcaagaccagugccggaccccagggccguaguuggagcuuuugauguguggggccaaggcacgauggucaccgugucuagc

SEQ ID NO: 24929 - RNA, 432 nt, Artificial Sequence
  derived and/or modified sequence opt3 from anti-HIV_cap256-059-176659_VR-Chain
agagugcagcuggucgagagcggcgggggaguugugcaacccgguaggucccuccggcuuucuugcgccgcuucacaguucaguuuuagcaacuacggcaugcacuggguacgccaggcaccugggaagggacuggaauggguggccggcaucuccuucgcggcuauuaaaaaguauuacgccgacucugucaaaggucgauuuaccauaucgcgugauaauucaaagaacgcauuguauuuacagaugaauagccugagagccgaggacacagcucuauacuauugugcaagggaucuccgggaauacgagugcgaagagugggccagugacuauuacgauuucgggcgcgagcugccaugucaagacccgagaggagugguuggcacuuuugauacguggggccaggggaccauggugacagucuccacu

SEQ ID NO: 24930 - RNA, 432 nt, Artificial Sequence
  derived and/or modified sequence opt3 from anti-HIV_cap256-059-172956_VR-Chain
caggugcaacuggucgagagcggcgggggaguugugcagcccgguagaucccucaggcuuucuugcgccgcuucacaguucaguuuuagcuccuacggcaugcacuggguacggcaggcaccugggaagggacuggaauggguggccgcgaugucuuucgcuggcaccaaccaauauuacgccgcaucggucaaaggucgcuuuacaaucucacgagacaauagcaagaacacuuuguauuuacauaugaauagucugcguccagaggauacggcccuauacuauugugcuagagaccucagggaauacgagugcgaagagugggcagccgauuauuacgacuucgggcgggaguacccgugucaggauccccgcggagugguuggcauuuuugacguguggggccaggggacccuggucacaguguccucu

SEQ ID NO: 24931 - RNA, 432 nt, Artificial Sequence
  derived and/or modified sequence opt3 from anti-HIV_cap256-059-171272_VR-Chain
caggugcugcucgucgagagcggcgggggaguugugcaacccgguagaucccuuaggcugucuugcgccgcuucacaguucaccuuuaguaauuacggcaugcacuggguacggcaggcaccugggaagggauuggaauggguggccgcgaucagcuucgcuggcaugaaaaaguauuacgccgacuccgucaaaggucgcuuuacaauuucucgagauaauucgaagaacacuuuauaucugcagaugaacucacuacgugcagaggacacggcccucuacuauugugcuaaagaucugagagaguucgaaugcgaagagugggcaagcgacuacuaugauuuugggagggcccaaccaugucaggacccgcggggagugguuggcaccuucgaucuuuggggccaggggacaauggugacugucaguucc

SEQ ID NO: 24932 - RNA, 432 nt, Artificial Sequence
  derived and/or modified sequence opt3 from anti-HIV_cap256-059-168734_VR-Chain
caggugcaacuggucgagagcggcgggggaguugugcagcccgguagaucccucaggcuuucuugcaccgccucacaguucaguuuuagcuccuacggcaugcacuggguacggcaggcuccugggaagggacuggaauggguggcagccaucucuuucgcgggcacuaaaaaguauuacgucgguacagugaaagggcgcuuuacgauuucgcgagacaacucaaagaauaccuuguauuuacaaaugaacagccugcgugcugaggauacagcccuauacuauugugcaaaagacaugagagaauacgagugcgaagagugggccagugauuauuacgacuucggaagggaguacccaugucaggauccgcggggcguugugggcacuuuugacauaugggggcagggaaccauggucacaguguccucu

SEQ ID NO: 24933 - RNA, 432 nt, Artificial Sequence
  derived and/or modified sequence opt3 from anti-HIV_cap256-059-155838_VR-Chain
caggugcaacuggucgagagcggcgggggaguugugcagcccgguagaucccucaggcuuucuugcgccguaucacaguucaccuuuaguaacuacggcaugcacugggugcggcaggcuccugggaagggacuggaaugggucgcagccaucagcuucgcgggcacuaaaaaguccuaugcugccucugugaaaggucgcuuuacaauuucgcgagacaauucaaagaacacguuguacuuacaaaugaauagccugcguccagaggauaccgcacuauauuacugugccaaagacaugagaggguucgaaugcgaggaaugggcuagugauuauuacgacuuuggaagggagcagccgugucaggauccccggggcguugugggcauauucgaccucugggggcagggaacaauggucuccgugucuagc

SEQ ID NO: 24934 - RNA, 432 nt, Artificial Sequence
  derived and/or modified sequence opt3 from anti-HIV_cap256-059-149799_VR-Chain
caggugcaccuggucgagagcggcgggggaguugugcaacccgguagaucccucaggcuuucuugcgccgcuucacaguucaccuuuaguaacuacggcuuccauuggguacggcaggcaccugggaagggacuggaauggguggccgcgaucagcuuugcuggcgucaaaaagcacuaugccgacuccgugaaaggucgcuucacaauuucucgagauaauucgaagaacacuuuguacuuacagcuaaauucacugcgugcagaggacacggcccucuauuacugugcuaaagaucugagagaauaugagugcgaagagugggcaagcgacuacuaugauuuugggagggacuucccaugucaagauccgcggggaguugugggcaccuuugacauauggggccaggggacaauggucacugugaguucc

SEQ ID NO: 24935 - RNA, 432 nt, Artificial Sequence
  derived and/or modified sequence opt3 from anti-HIV_cap256-059-148168_VR-Chain
caggugcaacuggucgagagcggcgggggaguugugcagcccgguagaucccucaggcuuucuugcaccgccucacaguucacauuuaguaacuacggcaugcacuggguacggcaggcuccugggaagggacuggaauggguggcaggcaucagcuucgccgcgacuaaaaaguauuacuccgacucugucaaaggucgcuuuacgauuucgcgagauaauucaaagaacgcuuuguauuuacaaaugaauagccugcgugccgaggacaccgcacuauaccauugugccaaagaucucagagaauaugagugcgaagagugggcuagugacuacuaugauuucgggagggagcagccaugucaggacccgcggggagugguuggcacauuugauauauggggccaggggacuauggugaccgucuccaca

SEQ ID NO: 24936 - RNA, 435 nt, Artificial Sequence
  derived and/or modified sequence opt3 from anti-HIV_cap256-059-144685_VR-Chain
caggugcaccuggucgagagcggcgggggaguugugcaacccgguagaucccucaggcuuucuugcgccgcuucaggcuucaccuuuaguaacuucgcaauggacuggguacggcaggccccugggaagggacuggaauggguggcguuugucagcuccgauggcaauaacaaaaauuacggugacucugugaaggggcgcuucacaaucucgcgagauaacagcaaaaauacuuuguuuuuacagaugaacucacugcgugcugaggacacggcccuauauuacuguguuaaggaugugggagacuauaaaagugaugaaugggcaacccauuacuauuacgaccucuccauugccgauccaauacaggacccgagagcugucgugggcgcauucgauaucuggggcagggggacaaugguagccguuucuagc

SEQ ID NO: 24937 - RNA, 432 nt, Artificial Sequence
  derived and/or modified sequence opt3 from anti-HIV_cap256-059-140017_VR-Chain
caggugcaacuggucgagagcggcgggggaguugugcagcccgguagaucccucaggcuuucuugcgccgcuucacaguucaguuuuggcaacuucgggaugcacuggguacggcaggcaccuggaaagggccuggaauggguggccgguaucagcuuugcggggaccaaaaaguacuaugcugacuccgucaaaggacgcuucacaauuucucgagauaauucgaagucagccuuguuuuuacaaaugaacagccugcgugcagaggacacugcccuauacuauugugcuaaagaucucagauacuaugaaugcgaggaaugggcaagugacuacuaugauuucggcagggaccagccaugucaggauccgcggggcgugguugggacguuugacauguggggacaggguaccauggugacagucuccucu

SEQ ID NO: 24938 - RNA, 432 nt, Artificial Sequence
  derived and/or modified sequence opt3 from anti-HIV_cap256-059-137547_VR-Chain
caggugcaacuggucgagagcggcgggggaguugugcagcccgguagaucccucaggcuuucuugcgccgcuucacaguucaccuuuagucgguacggcaugcacuggguacgccaggcaccugggaagggacuggaauggguggccgcgaucagcuucgcuggcauuaaaaagaauuaugccgacuccgucaaaggucgauuuacaauaucucgugauaauucgaagaacacuuuguacuuacaaaugaacucacugagagcagaggacacggcccuauauuacugugcuagggaucuccgggaguucgaaugcgaagagugggcaagcgacuauuacgauuuugggcgcgacuucccaugucaggauccgagaggagugguuggcaucuuugacauuuggggccaggggaccauggugacagucaguucc

SEQ ID NO: 24939 - RNA, 435 nt, Artificial Sequence
  derived and/or modified sequence opt3 from anti-HIV_cap256-059-131908_VR-Chain
caggugcaacuggucgagagcggcgggggaguugugcagcccgguagaucccucaggcuuucuugcaccgccucaggcuucacauuuaguaacuacgggauccacuggguacggcaggcuccuggaaagggccuggaauggguggcagccauuagcuaugaggguuccauaaaauacuaugucgacucugugaaggggcgcuucacuaucucgcgagaugacagcaaaaauacguuguuuuuacagaugaacucacugcguaccgaagauacagcgguuuacuauuguacuagagacgugagggagugggaaaccgaggagugggcuacaaauuacuauuacgaucuaaguauugccuacccaauccggcauccgcgcggagucgugggcauuuucgacguauggggccucgggaccagaguuacuguguccucu

SEQ ID NO: 24940 - RNA, 432 nt, Artificial Sequence
  derived and/or modified sequence opt3 from anti-HIV_cap256-059-116006_VR-Chain
caggcccaacugguggaaagcggcgggggagucguucagcccgguagaucccucaggcuuucuugcgcugcaucacaguucaguuuuagcuccuacggcaugcacugggugcggcaggccccugggaagggacuggaauggguagcgucuaucucguucgcuggcgugaaaaagaccaacgccgacucagucaaaggucgcuuuacaauuagccgagauaauaguaagaacacuuugcauuuacaaaugaaugggcugcguaacgacgauacggcacuauauuacugugccagagaccucagggauuucgagugcgaagagugggcuuccgacuauuacgauuuuggacgggaguucccaugucaggacccgcgcggcgugguuggcaccuuugauauaugggggcagggaacaaaagugacugucucuagc

SEQ ID NO: 24941 - RNA, 411 nt, Artificial Sequence
  derived and/or modified sequence opt3 from anti-HIV_cap256-059-115783_VR-Chain
caggugcaacuggucgagagcggcgggggaguugugcagcccggucggucccucaggcuuucuugcgccgcuucacaguucaccuuuaguagcuacggcaugcacuggguacggcaggcaccugggaagggacuggaauggguggccgcgaucuccuaugcugacucugucaaaggccgcuucacaauuucgcgagauaacucaaagaauacuuuguacuuacaaaugaacagccugcgugccgaggacacggcacuauauuacugugccaaagaucucagagaaauggagugcgaagagugggcuagugacuauuacgauuuugguagggaccugccaugucaggauccgagaggggugguuggaacccuugacauauggggccagggcacaauggugacugucuccucu

SEQ ID NO: 24942 - RNA, 432 nt, Artificial Sequence
  derived and/or modified sequence opt3 from anti-HIV_cap256-059-114609_VR-Chain
caggugcaacuggucgagagcggcgggggaguugugcagcccgguagaucccucaggcuuucuugcgccgcuucacagcugaccuucaguaacuuuggcaugcacuggguacggcaggcaccugggaagggauuggaauggguggccggcaucagcuucgcggguacuaaaaaguacuaugcugacuccgucaaagggcgcuuuacaauuucucgagauaauucgaagaacgccuuauaccugcaaaugaauacgcuacgugcagaggacaccgcccucuauuucugugcuaaagaucugagagaauacgagugcgaagagugggcaucagacuauuacgauuuuggaagggaccagccaugucaggauccgcggggcgugguuggcauauucgacaucugggggcagggaacaauggugacugucagcagu

SEQ ID NO: 24943 - RNA, 432 nt, Artificial Sequence
  derived and/or modified sequence opt3 from anti-HIV_cap256-059-113952_VR-Chain
caggcccaacugguggagagcggcgggggagucguucagcccgguagaucccucaggcuuucuugcgcugcaucacacuucaccuuuaguagcuacggcuuccauugggugcggcaggccccugggaagggacuggaauggguagcgggcaucuccuuugcugccacuaaaaaguauuacgcagacucugugaaaggucgcuucacaauuucgcgagauaacucaaaggacgccuuguauuuacagaugaauagccugcgugcugaggauacggcacuauacuauugugccagagaccucaggggguacgaaugcgaggaaugggcuagugauuauuacgacuuuggacgggaucaaccaugucaggacccgcgcggcgucgugggcauauucgaucugugggggcagggaaccaugguuacaguguccucu

SEQ ID NO: 24944 - RNA, 432 nt, Artificial Sequence
  derived and/or modified sequence opt3 from anti-HIV_cap256-059-113878_VR-Chain
caggugcaacuggucgagagcggcgggggaguugugcagcccgguagaucccucaggcuuucuugcgccgcuucaggcuucaccuuuaguacauacgcaaugcacuggguacggcaggccccugggaagggacuggaauggguggcguugaucagcuaugacgcuacuaacaaauacuaugucgauuccgugaagggccgcuucacgauuucucgagacaauucgaaaaacaccuuauaccugcagaugucaagccuaacagccgaggauacugcaguuuauuacugugccaaggaccucggugggauaaaaaucgaugaauggggaaccgacuauuacgauauuaguguguccuacccaguccaagacccgcgugcuguggcaggcaucuuugauguauggggccaugggacaaugguuucugugagcucc

SEQ ID NO: 24945 - RNA, 432 nt, Artificial Sequence
  derived and/or modified sequence opt3 from anti-HIV_cap256-059-113622_VR-Chain
caggugcaacuggucgagagcggcgggggaguugugcagcccgguagaucccucaggcuuucuugcgccgcuucacaguucaccuuuacaaguuacggcaugcacuggguacggcaggcaccugggaagggacuggaauggguggccggcaucagcuucgcggguacuaaaaagcauuaugcugacuccgucaaagggcgcuuuacgauuucucgagauaacucgaagucaaccuuguacuuacaaaugaauagccugcgugccgaggacacagcacuauauuacugugccaaagauaugagagaauaugagugcgaagagugggcuagugacuacuaugauuucggaagggaccagccaugucaggauccgcggggcgugguuggcauauuugaccucugggggcagggaacuauggugaccgucuccucu

SEQ ID NO: 24946 - RNA, 432 nt, Artificial Sequence
  derived and/or modified sequence opt3 from anti-HIV_cap256-059-109427_VR-Chain
caggugcaacuggucgagagcggcgggggaguugugcagcccgguagaucccucaggcuuucuugcgccgcuucacaguucaccuuuaguaacuacggcaugcacuggguacggcaggcaccugggaagggacuggaauggguggccagcaucuccuucgcgggcauuaaaaagcauuauacagacucugucaaaggucgcuuuacuauaucgcgagauaauucaaagaacacguuguucuuacaaaugaauagccugcgugcugaggacaccgcccuauacuauugugcaagagaucucagggaauacgagugcgaagagugggccagugacuauuacgauuuugggcgggaccagccaugucaggauccgcgcggagugguuggcacauccgacaucuggggccaggggacuaaagugaccgucucuagc

SEQ ID NO: 24947 - RNA, 432 nt, Artificial Sequence
  derived and/or modified sequence opt3 from anti-HIV_cap256-059-109081_VR-Chain
caggagcaacugguggaaagcggcgggggagucguucagcccgguagaucccucaggcuuucuugcgccgcuucacaguucaguuuuagcgcauacggcaugcacugggugcggcaggccccugggaagggacuggaguggguagcgggcaucuccuucgcugccaccaaaaaguauuacgaagacucugugaaaggucgcuuuacaauuucgcgagauaacucaaagaauacuuuguauuuacaaaugaacagccugcguggggaggacacggcacuauacuauugugccaaagauaugagagaaauggagugcgaggaaugggcuagugacuacuaugauuucggaaggccacagccgugucaggacccccggggcgucgugggcauauuugauaugugggggcagggaaccaugguuacaguguccucu

SEQ ID NO: 24948 - RNA, 432 nt, Artificial Sequence
  derived and/or modified sequence opt3 from anti-HIV_cap256-059-107590_VR-Chain
caggagcaacugguggaaagcggcgggggagucguucagcccgguagaucccucaggcuuucuugcgccgcuucacaguucaguaucagcgcauacggcaugcacugggugcggcaggccccugggaagggacuggaguggguagcgggcauuuccuuugcugguaccaaaaaguauuacgccgacucugugaaagggcgcuucacaauaucgcgagauaacucaaagaauacuuuguauuuacaaaugaacagccugcguggagaagacacggcacuauacuauugugccaaagauaugagagagauggaaugcgaggagugggcuagugacuacuaugauuuuggcagggaccagccaugucaggauccgcggggcgucguggggaucuucgacauguggggacaggguaccaugguuacaguguccucu

SEQ ID NO: 24949 - RNA, 435 nt, Artificial Sequence
  derived and/or modified sequence opt3 from anti-HIV_cap256-059-107504_VR-Chain
caggugcugcucgucgagagcggcgggggaguugugcaacccgguaagucccuucggcugucuugcucagccaguagguucaccuuuagcaacuacggcaugcacuggguacggcaggcuccugggaaaggauuggaauggguggcagccgucuccuucgcgggcaucaagaaaacaaaugcugacucugugaagggucgcuuuacuauuucgcgagauaacagcaaaaauacguuauaucugcagaugaacucacuacgugccgaggacaccgcacucuacuauugugccagagaucugagggacuucgaaugcgaggaaugggcuagugauuacuaugacuuuuggggagauccacagccgugucaagaccccagagggguugugggcacauucgaucuuuggggccaggggacuauggucaccguguccucu

SEQ ID NO: 24950 - RNA, 432 nt, Artificial Sequence
  derived and/or modified sequence opt3 from anti-HIV_cap256-059-099614_VR-Chain
gaggugcugcuccuugaaagcggcgggggacugguccagcccgguagauccuugagguuaucuugcgccgcuucacaauucaccuuuaguagcuacggcaugcacuggguucggcaggcaccugggaagggacuggaguggguggccggcaucuccuucguagguauuaaaaaguauuacgcggacucugugaaagggcgcuuuacaauaucgcgagauaacucaaagaauacucuauaucuccagaugaacagccugcgugcugaagacacggcccuuuacuauugugcaagagaucugagggaguacgaaugcgaggagugggccagugacuauuacgauuucggacgggaccagccaugucaagauccgcgcggcgucgugggcaccuuugacaucugggggcagggaacaaugguuacuguguccucu

SEQ ID NO: 24951 - RNA, 432 nt, Artificial Sequence
  derived and/or modified sequence opt3 from anti-HIV_cap256-059-098972_VR-Chain
caggugcaacuggucgagagcggcgggggaguugugcagcccgguagaucccucaggcuuucuugcgccgcuucacaguucaccuuuaguagcuacggcaugcacuggguacggcaggcaccugggaagggacuggaauggguggccuccaucucuuucgcgggcauuaaaaagaacuaucgcgacucggucaaaggucgauuuacaauaucacgugauaauagcaagaacacuuuguacuuacaaaugacgagucugagaccagaggacaccgcucuauauuacugugccaaagaucucaggggguucgaaugcgaggaaugggcauccgacuauuacgauuuuggacgggagcugccgugucaggacccccgcggcgugguuggcacauucgauaugugggggcagggaacuauggugaccgucucuagc

SEQ ID NO: 24952 - RNA, 432 nt, Artificial Sequence
  derived and/or modified sequence opt3 from anti-HIV_cap256-059-097236_VR-Chain
caggugcaacuggucgagagcggcgggggaguugugcagcccgguagaucccucaggcuuucuugcgccgcuucaggcuucaguuuuagcaacuucggguuucacuggguacggcaggcaccuggaaagggccuggaauggguggccgcgaucuccuucgucgguaauaaaaaguacuaugcugagucugugaaagggcgcuuuaccauuucgcgagaaaacucaaagaauauguuguucuuacagaugaacagccugcguggagaggacacagccguuuacuauugugcaaaagaucuaagagaauuugagugcgaggaaugggccagugacuacuaugauuucggcagggagcaaccaugucaggacccgcggggcguggucggguccauagauguguggggacaugguucucucguaacuguuagcucc

SEQ ID NO: 24953 - RNA, 432 nt, Artificial Sequence
  derived and/or modified sequence opt3 from anti-HIV_cap256-059-091487_VR-Chain
caggugcaacuggucgagagcggcgggggaguugugcagcccgguagaucccucaggcuuucuugcgccgcuucacaguucaccuuuaaccgguacggcaugcacuggguacgccaggcaccugggaagggacuggaauggguggccgucaucaguuaugacggcacaaauaaauacuauggugagagcgugaaggggcgauucacuauuucccgugauaacucuaaaaauacguuguacuuacaaaugaacucgcugagagcggaagacaccgcucuauauuacugugccaaggaucucagggaggacgaaugcgaggagugguggucagauuauuacgacuuuggacgggaacugccaugucgcaaaagcagaggcguugcaggcauauucgauaucugggggcagggaacaauggugacugucaguucc

SEQ ID NO: 24954 - RNA, 432 nt, Artificial Sequence
  derived and/or modified sequence opt3 from anti-HIV_cap256-059-089812_VR-Chain
caggugcaacuggucgagagcggcgggggaguugugcagcccgguagaucccucaggcuuucuugcgccgcuucacagcugaccuucaguagcuacggcaugcacuggguacggcaggcaccugggaagggauuggaauggguggccggcaucuccuuugcggguacuaaaaagcauuauucugacucggucaaagggcgcuucacaauuucacgagauaacagcaagaaugcuuuauaccugcaaaugaacagucuacgugccgaggacacggcacucuauuacugugccaaagaucugagagaauaugagugcgaagagugggcuuccgacuacuaugauuuuggaagggagcagccaugucaggacccgcggggcgugguuggcauauucgauaugugggggcagggaaccauggugacagucucuagc

SEQ ID NO: 24955 - RNA, 432 nt, Artificial Sequence
  derived and/or modified sequence opt3 from anti-HIV_cap256-059-088468_VR-Chain
caggugcaacuggucgagagcggcgggggaguugugcagcccgguagaucccucaggcuuucuugcgccgcuucacaguucaccuuuaguagcuacggcaugcacuggguacggcaggcaccugggaagggacuggaauggguggccgcgaucuccuucgucggcauuaaaaaguauuacgcuaacucugugaaaggucgcuuuacaauaucgcgagacaauucaaagaacacuuuguauuuacaaaugaauagccugcgugccgaggauacggcacuauacuauugugccagagaccucagggaauacgagugcgaagagugggcuagugauuauuacgacuucgggcggggaggcccaugucaggauccgcgcggcguugugggguccuuugacaucuggggacaggguaccauggucacagugucuagc

SEQ ID NO: 24956 - RNA, 432 nt, Artificial Sequence
  derived and/or modified sequence opt3 from anti-HIV_cap256-059-088341_VR-Chain
caggugcaacuggucgagagcggcgggggaguugugcagcccgguagaucccucaggcuuucuugcgccgcuucacaguucaccuuuaguagcuacggcaugcacuggguacggcaggcaccugggaagggacuggaauggguggccgcgaucuccuucgcuggcauuaaaaagcauuaugccgacucugucaaaggucgcuuuacaauaucgcgagauaacucaaagaauaugguguucuugcaaaugaacagcuuacgugcagaggacacugcccuguacuauugugcuagagaucuaagggaauacgagugcgaagagugggcaagugacuauuacgauuuugggcgggaccagccaugucaggauccgcgcggaguugugggcacguccgacaucuggggccaggggaccauggucacagugucuagc

SEQ ID NO: 24957 - RNA, 432 nt, Artificial Sequence
  derived and/or modified sequence opt3 from anti-HIV_cap256-059-086533_VR-Chain
caggugcugcucgucgagagcggcgggggaguugugcaacccgguagaucccuuaggcugucuugcgccgcuucacaguucaccuuuaguaauuucggcaugcacuggguacggcaggcaccugggaagggauuggaauggguggccggcaucagcuuugucgguauuaaaaaguacuaugcgggguccgugaaaggacgcuucacaauaucucgagacaauucgaagaacacuuuauaccugcagaugaacucacuacgugcugaggauacggcccucuauuacugugcaaaagaccugagagaauuugagugcgaagagugggccagcgauuauuacgacuucggcaggccacaaccgugucaggauccccggggcguuguggggaccuuugaccuuuggggacuggguacauuggucacugugaguucc

SEQ ID NO: 24958 - RNA, 432 nt, Artificial Sequence
  derived and/or modified sequence opt3 from anti-HIV_cap256-059-086043_VR-Chain
gaggugcaccuggucgaaagcggcgggggacucguuaagcccgguggcucccuuagacugucuugcgccgcuucaggguucaccuuuaguacauacagcaugaacugggugaggcaggcaccuggaaaaggcuuggaguggguagccuucguggcguuugacgaauccgauaaguauuacgcugacucugucaaaggucgguucacuaucucgcgcgauaauucaaagaacacguuaagccugcaaaugaauagucuacgaguggaggacaccgccauuuauuacugugcaaaagaaguuggggauaacaaggacgaugagugggccuccgacuauuacgaucucucuauagcuuauccaauccaggacccgcgugcagugggaagaggcuacgauauuuggggccaggggacaauggucacugugagcucc

SEQ ID NO: 24959 - RNA, 432 nt, Artificial Sequence
  derived and/or modified sequence opt3 from anti-HIV_cap256-059-084191_VR-Chain
caggugcaacuggucgagagcggcgggggaguugugcagcccgguagaucccucaggcuuucuugcgccgcuucacaguucaccuuuaguagcuacggcaugcacuggguacggcaggcaccugggaagggacuggaauggguggccgcgaucuccuucgucggcauuaaaaaguauuacgcugacucugugaaaggucgcuuuacaguuucgcgagauaacucaaagagcacuuuguauuuacaaaugaauagucugcgugccgaggacacggcacuauacuauugugccagagaucucagggaauacgagugcgaagagugggcuuccgacuauuacgauuucgggcgggaccagccaugucaggauccgcgcggaguggucggcauauuugacaucuggggccaggggaccgcagugacaguaucuagc

SEQ ID NO: 24960 - RNA, 417 nt, Artificial Sequence
  derived and/or modified sequence opt3 from anti-HIV_cap256-059-082135_VR-Chain
caggugcaacuggucgagagcggcgggggaguugugcagcccgguagaucccucaggcuuucuugcaccgccucaggcuucacauuucggaguuacgcuauccacuggguacgccaggcaccugggaagggacuggaauggguggccuugauuagcuaugacggcuccaacaaauacuaugcggauucugucaagggucgauucacuauaucgcgugacaauucaaagaacacguuauaccugcagaugaauagccuaaccagugaggauacagcuguguauuacugugccaaagaccucgggggauccaaaacugaugaauggggcaccgacuauugcuacccaguucaagauccgagaguggucgugggcgcauuugacaucugggggcauggaacaaugguaaccguuucuagc

SEQ ID NO: 24961 - RNA, 432 nt, Artificial Sequence
  derived and/or modified sequence opt3 from anti-HIV_cap256-059-079417_VR-Chain
caggugcaacuggucgagagcggcgggggaguugugcagcccgguagaucccucaggcuuucuugcgccgcuucaggcuucaguuuuagcaacuacgcaauggacuggguacggcaggccccugggaagggacuggaauggguggcguucgucuccucugauggcaauaacaaaaaguaugcugacucggugaaaggucgcuuuaccuugucacgagauaauuacaagaacacaguuuauuuacagaugaauagccugacuguggaggacacggccgucuacuauugugcaaaagaucuaggggccaacaaggacgaugaauggggaaccgacuacuaugauaugaguguguccuacccaaucccggacccccgugcuguaguuggcgcauucgauguguggggccaagggacacucgucacugugucuagc

SEQ ID NO: 24962 - RNA, 435 nt, Artificial Sequence
  derived and/or modified sequence opt3 from anti-HIV_cap256-059-076027_VR-Chain
caggugcaacuggucgagagcggcgggggaguugugcagcccgguagaucccucaggcuuucuugcgccgcuucaggcuucaguuuuagcaaguacgggaugcacuggguacggcaggcaccuggaaaaggccuggaauggguggccuucgucgcguuugacgaguccgaaaaguauuacgcugccucugugaaaggucgcuucaccaucucgcgagauaacucaaagaauacauugagcuuacagaugaacagucugcguacugaggacacggcaauuuauuacugugccaaagaaguuggggauaauaaggacgaugaguggaccuccccauauuacuaugacauaucuaucgcuuacccggugcaugaucccagagcagucgugggaguaagcgacguuuggggccaaggcacaauggugacugucuccuca

SEQ ID NO: 24963 - RNA, 432 nt, Artificial Sequence
  derived and/or modified sequence opt3 from anti-HIV_cap256-059-075082_VR-Chain
caggugcaacuggucgagagcggcgggggaguugugcagcccgguagaucccucaggcuuucuugcgccgcuucacaguucaccuuuaguagcuacggcaugcacuggguacggcaggcaccugggaagggacuggaauggguggccgcgaucuccuucgucggcauuaaaaaguauuacgcugacucugugaaaggucgcuuuacaauaucgcgagauaacucaaagaauacuuuguauuuacaaaugaacagccugcgugccgaggacacggcacuauacuauugugccaaagaucucagagaaauggagugcgaagagugggcuagugacuacuaugauuucgggagggaccugccaugucaggauccgcggggaguugugggcacccuugacaucuggggccaggggacaauggucacuguguccucu

SEQ ID NO: 24964 - RNA, 432 nt, Artificial Sequence
  derived and/or modified sequence opt3 from anti-HIV_cap256-059-072575_VR-Chain
cagggccaacugguggagagcgggggaggugucguucagcccggcagaucccucaggcuuucuugcgccgcuucacaguucaccuuuaguaauuucgggaugcacugggugcggcaggcaccuggaaagggccuggaauggguagccgugaucagcuacgacgguacuaaaaaguauuacgcggauuccgucaaagggcgcuuuacaauuucucgagacaauucgaagaacacguuguauuuacaaaugaacucacugcgugcugaggauaccgcccuauacuauugugcaaaagacaugagagaagaugagugcgaagaguggggagccgacuacuaugauuucggcaaggacuacccaugucaggcuagcaggggcgugguugggauauuugauaucuggggacaggguacaauggugacugucagugca

SEQ ID NO: 24965 - RNA, 432 nt, Artificial Sequence
  derived and/or modified sequence opt3 from anti-HIV_cap256-059-071926_VR-Chain
caggugcaacuggucgagagcggcgggggaguugugcagcccgguagaucccucaggcuuucuugcgccgcuucacagcugaguuucagcaacuacggcaugcacuggguacggcaggcaccugggaagggauuggaauggguggccggcaucuccuuugucgguauuaaaaaguauuaccgcgacucugugaaagggcgauucaccauaucgcgugauaauucaaagaacacauuauaucugcaaaugaauagccuaagaacugaggacacggcgcucuacuauuguguuaaagaucugagggaauuugagugcgaagagugggcuagugacuacuaugauuucggacgggaccagccaugucuugauccgcgcggcguggucggcaccuuugacaucugggggcagggaacaauggugacuguauccucu

SEQ ID NO: 24966 - RNA, 432 nt, Artificial Sequence
  derived and/or modified sequence opt3 from anti-HIV_cap256-059-069638_VR-Chain
caggugcaacuggucgagagcggcgggggaguugugcagcccgguagaucccucaggcuuucuugcgccgcuucaggcuucaccuuuaguaagaacgcaaugcacuggguacggcaggccccugggcgcggacuggaauggguggcgagcgucgcuuucgacggcuccgauaaauacuaugccgacucugugaagggucgauuuacaaucucgcgugauaauagcaaaaacacuuugucauuacagaugaauagucugagagcagaggacacggccguuuacuauugugcuaaggaaguggaucuauacaaagacgaugaguggggguccgacuauuacgaucucucuauugcauauccaauacaagacccgagggccgucgugggaggcuucggcaucugggggcagggaaccaugguaacaguuagcucc

SEQ ID NO: 24967 - RNA, 432 nt, Artificial Sequence
  derived and/or modified sequence opt3 from anti-HIV_cap256-059-069165_VR-Chain
cuggugcagcucgucgagagcggcgggggaguugugcaacccgguagaucccuuaggcugucuugcgccgcuucacgguucaccuuuaguaauuacggcaugcacuggguacgccaggcaccugggaagggauuggaauggguggccggcaucagcuucgcggguacaacuaaauauuacgcugacuccguccgagggcguuuuacgauuucuagagauaauucgaagaacaccuuauaucugcagaugaacucacuaagggccgaggacacagcacucuacuauugugccaaagauaugcgggaaauggagugcgaagagugggcuagcgacuacuaugauuucggacgcccacagccgugucaagaccccagaggcgugguuggcauauuugauaucugggggcagggaacuauggugaccgucaguucc

SEQ ID NO: 24968 - RNA, 432 nt, Artificial Sequence
  derived and/or modified sequence opt3 from anti-HIV_cap256-059-068956_VR-Chain
caggugcaacuggucgagagcggcgggggaguugugcagcccgguagaucccucaggcuuucuugcgccgcuucaggcuucaccuuuaguacauacgcaaugcacuggguacggcaggccccugggcgcggacuggaauggguggcguugaucagcuaugacggcuccaacaaguacuaugucgauucugugaaaggucgauucacuauuucgcgugacaauucaaagaacacguuauaccugcagaugaauagccuaaccgcugaggauacagccguuuauuacugugcaaaagaccucgggggaaguaaggaugacgaaugggccacugauuauuacgaccuguccauagcuuacccaauccaagauccgagagcaguggccggcauuuuugacgucuggggcagggggaccgugguaacaguuucuagc

SEQ ID NO: 24969 - RNA, 432 nt, Artificial Sequence
  derived and/or modified sequence opt3 from anti-HIV_cap256-059-068876_VR-Chain
caggugcaacuggucgagagcggcgggggaguugugcagcccgguagaucccucaggcuuucuugcgccgcuucacaguucaccuuuaguagcuacggcaugcacuggguacggcaggcaccugggaagggacuggaauggguggccgcgaucuccuucgcuggcacuaaaaaguauuacgccaacucugucaaaggucgcuuuacaauuucgcgagacaauucaaagaacacguugagcuuacaaaugaauagucugcguggggaggauaccgcaagauauuacugugccagggacccacgggaauaugagugcgaagagugggcuuccgauuacuaugacuucggacgcgaucagccgugucaggaccccagaggcgugauaggcaucuuugauauuugggggcagggaacaaugguuacugugucuagc

SEQ ID NO: 24970 - RNA, 432 nt, Artificial Sequence
  derived and/or modified sequence opt3 from anti-HIV_cap256-059-067733_VR-Chain
caggugcaacuggucgagagcggcgggggaguugugcagcccgguagaucccucaggcuuucuugcaccgccucacaguucaguuuuagcuccuacggcaugcacuggguacggcaggcuccugggaagggacuggaauggguggcagccaucucuuucgcgggcacuaaaaagaacuaugucgacucggugaaaggucgcuuuacaauuucacgagauaauagcaagaacacguuguacuuacaaaugaauagucugcgugcugacgauaccgcccuauauuacugugcaaaagacaugagagaguaugaaugcgaggaaugggccuccgauuacuaugacuucgggagggaguacccauguacagauccgcggggaguugugggcacuuuugacgucuggggccaggggaccauggugacaguaucuagc

SEQ ID NO: 24971 - RNA, 432 nt, Artificial Sequence
  derived and/or modified sequence opt3 from anti-HIV_cap256-059-067450_VR-Chain
caggugcaacuggucgagagcggcgggggaguugugcagcccgguagaucccucaggcuuucuugcgccgcuucacaguucaccuuuaguaauuacggcaugcacuggguacggcaggcaccugggaagggacuggaauggguggccggcaucagcuucgcggguauuaaaaaguauuacgcugacuccgucaaagggcgcuuuacaauaucucgagauaaugccaagaacacuuuguauuuacaaaugaacucgcugcgugcagaggacacggcccuauacuauugugcuaaagaucucagagaauacgagugcgaagagugggcaucagacuauuacgauuucggaagggagcugccaugucaggacccgcggggcgugguuggcaccuuugauaucugggggcagggaacaauggugacugucagcagu

SEQ ID NO: 24972 - RNA, 432 nt, Artificial Sequence
  derived and/or modified sequence opt3 from anti-HIV_cap256-059-065694_VR-Chain
caggugcaacuggucgagagcggcgggggaguugugcagcccgguagaucccucaggcuuucuugcgccgcuucacagcugaccuucaacaauuacggcaugcacuggguacggcagacaccugggaagggauuggaauggguggcaggcaucaguuuugccgguauuaacaaauauuacgcggacagcgucaaggggcgcuucacuauaucccgagauaauucuaaaaacgcuuuauaucugcaaaugacgucgcuacgugccgaggacaccgcacucuacuauugugugaaggaucugagagaaauggagugcgaagagugggccucagacuacuaugauuuuggaagggaccagccaugucaggauccgcggggcguugugggcacauucgacaucugggggcagggaacuauggucaccgugagcagu

SEQ ID NO: 24973 - RNA, 432 nt, Artificial Sequence
  derived and/or modified sequence opt3 from anti-HIV_cap256-059-065109_VR-Chain
caggugcaacuggucgagagcggcgggggaguugugcagcccgguaagucccucagacuuucuugcgccgcuucaggcuucaccuuuacaaacaaugcaaugaacuggguaaggcaggccccugggaaaggacuggaauggguggcguucgucaguagcgacggccggaauaagaacuacgcugauuccgugaaaggucgcuuuacuaucucucgagacaauucgaagaacacgguuuauuugcagaugaacucauuacguguggaggauaccgcccuguacuauugugcaaaagaccuaggggccaauaaggaugacgaaugggcuacagauuacuaugaccucagcgucgcauacccaauuccggaucccagagccgugguaggagcuuucgacguuuggggccaaggcacuauggugaccgucaguucc

SEQ ID NO: 24974 - RNA, 432 nt, Artificial Sequence
  derived and/or modified sequence opt3 from anti-HIV_cap256-059-065060_VR-Chain
caggugcaacuggucgagagcggcgggggaguugugcagcccgguaccucccucagacuuucuugcgccgcuucaggcuucacauuuaguaacuacgcaaugggguggguaaggcaggccccuggaaagggccuggaauggguggcggucgugagcuaugacgguuccaaaaagucuuacgcugauucgguuaaagggcgguucacuaucucacgcgacaauagccgaaacacguuguauuuacagcugaauagucuacgugccgaggauaccgcaauguuuuacugugccaaggaccucggaaaaggcgaaauugaggaaugggcuacagauuauuacgacugguccaaggcauauccaauagagggcccgagagauguggucggggccuucgacacuuggggacaagguacccuggugacaguaucuagc

SEQ ID NO: 24975 - RNA, 432 nt, Artificial Sequence
  derived and/or modified sequence opt3 from anti-HIV_cap256-059-064001_VR-Chain
caggugcaacuggucgagagcggcgggggaguugugcagcccgguagaucccucaggcuuucuugcgccgcuucacaguucaccuuuaguaacuacggcaugcacuggguacggcaggcaccugggaagggacuggaauggguggccggcaucagcuucgcggguacuaaaaauuauuacgcuaaguccgucaaagggcgcuuuacaauuucucgagacaacucgaagaaugccuuguauuuacaaaugaacucacugcgugcagaggauacggcccuauacuauugugcuaaagacaugagagaauacgagugcgaagagugggcaagcgauuauuacgacuucggaagggaucagccaugucaggacccgcggggcgugguuggcaccuuugauauaugggggcagggaacaaugguggccgucaguucc

SEQ ID NO: 24976 - RNA, 432 nt, Artificial Sequence
  derived and/or modified sequence opt3 from anti-HIV_cap256-059-063270_VR-Chain
caggugcaacuggucgagagcggcgggggaguugugcagcccgguagaucccucaggcuuucuugcgccgcuucacaguucaccuuuaguaauuacggcaugcacuggguacggcaggcaccugggaagggacuggaauggguggccgcgaucagcuucgcuggcacuaaaaagcauuaugccgacuccgucaaaggucgcuuuacaauuucucgagauaauucgaagaacgcauuguacuuacaaaugaacucacugcgugccgaggacacggcucuauauuacugugcaaaagaucucagagaauaugagugcgaagagugggccagcgacuacuaugauuucgggagggaccagccaugucuggauccgcggggagugguuggcauauuugacaucuggggccaggggacccuugugacagucaguucc

SEQ ID NO: 24977 - RNA, 432 nt, Artificial Sequence
  derived and/or modified sequence opt3 from anti-HIV_cap256-059-061357_VR-Chain
caggugcaacuggucgagagcggcgggggaguugugcagcccggucggucccucaggcuuucuugcgccgcuucaggcuucaccuuuaguaauuucggguuucacuggguacggcaggcaccuggaaagggccuggaauggguggccgguaucagcuucgcggggacaaaaauuuacuaugcugacuccgucaagggacgcuuuacuauaucucgagaaaauucgaaaaacauguuguacuuacagaugaacucacugcguggcgaggauacggccguguauuucugugcaaaggaccuaagagaguuugaaugcgaggagugggccagcgauuacuaugacuucggcagggaauuuccaugucaagauccgagagggguugugggaaccuucgacgucuggggucauggcgcugugguaacaguuaguucc

SEQ ID NO: 24978 - RNA, 435 nt, Artificial Sequence
  derived and/or modified sequence opt3 from anti-HIV_cap256-059-059834_VR-Chain
caggugcaacuggucgagagcggcgggggaguugugcagcccgguagaucccucaggcuuucuugcgccgcuucaggcuucaccuuuaguaacuucgggaugcacuggguacggcaggcaccuggaaagggccuggaauggguggccuuugucgcguucgacgagagcgauaaauacuaugcugccuccgugaagggucgcuuuacaguuucucgagacaauucgaaaaacacugugucauugcagaugaauagcuuacguacggaagauaccgcagucuacuauugugccaaggaggugggggacaacaaagaugacgaauggacaaguccauacuauuacgauuucuccaucgcuuauccgguacaugaccccagagcaguugugggaggcuacgaugucuggggccaagggacuauggugaccgugucuagc

SEQ ID NO: 24979 - RNA, 432 nt, Artificial Sequence
  derived and/or modified sequence opt3 from anti-HIV_cap256-059-059313_VR-Chain
caggugcaccuggucgagagcggcgggggaguugugcaacccgguaagucccucagacuuucuugcgccgcuucacaguucaccuuuaguaauuucggcaugcauuggguaaggcaggcaccugggaaaggacuggaauggguggccggcaucagcuuugcggguacaaagaaauacuaugcugacuccgucaaggggcgguucacuauuucucgcgauaauucgaaaaacacguuguacuuacagaugaacucagugcgagccgaggacaccgcacuguauuacugugccaaggauaugcgugaauaugagugcgaagagugggcuagcgacuacuaugauuuuggaaagccacaaccgugucaggaccccagaggcguugugggcacauucgauaugugggggcuaggaacucucgucaccgugaguucc

SEQ ID NO: 24980 - RNA, 432 nt, Artificial Sequence
  derived and/or modified sequence opt3 from anti-HIV_cap256-059-057130_VR-Chain
caggugcaacuggucgagagcggcgggggaguugugcagcccgguagaucccucaggcuuucuugcgccgcuucacaguucaguuuuagcuccuacggcaugcacuggguacggcaggcaccugggaagggacuggaauggguggccgcgaucucuuucgcuggcauuaaaaagcauuaugccgacucggucaaaggucgcuuuaccauaucacgagauaacagcaagaauacauuguacuuacaaaugaacagucugcguguggaggacacugcacuauauuacugugccaaagaucucagagaauaugagugcgaagagugggcuuccgacuacuaugauuucgggaggccacagccgugucaggacccccggggaguugugggcacgucugauaucuggggccaggggaccauggucacagugagcucc

SEQ ID NO: 24981 - RNA, 411 nt, Artificial Sequence
  derived and/or modified sequence opt3 from anti-HIV_cap256-059-050520_VR-Chain
caggugcaacuggucgagagcggcgggggaguugugcagcccgguagaucccucaggcuuucuugcgccgcuucacaguucaccuuuaaucgguacggcaugcacuggguacgccaggcaccugggaagggacuggaauggguggccgucaucaguuaugcggacagcgugaaaggccgauucacaauuucccgugauaauucuaagaacacuuuguacuuacaaaugaacucgcugagagcugaggacacggcccuauauuacugugcaaaagaucucagggaagacgagugcgaagagugguggucagauuauuacgacuuuggucgggagcugccaugucgcaagagcagagggguugccggaauauucgauaucuggggccagggcaccauggugacagucaguucc

SEQ ID NO: 24982 - RNA, 432 nt, Artificial Sequence
  derived and/or modified sequence opt3 from anti-HIV_cap256-059-049839_VR-Chain
caggugcaacuggucgagagcggcgggggaguugugcagcccgguagaucccucaggcuuucuugcgccgcuucaggcuucaguuuuagcaacuacgcaauggacuggguacggcaggccccugggaagggacuggaauggguggcggucguguccucugauggcaaaaccaagaauuaugcugacucgguuaaaggucgcuucacaaucucacgagauaacagcaagaauacuguguacuugcagaugaacaguuuacguccagaggacacggccgucuauuacugugcaaaagaucugggggccaauaaggacgaugaauggaccacagacuauuacgauugguccguggcuuauccgguacccgacccuagagcaguugugggagccuuugaugucuggggccaaggcacuauggugaccgugucuagc

SEQ ID NO: 24983 - RNA, 432 nt, Artificial Sequence
  derived and/or modified sequence opt3 from anti-HIV_cap256-059-048503_VR-Chain
caggugcaacuggucgagagcggcgggggaguugugcagcccgguagaucccucaggcuuucuugcgccgcuucacagcugaguuucagcaacuacggcaugcacuggguacggcaggcaccugggaagggauuggaauggguggccggcaccuccuuugcggguacuaaaaaguauuacgcugacucugucaaagggcgcuucacaaucucgcgagauaauucaaagaacgccuuauaucugcaaaugaauagccuacgugcagaggacacggcccucuacuauugugcuaaagaucugagagaauacgagugcgaagagugggcaagugacuauuacgauuuuggaagggaccagccaugucaggauccgcggggcgugguuggcaccuucgacauuugggggcagggaacaauggugacugucuccgcc

SEQ ID NO: 24984 - RNA, 432 nt, Artificial Sequence
  derived and/or modified sequence opt3 from anti-HIV_cap256-059-045516_VR-Chain
caggugcaacuggucgagagcggcgggggaguugugcagcccgguagaucccucaggcuuucuugcgccgcuucacaguucaccuuuaguggcuacgggaugcacuggguacggcaggcaccuggaaagggccuggaauggguggccgcgaucagcuucgcugguaauaaacgcuauuuugccgacuccgucaaggggcgauucacaauuucucgugauaauucgaaaaacacuuuguuuuuacaaaugaacucacugagagcagaggacacggcccuauacuauugugcuagggauaugcgggaauacgagugcgaagagugggcaagcgacuauuacgauuucggacgcccacagccgugucaggaccccagaggcgugguuggcguguuugauauaugggggcagggaaccauggucacagugaguucc

SEQ ID NO: 24985 - RNA, 432 nt, Artificial Sequence
  derived and/or modified sequence opt3 from anti-HIV_cap256-059-044188_VR-Chain
caggugcaccuggucgagagcggcgggggaguugugcaacccgguagaucccucaggcuuucuugcgccgcuucacaguucaccuuuaguagcuacggcaugcauuggguacggcaggcaccugggaaaggacuggaauggguggccggcaucuccuucgcggguacaaacaaauauuacgcugacucugucaaggggcgcuuuacugugucgcgagauaauucaaagaacacguuguauguucagaugaauagcuuacgugccgaggacaccgcacuguacuauugugccagagaucuaagggaauacgagugcgaagagugggcuagugacuauuacgauuucggacgggagcaaccaugucaggacccgcgcggcguggucggcauuuuugauauaugggggcccggaacaauggugacuguauccucu

SEQ ID NO: 24986 - RNA, 435 nt, Artificial Sequence
  derived and/or modified sequence opt3 from anti-HIV_cap256-059-044105_VR-Chain
cagggccaacugguggagagcgggggaggugucguucagcccggcagaucccucucucuuucaugcgccgcuaguggguucagcuuuaacaauuacgcaauggacugggugaggcaggccccuggaaagggccuggaauggguagcgguggucuccucugaugguaacaauaaaaacuaugcugacucggugaaggggcgguucaccaucucacgcgauaauagcaaaaacacaguuuacuugcagaugaauaguuuacgagccgaggacacugcaauuuauuacugugccaaggaugugggagcuaacaaagacgaugaaugggcaacgaauuauuacuaugacugguccgucgccuacccagugccggauccccgugcuguaauaggcgccuuugacguuuggggccaagggaccauggugacagucucuagc

SEQ ID NO: 24987 - RNA, 432 nt, Artificial Sequence
  derived and/or modified sequence opt3 from anti-HIV_cap256-059-042100_VR-Chain
caggugcaacuggucgagagcggcgggggaguugugcagcccgguagaucccagaggcucucuugcgccgcuucacaguucaccuuuaguagcuacggcaugcacuggguacggcaagcaccugggaaaggacuugaauggguggccgcgaucuccuucgcuggcacaaacaaauauuacggugacucugucaaggggcgcuuuacuauuucgcgagauaauucaaagaacacgcuguauuugcagaugaauagcuuacgugccgaggacaccgcacuguaccauugugccagagauaugagggaauaugagugcgaagagugggcuagugacuacuaugauuucggacgggaccagccaugucaggauccgcgcggcgugguuggcauauuugaccuaugggggcaaggaacaauggugacugucuccucu

SEQ ID NO: 24988 - RNA, 432 nt, Artificial Sequence
  derived and/or modified sequence opt3 from anti-HIV_cap256-059-040742_VR-Chain
caggugcaacuggucgagaccggcgggggaguuggucagcccggcaagagccucagacuuuccugcgccgcuucuggguucacauuuucaaacuucgcaauggacugggugaggcaggccccuggaaaaggccuggaauggguagcguuuaucaguagcgaugguauuaauaagaaauacggggacuucgugaagggacgguuuacuauaucccgcgauaacucuaaaaauacguuguucuuacagaugaacucgcugcgagcugaggacaccgcccuauauuacugugcaaaggaugucggcgacuauaagucagaugaauggggcacagacuacuaugaucucagcaucgaguacccaauucaagacccgcgugccgugguuggggcuuuugauaauuggggacaggguacuauggugaucgucaguucc

SEQ ID NO: 24989 - RNA, 432 nt, Artificial Sequence
  derived and/or modified sequence opt3 from anti-HIV_cap256-059-040554_VR-Chain
caggugcaacuggucgagagcggcgggggaguugugcagcccgguagaucccucaggcuuucuugcgccgcuucacaguucaccuuuaguagcuacggcaugcacuggguacggcaggcaccugggaagggacuggaauggguggccggcaucuccuucgcggcuacaaacaaauauuacggugggucugucaagggacgcuuuacuauuucgcgagacaauucaaagaacacguuguauuuacaaaugaauagccugcgugccgaggauaccgcacuauacuauuguacaagagacaugagggaauacgagugcgaagagugggccagugauuauuacgacuucggcaaagaucagccaugucaggacccgcggggcgugguugggacucucgauauauggggacaggguaccauggugacagucuccucu

SEQ ID NO: 24990 - RNA, 432 nt, Artificial Sequence
  derived and/or modified sequence opt3 from anti-HIV_cap256-059-039660_VR-Chain
caggugcaacuggucgagagcggcgggggaguugugcagcccgguagaucccucaggcuuucuugcgccgcuucacaguucaguuuuagcaacuacggcaugcacuggguacggcaggcaccugggaagggacuggaauggguggccuccaucucuuucgcgggcaccaaaaagaaauaugcugacucggucaagggucgcuuuacaauuucacgagauaauagcaaaaacacuuuguucuuacaaaugaauagucugcguacggaggacgccgcacuauacuauugugccaaggauaugagagaauuugagugcgaagagugggcuuccgacuacuaugauuucgggagggagcagccaugucaggacacccgggaugugguuggaauauuugacaucuggggccagggcacaauggugacugucucuagc

SEQ ID NO: 24991 - RNA, 435 nt, Artificial Sequence
  derived and/or modified sequence opt3 from anti-HIV_cap256-059-039298_VR-Chain
caggugcaacuggucgagagcggcgggggaguugugcagcccgguagaucccucaggcuuucuugcgccgcuucaggcuucaccuuuaguaaguacgggaugcacuggguacggcaggcaccuggaaaaggccuggaauggguggccuucgucgcguuugacgagagcgauaaguauuacgcugccuccgcaaaaggucgcuucaucauuucucgagacaacucgaagaauacauugucauuacagaugaacagccugcguacugaagauacggccguguauuacugugcuaaagagguuggggacaauaaggaugacgaauggaccaguccauauuacuaugauauauccaucgcauacccggugcaagaccccagagccgucgugggaggcuacgauguauggggccaggggacaaugguuacugugucuagc

SEQ ID NO: 24992 - RNA, 432 nt, Artificial Sequence
  derived and/or modified sequence opt3 from anti-HIV_cap256-059-037873_VR-Chain
caggugcaacuggucgagagcggcgggggaguugugcagcccgguagaucccucaggcuuucuugcgccgcuucacaguucaccuuuaguaacuacggcaugcacuggguacggcaggcaccugggaagggacuggaauggguggccgcgaucagcuucgcuggcauuaauaaauauuacgccgacuccgucaagggucgcuuuacauugucucgagauaacacuaaaaauacguuauaucugcaaaugaacucgcuacgugcagaggacaccgcccucuacuauugugcuagagaucugagggaauacgagugcgaagagugggcaucagacuauuacgauuucgggcggccacagccgugucaggacccccgcggagugguuggcacaagcgauauauggggccaggggacuauggugaccgucaguucc

SEQ ID NO: 24993 - RNA, 432 nt, Artificial Sequence
  derived and/or modified sequence opt3 from anti-HIV_cap256-059-037633_VR-Chain
caggugcaacuggucgagagcggcgggggaguugugcagcccgguagaucccucaggcuuucuugcgccgcuucacaguucaccuuuaguaacuucggcaugcacuggguacggcaggcaccugggaagggacuggaauggguggccgcgaucagcuuugcuggcauuaauaaaaacuacgccgacuccgucaagggucgcuucacaauaucucgagauaauucgaaaaacacuuugcauuuacaacuaaauucacugcgugcagaggacacggcccucuauuacugugcuaaggaucugagagaauaugagugcgaagagugggcaagcgacuacuaugauuuugggagggaccagccaugucaggauccgcggggagugguuggcaccuucgacaucuggggccaggggacaauggugacugucaguucc

SEQ ID NO: 24994 - RNA, 432 nt, Artificial Sequence
  derived and/or modified sequence opt3 from anti-HIV_cap256-059-036817_VR-Chain
caggugcaacugcucgagagcggcgggggagucguucagcccgguagaucccuuaggcugucuugcgaagccucacaguucaccuuuaguaacuucggcaugcacugggugcggcaggcuccugggaagggauuggaguggguagcagccaucagcuuugcgggcauuaaaaagaauuacgcugacuccgugaaaggucgcuucacaauaucucgagauaacucgaagaauacuuuauaucugcaaaugaacucacuacgugucgaagacacggcccucuacuauugugcaaaagaucugagagaguacgaaugcgaggagugggccagcgacuauuacgauuuugggagggaacagccaugucaggacccgcggggagugaucggcaccuucgauauuuggggccaggggacaaugguuacugugaguucc

SEQ ID NO: 24995 - RNA, 432 nt, Artificial Sequence
  derived and/or modified sequence opt3 from anti-HIV_cap256-059-032787_VR-Chain
caggugcaacuggucgagagcggcgggggaguugugcagcccgguagaucccucaggcuuucuugcgccgcuucaggcuucaccuuuaguaaguacgcaaugcacuggguacggcaggccccugggaaaggacuggaauggguggcguucgucgcuuuugacgagagcgauaaguauuacguggacuccguuaaaggccgcuucacaaucucucgagauaacucgaagaauacuuugucauuacagaugaacagccugcgugccgaagacacggcaguguauuacugugccaaagagguccaugugaauaaggaugacgaaugggcuagugauuauuacgaccuauccauugcauauccaauacaagauccgagagccguaguuggugggcucgacaucuggggacagggcaccauggugacagucucuagc

SEQ ID NO: 24996 - RNA, 432 nt, Artificial Sequence
  derived and/or modified sequence opt3 from anti-HIV_cap256-059-032427_VR-Chain
caggugcaacuggucgagagcggcgggggaguugugcagcccgguagaucccucaggcuuucuugcgccgcuucacaguucaccuuuaguaauuucggcaugcacuggguacggcaggcaccugggaagggacuggaauggguggccggcaucagcuuuccagguacuaaaaaguacuaugcggacuccgucaaagggcgcuucacaauuucucgagauaauucgaagaacgcuuuguacuuacaaaugaacucacugcgugccgaggacacggcacuauauuacugugccagagaucucagggaauaugagugcgaagagugggcuagcgacuacuaugauuuuggaaaaccgcagcccugucuggacccucggggcgugguuggcaccuucgauauaugggggcagggaacaauggugacugucaguucc

SEQ ID NO: 24997 - RNA, 435 nt, Artificial Sequence
  derived and/or modified sequence opt3 from anti-HIV_cap256-059-029390_VR-Chain
caggugcaacuggucgagagcggcgggggaguugugcagcccgguagaucccucaggcuuucuugcgccgcuucaggcuucaccuuuaaccagcacgggaugcauuggguacggcaggcaccugacaagggacuggaauggguggccuucgucggcuuugaugagagugaaaaauacuaugcggacagcgugaagggucgcuucacaaucucccgagauaauucuaaaaacacuuugucguuacaaaugaacucacugcguccagaggacacggcuguuuacuauugugccaaggaagugggggauaauaaagaggacgagugggcaagcgauuacuauuacgaccuaaguaaugccuauccgauucacgaucccagagcugucgugggaggcuacgacauauggggccaggggaccaugguaacaguuugcucc

SEQ ID NO: 24998 - RNA, 435 nt, Artificial Sequence
  derived and/or modified sequence opt3 from anti-HIV_cap256-059-027877_VR-Chain
caggugcaacuggucgagagcggcgggggaguugugcagcccgguagaucccucaggcuuucuugcucagccagugcuuucagcuuuuccuacuucgcaauggacuggguacggcaggccccuggcaaggggcuggaauggguggcguuugucucuucggauggaaacaauaaaaacuaugcugacucagugaagggccgcuucaccaucagccgagauaauaguaaaaacacaguguuuuugcagauggacuccuuacguccagaggauacugccguuuacuauugugcaaaggaccugggugggaauaaagaugacgaauggucuacgaacuacuauuacgauauuagcauagccgacccgguccccgauccuagagcuguggcaggagccuucgacguauggggccaaggcaccaugguuacaguguccuca

SEQ ID NO: 24999 - RNA, 435 nt, Artificial Sequence
  derived and/or modified sequence opt3 from anti-HIV_cap256-059-026640_VR-Chain
caggugcaacuggucgagagcggcgggggaguugugcagcccgguagaucccucaggcuuucuugcgccgcuucaggcuucaguuuuagcaaguacgggaugcacuggguacggcaggcaccuggaaaaggccuggaauggguggccuucgucgcguuugacgaguccgaucgcuauuacgcugccucugugaagggucgauucaccaucucgcgugacaacagcaaaaauacauugucauuacagaugaacagucugagaacugaagauacggcaauuuauuacugugccaaggagguuggggacaauaaagaugacgaauggaccuccccauauuacuaugauaugucuauagcuuacccggugcaagaccccagggcagucgugggaggcuacgauaucuggggccaggggacaaugguaacuguuagcucc

SEQ ID NO: 25000 - RNA, 432 nt, Artificial Sequence
  derived and/or modified sequence opt3 from anti-HIV_cap256-059-026017_VR-Chain
caggugcaacuggucgagagcggcgggggaguugugcagcccgguagaucccucaggcuuucuugcgccgcuucaggcuucaccuuuaguacauacgcaaugcacuggguacggcaggccccugggaagggacuggaauggguggcguugaucagcuaugacggcacuaauaaauacuaugucgauuccgcuaagggucgcuucacgauuucucgagacaauucgaaaaacaccuuauaccugcagaugaacucacuaacaccagaggauacugccguguuuuauugugcaaaggaccucgggggauacaaagaugacgaauggggcaccgaguauuacgauauaagcguuaguuacccggugcaagacccccgugccgucgcuggcguguucgauguaugggggcauggaacaaugguuaccguguccucu

SEQ ID NO: 25001 - RNA, 432 nt, Artificial Sequence
  derived and/or modified sequence opt3 from anti-HIV_cap256-059-024100_VR-Chain
ugccaggugcuggucgagagcggcgggggaguugugcaacccgguagaucccucaggcuuucuugugccgcuucacaguucaccuuuaguagcuacggcaugcacuggguacggcaggcaccugggaagggacuggaauggguggccgcgaucuccuucgcuggcacuaaaaaguauuacgccgacucugucaaaggucgcuuugcaauuucgcgagauacaucaaagaacgccuuguauuuacagaugaauacgcugcgugcugaggacaccgcacuauacuauugcgccagagaucucagggaguucgaaugugaagagugggcuagcgacuacuaugauuuugggcggccacaaccgugccaggacccccgcggagugguuggcaguuucgauauauggggccaggggacaauggugacugucucccug

SEQ ID NO: 25002 - RNA, 432 nt, Artificial Sequence
  derived and/or modified sequence opt3 from anti-HIV_cap256-059-023966_VR-Chain
caggugcaacuggucgagagcggcgggggaguugugcagcccgguagaucccucaggcuuucuugcgccgcuucacaguucaguuuuagcuccuacggcaugcacuggguacggcaggcaccugggaagggacuggaauggguggccgcgaucucuuucgcuggcauuaaaaagcauuauaccgacucggucaaaggucgcuuuacaauaucacgagauaacagcaagaauacuuuguacuuacaaaugaacagucugcgugccgaggacacggcacuauauuacugugccaaagaucucagaggguucgaaugcgaggaaugggcuuccgacuauuacgauuuuggaagggaccagccaugucaggauccgcggggcgugguuggcaccuucgacaucugggggcagggaacacuggugacugucucuagc

SEQ ID NO: 25003 - RNA, 432 nt, Artificial Sequence
  derived and/or modified sequence opt3 from anti-HIV_cap256-059-020534_VR-Chain
caggugcaacuggucgagagcggcgggggaguugugcagcccgguagaucccucaggcuuucuugcgccgcuucacaguucaccuuuaguaacuacggcaugcacuggguacggcaggcaccugggaagggacuggaauggguggccggcaugagcuucgcggguacaaauacuuauuacgcugacuccgucaaagggcgcuuuacgaucucucgagauaacucgaagaauaccuuguauuuacaaaugaacucacugcgugccguggacacagcacuauacuauugugccagagauaugagggaguacgaaugcgaggaaugggcuagcgacuauuacgauuucggacgggaguacccaugucaggacccgcgcggcguugugggcauuuuugaucucugggggcagggaacuauggucaccgugaguucc

SEQ ID NO: 25004 - RNA, 435 nt, Artificial Sequence
  derived and/or modified sequence opt3 from anti-HIV_cap256-059-019513_VR-Chain
caggugcaacuggucgagagcggcgggggaguugugcagcccgguagaucccucaggcuuucuugcgccgcuucaggcuucaccuuuaguaacuucgcaaugggguggguacggcaggccccuggaaagggccuggaauggguggcggucaucagcuccgacgguacaaauaaaaacuacggggauucugugaagggacgcuuuacuauuucgcgagacaauucaaagaacacguuguucuuacagaugaauagccugcgugcugaggauaccagucuauauuacugugccaaagaccucggcggcuauaaaacagaugaaugggcaacuaacuacuauuacgacauauccaucgccucuccaauucaagauccgagagcuguugugggggcauuugacaucuggggacaggguaccauggucacagugaccagc

SEQ ID NO: 25005 - RNA, 432 nt, Artificial Sequence
  derived and/or modified sequence opt3 from anti-HIV_cap256-059-012963_VR-Chain
caggugcaacuggucgagagcggcgggggaguugugcagcccggucggucccucaggcuuucuugcguagccucaggcuucaguuuuagcuccuacgggauggcuugggugcggcaggcaccuggaaagggccuggaaugggucaccgugaucucuuucgccgguguuaaaacauauuacgcggacucggugaaggggcgcuuuacuauuucacgagauaacagcaaaggaacguuguauuuacagauggacggccugcguccagaggauaccgcucuauacuauugugccaaggaccucgcagaaagagagugcgaagagugggccagugauuacuaugacuucggcagggagcugccgugucaagaucccagaggggucgugggaacauuugacguauggggucagggcacuaugguuaccguguccucu

SEQ ID NO: 25006 - RNA, 435 nt, Artificial Sequence
  derived and/or modified sequence opt3 from anti-HIV_cap256-059-010396_VR-Chain
caggugcaacuggucgagagcggcgggggaguugugcagcccgguagaucccucaggcuuucuugcgccgcuucaggcuucaguuuuaacaauuacgcaaugaacuggguacggcaggccccugggaagggacuggaauggguggcguucgucagcuccgacggcucuaauaaaaacuaugcugauucggugaccggucgcuuuacauugucacgagacaauagcaagaacacuguuuucuuacagaugaauagucugcguguggaggauacggccgucuacuauugugcaaaagacgugggggccaacaaggaugacgaauggaccacaaauuacuauuacgauaucuccauugcugacccaguaccggaucccagagcaguuauaggagccuuugacguguggggccaaggcacuauggucaccgugucuagc

SEQ ID NO: 25007 - RNA, 432 nt, Artificial Sequence
  derived and/or modified sequence opt3 from anti-HIV_cap256-059-008136_VR-Chain
caggugcaacuggucgagagcggcgggggaguugugcagcccgguagaucccucaggcuuucuugcgccgcuucaggcuucaccuuuaauacauacgcaaugcacuggguacggcaggccccugggaagggacuggaauggguggcguugaucaguuaugacggcacugagaaauacuaugcugauagcgucaagggucgcuucacgauuucccgagacaauucucguaacaccuuauaccugcagaugaacucgcuaagacucgaagaugccgcacuguaucaaugugccaaagaccuugggggaucaaagagcgaugaguggggcacagacuacuaugauaugaguauauccuacccaauccaggacccgagggcuguggcaggcguuuuugauauuugggggcagggaacucuggugaccgucucuagc

SEQ ID NO: 25008 - RNA, 432 nt, Artificial Sequence
  derived and/or modified sequence opt3 from anti-HIV_cap256-059-006147_VR-Chain
caggugcaagucguugagagcggcgggggagugguacagcccgguagaucccugaggcucucuugcaccgccucaggcuucacauuuaguaacuucgcuauggggugggugcggcaggcaccuggaaagggccuugaaugggucgccuuuaucagcuccgacgguucuaauaaaaacuacggggauucggugaagggacgcuucacuauuucacgagacaauagcaaaaacacgguuuuucugcagaugaauaguuugcguguggaggauaccgcguuauauuacugugcuaaggacgucggcgauuauaaauccgacgaauggggcacagaguacuaugauauaucuaucagcuacccaauucaagacccgagagccauggugggggcauucgaucuguggggacaggguacuaugguaaccguuuccccc

SEQ ID NO: 25009 - RNA, 432 nt, Artificial Sequence
  derived and/or modified sequence opt3 from anti-HIV_cap256-059-005081_VR-Chain
caggugcaacuggucgagagcggcgggggaguugugcagcccgguagaucccucaggcuuucuugcgccgcuucacaguucaccuuuaguagcuacggcaugcacuggguacggcaggcaccugggaagggacuggaauggguggccggcaucuccuucgcggcuacuaaaaaguauuacucugagucggucaaaggucgcuuuacaauuucacgagacaacagcaagaaugccuugcauuuacacaugaacagucugcgugcagaagauacggcccuauauuacugugcuaaagaccucagagaguucgaaugcgaggagugggcauccgauuauuacgacuuugggagggaucaaccaugucaggacccgcggggagugguuggcauauucgauauguggggccaggggaccauggugacagucucuagc

SEQ ID NO: 25010 - RNA, 432 nt, Artificial Sequence
  derived and/or modified sequence opt3 from anti-HIV_cap256-059-005006_VR-Chain
caggcccaacugguggagagcggcgggggagucguucagcccgcuaagucccucagacuuucuugcgcagccucagguuucaccuuuaacaaauacgcgaugcacugggugaggcaggcuccuggcaaggggcuggaauggguagccuucguggcauuugacgagagugauaaauauuacgccgacagcgucaagggacgguucacaaucucccgcgauaauucuaaaaacacuuugucguuacagaugaauaaccugcgagcugaagacacggcaguguauuacugugccaaggagguuggcgauaauaaggacgaugaaugggcuucagacuauuacgaucuaagcauugccuauccaauacaagacccgcgugcgguggguagaggguacgauaucuggggacagggcaccauggucacagugaguucc

SEQ ID NO: 25011 - RNA, 432 nt, Artificial Sequence
  derived and/or modified sequence opt3 from anti-HIV_cap256-059-004451_VR-Chain
caggugcaccuggucgagagcggcgggggaguugugcaacccgguaagucccucagacuuucuugcaccgccucaggcuucacauuuacuaacuucgcuauggacuggguaaggcaggcaccugggaaaggacuggaauggguggccuuuaucaguagcgauggcuccaauaaguacuauucugagucggucaaaggucgguucacgauuucacgcgacaacagcaagaauaccuuguacgugcagaugaacaguuuacgaacagaagauacugcgguuuauuacugugcuaaagaccuagggggauauaaggaugacgagugguccaccgauuacuaugacuggucuacagccuacccagugcaggauccgcgugcagucgccggcgcuuuugaccuguggggccaagggaccauggugagcguauccuca

SEQ ID NO: 25012 - RNA, 432 nt, Artificial Sequence
  derived and/or modified sequence opt3 from anti-HIV_cap256-059-003571_VR-Chain
caggagcaacugguggaaagcggcgggggagucguucagcccgguagaucccucaggcuuucuugcgccgcuucacaguucaccuuuggcgcauacgggaugcacugggugcggcaggccccuggaaagggccuggaguggguagcgggugugaguuucgucgggaacaauaaauauuacgcugacagcgugaagggacgcuuuacaaucucccgagauaacucuaaaaauacuuuguauuuacaaaugaacucgcugcguggcgaagacacggcccuauacuauugugcaagagauaugagggagauggaaugcgaggagugggccucagacuacuaugauuucggccggccacagccgugucaggacccccgcgggguugugggaauuuuugauauguggggucagggcaccauggucacagugagcagu

SEQ ID NO: 25013 - RNA, 432 nt, Artificial Sequence
  derived and/or modified sequence opt3 from anti-HIV_cap256-059-003449_VR-Chain
caggugcaacuggucgagagcggcgggggaguugugcagcccgguaagucccucagacuuucuugcgccgcuucacagguaaccuucaguagcuacggcaugcacugggugaggcaggcaccugggaaaggacuggaaugggucgccggcaucuccuuugcggguacaaagaaauauuacgcugacucugugaaggggcgguucacuauuucgcgcgauaacagcaaaaaugccuuguauuuacaaaugaaccgacugcgugcaggagacacggcccuauacuauugugcuaaggaucucagagaguacgaaugcgaggaaugggcaucagacuauuacgauuuuggcagggagcagccaugucaggacccgcggggcguuguggggauauucgauaucuggggacuggguaccauggucacagugaguucc

SEQ ID NO: 25014 - RNA, 432 nt, Artificial Sequence
  derived and/or modified sequence opt3 from anti-HIV_cap256-059-002712_VR-Chain
caggugcaacuggccgagagcggcgggggagucguucagcccgguagaucccucaggcuuucuugcgcugcaucacaguucaccuuuaguagcuacggcaugcacugggugcggcaggccccugggaagggacuggaauggguagcggcuaucuccuucgccggcacuaaaaagcauuaugcagacucugugaaaggucgcuuuacaauuucgcgagauaacucaaagaauacguugaacuuacaaaugaauagccugcgugccgaggacaccgcucuauacuauugugcaagagauaugagggaauacgagugcgaagucugggccagugacuauuacgauuucgggcgggagcagccaugucaggacccgcgcggagugguuggcacauuugauauauggggccaggggacuauggugaccgucuccccc

SEQ ID NO: 25015 - RNA, 432 nt, Artificial Sequence
  derived and/or modified sequence opt3 from anti-HIV_cap256-059-001573_VR-Chain
caggugcaacuggucgagagcggcgggggaguugugcagcccgguagaucccucaggcuuucuugcgccgcuucacaguucaccuuuaguagcuacggcaugcacuggguacggcaggcaccugggaagggacuggaauggguggccggcaucuccuaugacgguacaucuaaauacuaugcggauucggucaaggggcgcuucacuauuucacgagacaacagcaaaaauacguuguacuuacaaaugaacagucugcgugcugaggauaccgcccuauauuacugugcaaaggaccucagagaagaugagugcgaagaguggugguccgacuauuacgauuuuggaagggagcugccaugucggaaaucucgcggcguggccggcacauucgacauaugggggcauggaacuaugguuaccgugagcucc

SEQ ID NO: 25016 - RNA, 432 nt, Artificial Sequence
  derived and/or modified sequence opt3 from anti-HIV_cap256-059-001379_VR-Chain
caggugagacuggucgagagcggcgggggaguugugcaacccgguaggucccuccggcuuucuugcgccgcuucaggcuucaccuuuaacaguuacccuaugcacuggguacgccaggcaccagggaagggacuggacuggguggccuugaucagcuaugauggcacaaauaaauucuacgucgacuccgugaagggucgauuuacuauuucucgugauaacucgaaaaauacguuauaucugcagaugaacucacuaaccgcggaagacacagcuauguacuauugugccaaggaucucgggggaaauaaagacgaugaguggggcacugacuacuaugauauaagcguugcauacccgauccaugaccccagagccguggcuggcauuuucgaugucugggggcacggaaccauggugacaguaaguucc

SEQ ID NO: 25017 - RNA, 432 nt, Artificial Sequence
  derived and/or modified sequence opt3 from anti-HIV_cap256-059-001029_VR-Chain
caggagcaacuggugcagagcggcgggggagucguucagcccgguagaucccucaggcuuucuugcgccccuucacaguucaccuuuagugcucacggcaugcauugggugcggcaagcaccagggaagggacuggaauggguagccggcaucagcuucgcggguacuaaaaauuacuaugcugacuccgugaaggggcgcuuuacaauuucucgagauaauucgaaaaacacguuguacuuacagaugaacucacugcgugucgaggacaccgcccuauauuacugugcaaaggauaugagagaaauggagugcgaagagugggccagcgacuauuacgauuucggaaggcaccagccgugucaggacccccggggcgugguuggcauauuugauaucugggggcaaggaacaauggugacugucaguucc

SEQ ID NO: 25018 - RNA, 432 nt, Artificial Sequence
  derived and/or modified sequence opt3 from anti-HIV_cap256-048-165087_VR-Chain
gaggugaagcugcucgaaagcggcgggggacuuguccagcccgguggcuacagaaggcuguccugcgccgcuucuggguucaccuuuucacgguaugcaaugcacugggcccgccaagcgccuggaaaaggcuuggaguggguugcugugguaagugacgauggugugaagaaauacuauccagacagcguccgagggcguuucacaaucuccagagauaacucuaggaauacugugucguuacagaugaacucacugcggccggaagacacggccguuuacuauugugcaaaggaugugggagccaauaaagacgaugagugggcuaccgacuacuaugaucuaagcauugcauaccccgucccugacccacgcgccgugguaggcgcuuuugauauauggggccaggggacaaugguuacugugaguucc

SEQ ID NO: 25019 - RNA, 432 nt, Artificial Sequence
  derived and/or modified sequence opt3 from anti-HIV_cap256-048-158861_VR-Chain
gaggugcagcuggucgaaagcggcgggggacucguucaacccgguggcucccuuagacugucuugcguggacuucggguuuagguucucagaguacuggaugaguuggguacggcaggccccuggaaagggcuuggaauggguggcugucaucagcuaugaugguaccaauaaauacuaugcagacuccgugaaggggcgcuuuacaauuucucgagauaauucgaaaaacacuuuauaccugcagaugaacucacuacgugccgaggacacggcgcucuauuacugugcuaaggauaugagagaaagcgagugcgaggaaugggccagugacuauuacgauuucggaaaagacuacccaugucaggauccgaggggcguugugggcaccuuugacauaugggggcaaggaacaauggucacuguguccucu

SEQ ID NO: 25020 - RNA, 435 nt, Artificial Sequence
  derived and/or modified sequence opt3 from anti-HIV_cap256-048-158280_VR-Chain
caggugcaccuggucgagagcggcgggggaguugugcaacccgguagaucccucaggaucuacugcgccguaucugaguucaccuuucggaacuaugcuaugcauugggugcgccuugcaccuggcaaggggcugcagugggucgccgugauuucacacgacggaauaaaugauuacuaugcggacaguguuaaaggccgauucacaaucagccgugauaacuccaagaauacugugucuuugcagaugaacucguuaagaccagaagacacggcugucuacuauugugccaaagaucugggugcaaauaaggacgaugaaugggccaccgacuacuaugaucuaucaauugcuuacccggugcccgacccuacagggccaugguuuggagcauucgauaucuggggccagggcacuaugguaaccguuagcagu

SEQ ID NO: 25021 - RNA, 432 nt, Artificial Sequence
  derived and/or modified sequence opt3 from anti-HIV_cap256-048-157928_VR-Chain
caggugcaacugauggagagcggcgggggagucguucagcccgguagaucccucaggcuuucuugcgccaucucaggcuucaccuuuaguaacuacuggaugagcugggugcggcaggcuccugggaagggacuggaauggguagcagugauuuccucugacggcucgagcaaaaauuaugccgauucagucaagggucgcuucacaauaagucgagacaacuccaaaaauacugugucuuugcagaugaacagcuuacguccagaggauacggcgguuuacuauugugcuaaggacgugggggccaauaaagaugacgaaugggcaaccgauuacuaugaccuguccaucgccuacccgguccccgauccuagagcugugguaggagcauuugacauuuggggccaaggcacaaugguuacugugucaagu

SEQ ID NO: 25022 - RNA, 432 nt, Artificial Sequence
  derived and/or modified sequence opt3 from anti-HIV_cap256-048-157056_VR-Chain
caggugcaacuggucgagagcggcgggggaguugugcagcccgguagaucccucaggcuuucuugcgccgcuucaggcuucacccugaguagcuacgcaaugcacuggguacggcaggccccugggaagggauuggaauggguggcguuuaucuccaacgacggcucuaauaaauauuucgcugauucggucaagggucgcuuuacaauuucacgagacaacagcaaaaauacuuuauaccugcagaugaacagucuacgugccgaggauacggcaguguauuacugugccaaggaccucgggggaaauaaagaugacgaaugggcuaccgauuauuacgaccuguccauagcauauccaguucaagauccgagaguggucgugggcaucuucgacauuuggggccaggggacaaugguaacuguuucuagc

SEQ ID NO: 25023 - RNA, 432 nt, Artificial Sequence
  derived and/or modified sequence opt3 from anti-HIV_cap256-048-156422_VR-Chain
caggugcaacuggucgagagcggcgggaccguugugcagcccggaagaucccucaggcuuucuugcguagguucaggcuucagucugagcuacuaugccauccacugggugcggcaggcuccugggaagggauuggaaugggucgcagugauuuccuacgacggcucuaacuauuacuaugccgauucgguuaaaggucgcuuuacaauaucacgagacaauagcaagaacacuguguacuuacagaugaauagucugcguggggucgauacggcgguguauuacugugcuaaagaccuaggaggcggcgagguagaagagugggccaccgauuacuaugacugguccaucgcauacccaguugaacauccgagagccguggucgggguguucgauauuuggggacaagguacaaaggugacugucucuagc

SEQ ID NO: 25024 - RNA, 432 nt, Artificial Sequence
  derived and/or modified sequence opt3 from anti-HIV_cap256-048-152863_VR-Chain
gaggugcagcugcucgaaagcggcgggggacuuguccaacccgguggcucccugagauugucuugcgccgggucaggauucaccuuuaguaagcacggcaugcauuggguuaggcaggcuccugguaaaggguuagaguggguggcauucguagccuuugacgaaagcgauaaguacuaugcggacuccgugaaaggacgguucacaaucucucgcgauaacucgaagaauacucugucacuacagaugaacagccuccgagcugaggacacggccauguacuauugugcaaaagaagucggcgauaauaaggacgaugagugggccagugacuacuaugaucuguccauugcuuacccagugcacgacccgcgugcaguugugggcggguaugauauauggggacaggguaccauggucacagugucuagc

SEQ ID NO: 25025 - RNA, 432 nt, Artificial Sequence
  derived and/or modified sequence opt3 from anti-HIV_cap256-048-152770_VR-Chain
caggugcaacuggucgagagcggcgggggaguugugcagcccgguagaucccucaggcuuucuugcgccgcuucaggcuucaccuuucggaguaacgcaaugcacuggguacgccaggccccugggaagggacuggaauggguggcggucaucagcuacgacggcuccaaaacauauuacgcugauucugugaagggucgauucacuauuucgcgugacaauucaaagaacacguuguauuuacagaugaauagccugagagccgaggauaccgcaguuuacuauugugccaaagaccuaggggaauacaaaagugaugagugggcuacagacuauuacgaucucuccauagcauacccagugcaagacccgaggggagucgccggcgcuuuugauaucuggggccaggggacuauggugaccguaucuagc

SEQ ID NO: 25026 - RNA, 432 nt, Artificial Sequence
  derived and/or modified sequence opt3 from anti-HIV_cap256-048-150027_VR-Chain
gaggugcagcuggucgaaagcggcgggggacucguucaacccgguggcucccuuagacugucuugcgccgugucaggguucaccuuuaguagcuacaucaugcacuggguaaggcaggcuccuggaaagggcuuggaguggguggcagucauuuccuaugacgguucuaacaaagauuacgccgacucggugaaggggcgguucacaauaucacgcgauaauagcaaaaacacuuuauaucugcagaugaauagucuacgagcggaagacacggcucucuacuauugugccaaggaucugcgugaguacgaaugcgaggagugggcauccgacuauuacgauuuuggaagagacuacccaugucaggauccgaggggcguugugggcaccuucgacaucugggggcaaggaacaauggucacugugucuagc

SEQ ID NO: 25027 - RNA, 432 nt, Artificial Sequence
  derived and/or modified sequence opt3 from anti-HIV_cap256-048-148246_VR-Chain
caggugcaacuggucgagagcggcgggggaguugugcagcccgguagaucccucaggcuuucuugcgccaccucaggcuucacauuuaguacuuacagcaugcacuggguacggcaggcuccugggaagggacuggaauggguggcagucaucuccuaugacggcucuaacgaguacuauguggauucgguuaaaggucgcuucacgauuucacgagacaauagcaagaacaccuuguacuuacagaugaauagucugcguguggaagauacagcccuauauuacugugcgaaagaccucgggggaaacaaggaugacgaguggggcacugauuauuacgacuuuuccgucgcuuacccagugcaagauccgagagccguaucuggcauauucgacguuugggggcauggaaccauggugacagucagcucc

SEQ ID NO: 25028 - RNA, 432 nt, Artificial Sequence
  derived and/or modified sequence opt3 from anti-HIV_cap256-048-147428_VR-Chain
caggugcaacuggucgagagcggcgggggaguugugcagcccgguagaucccucaggcuuucuugcucagccaguggcuucaccuuuagcaacuacgggaugcacuggguacggcaggcuccuggaaagggccuggaauggguggcagucaucuccuucgacgguucuaauaaaguguaugccgauucgguuaaggggcgcuuuacaauuucacgagacaacagcaaaaauacuuuguacuuagagaugaacagucugcgugcggaagauacggcugaguauuacugugccaaggaccuaggagaauccgauaaagaggaguggccaucugacuauuacgauuucggcagagacuuuaccggccaggugccgagggcagucguggggauauucgauauguggggacaagguacaaugguaacuguuagcucc

SEQ ID NO: 25029 - RNA, 432 nt, Artificial Sequence
  derived and/or modified sequence opt3 from anti-HIV_cap256-048-146603_VR-Chain
gaggugcagcuggucgaaagcggcgggggacucguucaacccgguagaucccuuaggcugucuugcgccgcuucaggcuucaccuuugacgauuacgcaauccacugggugcggcaggccccugggaagggauuggaguggguagcguuaauuaguuaugacggcacagauaaauacuaugcugacagcgugaagggucgcuucacuauaucccgagauaacucuaaaaauacgcuguaccuacagaugaacucgcuccgugucgaagacaccgccguguaucauugugcaaaggaucuugggggaacaaaaucagacgagugggccacugauuacuaugaccugagcaucgcuuacccaauucaggauccgggcgcaguugugggcgucuuugacaucugggggcaaggaaccauggugacaguaaguucc

SEQ ID NO: 25030 - RNA, 432 nt, Artificial Sequence
  derived and/or modified sequence opt3 from anti-HIV_cap256-048-145735_VR-Chain
caggugcaacugguccagagcggcgggggaguugugcagcccgguagaucccucaggcuuucuugcggcgccucaggguucaccuuuaguaauuacgcuaugcacuggguacggcaggcaccuggaaagggccuggacuggguggccgucaucagcuaugaugguacaaaugagaaccaugcggacuccgugaaagggcgcuucacuauuucucgagauaauucgaagaacacgguuuacuugcaaaugaacucauuacgugcugaagacaccgccguguauuacugugcaaaagaugucggaggcagcaaggacgaugagugggccacagacuauuacgaucugaguauagcuuauccagugccggaccccagagcaguaguuggcgccuuugauaucugggggcagggaacuauggugaccgucuccucu

SEQ ID NO: 25031 - RNA, 432 nt, Artificial Sequence
  derived and/or modified sequence opt3 from anti-HIV_cap256-048-145116_VR-Chain
caggugcaccuggucgagagcggcgggggaguugugcaacccgguggcucccucagacuuucuugcgccgcuucaggguucaccuuuaguaacuacggaaugcauuggguaaggcaggcaccuggcaagggucuggaauggguggccgcgaucagcuucgcugggacaaauaaauauuacgccgacuccgucaagggacgguuuacuauuucucgcgauaacucgaaaaaugcauuguauuuacagaugaacucacugcgagccgaggacacggcucuauacuauugugcaaaggaucuccgugaaagcgagugcgaagagugggccagugacuacuaugauuucggcagagacuacccaugucaggauccgaggggcgugguugggacccuggacauauggggacaagguacaauggugacugucuccucu

SEQ ID NO: 25032 - RNA, 432 nt, Artificial Sequence
  derived and/or modified sequence opt3 from anti-HIV_cap256-048-144077_VR-Chain
caggugaagcuggucgagagcggcgggggaguugugcaacccgguagaucccucaggcuuucuugcgccgcuucaggcuucacccugaguagcuacgcaaugcacuggguacggcaggccccugggaaaggauuggaauggguggcggucaucuccuaugacggcucuaaccgcuacacagcugauucggugaagggucgauuuacuauuucacgugacaauagcaaaaacacguuaaaucugcagaugaacagucuaagaccagaggauaccgccguuuauuacugugcaaaggacgugggggccaauaaagaugacgaaugggcuacagauuauuacgaccucuccauagcauauccgguccccgauccuagggccgugguaggagcuuucgacaucuggggccagggcacuaccguuacagugucuagc

SEQ ID NO: 25033 - RNA, 432 nt, Artificial Sequence
  derived and/or modified sequence opt3 from anti-HIV_cap256-048-142876_VR-Chain
caggugcaacuggucgagagcggcgggggaguugugcagcccgguggcucccucagacuuucuugcguagccucaggguucaccuuuaguacauacggaaugcacugggugaggcaggcuccuggcaagggucuggaaugggucgcauucaugcgguuugacgggagcaaccgcuauuacggagauuccgugaaaggccgauucacuaucucucgugacaauucgaagaacacguuguauuuacagaugauuucacugagagccgaggauaccgcgguuuaccauugugcuaaagaccuaggcgggaauaagccagaugaaugggccacagacuauuacgaucucagcauagcauauccggugcaagaccccagggccgucgugggaguauuugauaucuggggucagggcacuauuaucaccguuaguucc

SEQ ID NO: 25034 - RNA, 432 nt, Artificial Sequence
  derived and/or modified sequence opt3 from anti-HIV_cap256-048-140582_VR-Chain
caggugcaacuggucgagagcggcgggggaguugugcagcccgguagaucccucaggcuuucuugcgccgcuucaggcuucaguuuuagcaacuacgcaauggacuggguacggcaggccccugggaagggacuggaauggguggcguucgucuccucugauggcucgaauaaaaacuaugcugacucagugaagggucgcuuuaccaucagccgagauaauaguaaaaacacaguuuacuugcagaugaacuccuuacguguggaggacacugccgucuauuacugugcaaaggaucugggggccaauaaagacgaugaaugggcuacggacuauuacgaucuaucuguggcauauccaguaccggaccccagagccguugugggagcuuucgaugucuggggccaaggcaccauggugacagugagcucc

SEQ ID NO: 25035 - RNA, 432 nt, Artificial Sequence
  derived and/or modified sequence opt3 from anti-HIV_cap256-048-139355_VR-Chain
caggugcaacuggucgagagcggcgggggaguugugcagcccggucggucccucaggcuuucuugcgccgcuucaggcuucaccuuuaguagcuacgcaaugcacuggguacggcaggccccugggaagggacuggaauggguggcgaucauuuccuaugacggcucuaacaaauacuaugcugauucggucaagggucgcuucacaauaucacgagacaauagcaaagggacuuuguacuuacagauggauggaccacguccggaggacacggcccuguauuacugugcaaaggaucuaggcgaaagagagugcgaagagugggccagugacuauuacgauuuuggcagggacuuccccugucaagauccuagaggggugguuggaaccuuugacaucuggggucagggcacaauggugacugucuccucu

SEQ ID NO: 25036 - RNA, 432 nt, Artificial Sequence
  derived and/or modified sequence opt3 from anti-HIV_cap256-048-139151_VR-Chain
caggugcaacuggucgagagcggcgggggaguugugcagcccgguaagucccucagacuuucuugcgccgcuucaggcuucaccuuuaacacauacgggaugcacuggguaaggcaggcaccuggaaaaggccuggaauggguggccgucaucaguuaugacgguagcauucagaaguacgcggauuccgugaaagggcgguucacuauaucucgcgacaauucgaagaacacguuguauuuacaaaugaacucacugagcguugaggauaccgcuguguacuauugugccaaagaccuaggaaagaauaaggaugacgaaugggcaacagauuacuaugacaucaguauugccuacccagucccggauccccgagcugugguaggcguuuuugacaucuggggccaggggacuguggucaccguguccucu

SEQ ID NO: 25037 - RNA, 432 nt, Artificial Sequence
  derived and/or modified sequence opt3 from anti-HIV_cap256-048-137672_VR-Chain
gaggugcagcuggucgaaagcggcgggggaguugccagacccgguggcucccucaggcuuucuugcgcugcaucaggguucaucuuuacccacuacgccauggacugggugcggcaagcgccuggaaagggccuggaguggguagcugugauuaguagcgaugguuccucuaaaaacuaugccgacucggucaaggggcgcuucacaauaucacgagauaauagcaaaaacacugugaguuugcagaugaacuccuuacguccagaagacacggcaguuuacuauugugccaaggaugugggagcuaauaaagacgaugagugggcaaccgacuacuaugaucugucuaucgccuacccgguccccgacccuagagcugugguaggcgccuuugauauuuggggccaggggacaaugguuacugugagcucc

SEQ ID NO: 25038 - RNA, 432 nt, Artificial Sequence
  derived and/or modified sequence opt3 from anti-HIV_cap256-048-137506_VR-Chain
caggugagacuggucgacagcggcgggggaguugugcaacccgguggcucccucaggcuuucuugcgccgcuucaggguucaccuuuaguacauacggaaugcacuggguacggcaggcaccuggcaagggucuggaguggguggccuucauccgcagcgauggguccaacaaauauuacgcggacucuguccagggacgauuuucgauuucacgugauaauagcaagaacacuuuguauuuacagaugaauagucugagagcugaagacacggccguguacuauugugcaaaagaucuaggcgaguccgacaaggaagaguggccaucugauuacuaugacuucggcagggauuuuaccgggcaagacccgcgggccguugugggagucuucgauauauggggucagggcacaacugugaucguaagcucc

SEQ ID NO: 25039 - RNA, 432 nt, Artificial Sequence
  derived and/or modified sequence opt3 from anti-HIV_cap256-048-137270_VR-Chain
caggugcaacuggucgagagcggcgggggaguugugcagcccgguagaucccucaggcuuucuugcgccgcuucaggcuucaccuuuaguagcuacgcaaugcacuggguacggcaggccccugggaagggacuggaauggguggcggucauguccccagacggcucuaaccgcuauuacacagauucggugaaaggucgauucacuaucucacgugacaauagcaagaacacguugaguuuacagaugaacucccugagaccggaggauaccgcuguuuauuacugugccaaagacgugggggcaaauaaggaugacgaaugggccacagauuauuacgaccuaucuauugcuuaucccgucccugauccaagggcagugguaggagccuuugacauauggggccaaggcacuaugguuaccgugagcucc

SEQ ID NO: 25040 - RNA, 432 nt, Artificial Sequence
  derived and/or modified sequence opt3 from anti-HIV_cap256-048-135447_VR-Chain
gaggugcagcuggucgaaagcggcggggccguugugcaacccggaagaucccucaggcuuucuugcaccgcuucagguuucaguuuuacaagcuacacuauccacuggguacggcaggcaccuggcaaggggcuggaguggguggccuucauuuccuaugacggaacggagaaaaaguacaccgauucugucaaaggccgcuuuacaauaucgcgagacaacucaaagaauacuuugagcuuacagaugaacagucugcguccagaagauaccgcgguguauuacugugcuaaagaccuaggugccuccaaggaugacgaaugggcaacagauuauuacgacuucucuaucgccuauccgguucaggaucccagagcuguggucggggcauuugacauuuggggacaaggcaccauggugacuguaagcucc

SEQ ID NO: 25041 - RNA, 432 nt, Artificial Sequence
  derived and/or modified sequence opt3 from anti-HIV_cap256-048-131966_VR-Chain
caggagcaacugguggaaagcggcgggggagucguucagcccgguagaucccucaggcuuucuugcgccgcuucaggcuucaccuuuaguaacuacgcaaugcacugggugcggcaggccccugggaagggacuggaguggguagcggcuaugagccaugacggcuccgauaaauauuacgccgacucugugaagggucgcuucacaaucucgcgagauaauucaaagaacacuuuguauaugcagaugaauagcuuacgugcagaagacacggccgucuacuauugugcuaaagaucaaggggagagugaaaaagaggagugggcauccgacuacuaugauuuuggaagagacuacccaggccaggauccgaggcgggugguugccaccuucgcuauuuggggccaggggacaauggugacugucucuagc

SEQ ID NO: 25042 - RNA, 432 nt, Artificial Sequence
  derived and/or modified sequence opt3 from anti-HIV_cap256-048-131008_VR-Chain
gaggugagacuggucgaaagcggcgggggacucguuaagcccgguggcucccuuaggcugucuugcgccgcuucaggguucaccgugaguagcaacuacauguccuggguacggcaggcaccuggaaaaggcuuggaguggguggccgcgaucucuuuugcugguacaaauaaguauuacgccgacucggucaaagggcgcuucacuauuucacgagauaacagcaagaaugcauuauaucugcaaaugaacagucuacgugccgaagacacggcucucuacuauugugcaaaagaucugagagaguccgaaugcgaggagugggccucugacuacuaugauuuuggaagggacuacccaugucaggauccgcggggcgugguuggcacccuugacauaugggggcagggaacaauggugacugucagcucc

SEQ ID NO: 25043 - RNA, 432 nt, Artificial Sequence
  derived and/or modified sequence opt3 from anti-HIV_cap256-048-129369_VR-Chain
caggugcaacuggucgagagcggcgggggaguugugcagcccgguagaucccucaggcuuucuugcgccgcuucaggcuucaccuuuaguaacuacguaaugcacugggugcggcaggcaccugggaagggacuggaaugggucgccuuggugagcuucgacggcuccaauaaauauuacgcggauucuguuaagggucgcuuuacaaucucgcgagacaacagcaaaaauacuguguauuuacagaugaacucacugcguggggucgauacggcuguguacuauugugccaaggaccuaggaggcggcgagguagaagagugggcaaccgauuacuaugacuggaguauugccuacccaguugaacauccgagagcuguggucgggguguucgauauauggggacaagguacaaaagugacugucuccucu

SEQ ID NO: 25044 - RNA, 432 nt, Artificial Sequence
  derived and/or modified sequence opt3 from anti-HIV_cap256-048-128476_VR-Chain
gaggugcagguccuggaaagcggcgggggacucguucaacccgguggcucccuuagacuggccugcgcugcaucuggguucucauuuaguagcuacggaaugcacugggugaggcaggccccuggcaaggguuuggaguggguauccuucauccgguaugacggggcgaacaaauaccaugcugauucugugaagggacgcuuuauuauaucgcgagacgauagcaaaaauaccgucucauuacagaugaacagucugcguccagaagacacagccguguauuacugugcaaaggaucuaggcgccaauaaagacgaugagugggcuacugacuauuacgaucucuccaucgcauauccgguucccgacccuagagccguggucggcgcuuucgauauuugggggcagggaacgauggugaccguaucuagc

SEQ ID NO: 25045 - RNA, 432 nt, Artificial Sequence
  derived and/or modified sequence opt3 from anti-HIV_cap256-048-128270_VR-Chain
caggugcaacuggucgagagcggcgggggaguugugcagcccgguagaucccucaggcuuucuugcaccgccucaggcuucacauuucggaguuacgcuaugcacuggguacgccaggcaccugggaagggacuggaauggguggccuugaucagcuaugacggcuccaacaaauacuaugcggauucugucaagggucgauucacuauuucgcgugacaauucaaagaacacguuauaccugcagaugaauagccuaaccagugaggauacagcuguguauuacugugccaaagaccucgggggauccaaaacugaugaauggggcaccgacuauuacgaguuuuggaacgcauacccaguucaagauccgagaguggucgugggcgccuucgacauaugggggcauggaacaaugguaaccguuucuagc

SEQ ID NO: 25046 - RNA, 432 nt, Artificial Sequence
  derived and/or modified sequence opt3 from anti-HIV_cap256-048-126220_VR-Chain
caggugcaacuggucgagagcggcgggggaguugugcagcccgguagaucccucaggcuuucuugcgccgcuucaggcuucaucuuuaguccuuacgggauucacuggguacggcaggcaccaggaaagggccuggaauggguggccuugauaagccaugacgguuccaaaaaguauuacgcggauucugucaaagggcgcuucaccaucucgcgagacaauuuuaaggauacauuauaucugcagaugaacucacuacguggaguggacacugcuguuuacuauugugccaaagaucucggcggcggggagguggaagagugggcaacggacuacuaugauuggagcaccgccuacccggucgaacaccccagagcugugguaggaguuuucgacauuuggggucaaggcacaaaggugacugucaguucc

SEQ ID NO: 25047 - RNA, 432 nt, Artificial Sequence
  derived and/or modified sequence opt3 from anti-HIV_cap256-048-125713_VR-Chain
gaggugcagcuggucgaaagcggcgggggacucguucaacccgguggcucccuuagacugucuugcgaggccucaggguucaguuuuagcaccuacgaauugaacugggugaggcaggcuccuggaaagggcuuagaguggguagcagugaucuccuaugacgguucuaauuacuauuacgccgauucggucaaagggcgguucacaauuucacgcgacaacagcaagaauacucuguaucuacagaugaacagucuccgagcggaagauacggcuguguacuauugugccaaagacguuggagcaaauaaggaugacgagugggccaccgauuacuacgaccuguccauagcuuauccagugccggauccccgugcagucgugggcgccuuugacaucuggggccaggggacaaugguaacuguuucuagc

SEQ ID NO: 25048 - RNA, 432 nt, Artificial Sequence
  derived and/or modified sequence opt3 from anti-HIV_cap256-048-123934_VR-Chain
caggugcaacuggucgagagcggcgggggaguugugcagcccgguagaucccucaggcuuucuugcgccgcuucaggcuucaccuuuaguagcuacgggauggcauggguacggcaggccccuggaaagggccuggaaugggugacagcgaucuccuucgcugguacuaacaaauauuacgccgacucugucaaggggcgcuuuacgauuucgcgagauaauucaaaagacaccuuguauuuacagauggauggacugcguccagaggacacagcacuauacuauugugccaaggaucucggcgaaagagagugcgaagagugggcuagcgacuacuaugauuucggcagggacuuuccggggcaagaucagcgggcaguggccggaguuuucgacauguggggucagggcacuauggugaccgucaguucc

SEQ ID NO: 25049 - RNA, 432 nt, Artificial Sequence
  derived and/or modified sequence opt3 from anti-HIV_cap256-048-122673_VR-Chain
gaggugcaggucguugaaagcggcgggggacuggugaagcccgguggcucccucagacuuucuugcgccgcuucaggguucaccuuuaguagccacguaaugaacugggugaggcaagcaccuggaaaaggccuggagugggucuccucuaucucgggugggucaagcaguaaggacuacgccgauuccgugaaaggacgguucacaauuucucgcgacaauagcaagaacacuuuguccuuacagaugaacucacugcgaccagaagauacggcgguuuauuacugugcuaaagacgugggcgccaauaaggaugacgagugggcaaccgauuauuacgaccuaaguauagccuauccgguccccgauccucgugcugugguaggcgcauuugacaucugggggcagggaacaaugguuacugugagcucu

SEQ ID NO: 25050 - RNA, 432 nt, Artificial Sequence
  derived and/or modified sequence opt3 from anti-HIV_cap256-048-122208_VR-Chain
agagugcaggucguugagagcggcgggggagugguaaagcccgguggcucccugaggcucucuugcggggccucaggauucaccuuuaguaacgcuuggcuuagcugggugcggcaagcaccuggcaaaggucuggaaugggucgccgugaucuccucugacgggucgucaaagaauuacgcggauagcguuaaaggacgcuucacaauuagucgagacaacuccaagaauacugugucuuugcagaugaacagcuuacguccagaggauacggcugucuauuacugugccaaagacgugggcgcaaauaaggaugacgaaugggccaccgauuauuacgaccuguccauagcuuauccgguacccgauccuagagcaguugugggcgccuuugacaucugggggcagggaacaauggucacugugucaagu

SEQ ID NO: 25051 - RNA, 432 nt, Artificial Sequence
  derived and/or modified sequence opt3 from anti-HIV_cap256-048-121552_VR-Chain
caggugcaacuggucgagagcggcgggggaguugugcagcccgguggcucccucagacuuucuugcgccgcuucaggguucaccuuuaguagcuacgcaaugcacuggguaaggcaggccccuggaaagggccugaaauggguggcggacaucuccuaugaugcuucuucgaaguacuaugccgacucagucaaaggucgguucacaauuagccgcgauaacaguaagaauacuuuguacuuagaaaugaacucccugcgaccagaggacacggcaguguauuacugugccaaagaucuaggggaacgugagugcgaagagugggcuucugacuauuacgauuuuggaagagacuucccgugucaggaucccaggggcguugugggcaccuuugacauaugggggcaaggaacaauggucacugugagcucc

SEQ ID NO: 25052 - RNA, 432 nt, Artificial Sequence
  derived and/or modified sequence opt3 from anti-HIV_cap256-048-120643_VR-Chain
caggugcaacuggucgagagcggcgggggaguugugcagcccgguagaucccucaggcuuucuugcgccgcuucaggcuucacccugagugcauacacaaugcacuggguacggcaggccccugggaagggauuggaaugggugagcgucaucuccuuugcgggcaacaauaaauauuacgcugacucugugaagggucgcuucacuauuucgcgagagaacagcaaaaauauguuauaucugcagaugaacucacuacguggggaagauacggccguuuacuauugugcaaaggaccucagagaguuugaaugcgaggagugggccagugauuacuaugacuucggaagggauuacccaugucaagacccgcggggcguggucggcaccuuugaugugugggggcauggaucccugguaacaguuucuagc

SEQ ID NO: 25053 - RNA, 432 nt, Artificial Sequence
  derived and/or modified sequence opt3 from anti-HIV_cap256-048-118458_VR-Chain
caggugcaacuggucgagagcggcgggggaguugugcagcccgguagaucccucaggcuuucuugcgccgcuucaggcuucaccuuuaguacaagcgggaugcacuggguacggcaggcaccuggaaagggccuggaauggguggccuucaucuccucugaccgcucgaacaaauuuuacgcggauucagucaagggucgauucagcauuagucgugacaauuccaaauauacuuuguacuuacagaugaacucucugagagcugaugacacggccguguauuuuugugcaaaggaucuagggguuaauaaaaacgacgagugggccaccgauuacuaugaccucagcguggcuuacccaguccaagauccgaggggaguggcaggcauauucgacaucuggggccaggggacaaugguaacuguuuccuca

SEQ ID NO: 25054 - RNA, 432 nt, Artificial Sequence
  derived and/or modified sequence opt3 from anti-HIV_cap256-048-118112_VR-Chain
caggagcaacugguggaaagcggcgggggagucguucagcccgguagaucccucaggcuuucuugcgccgcuucacaguucaccuuuaguaacuacggcaugcacugggugcggcaggcaccugggaagggacugguauggguggccggcaucagcuucgcggguacaaauaaauauuacgcugccuccgucaaggggcgcuuuacuauuucucgagacaacucgaaaaauacguuguauuuacaaaugaacucacugcgugcagaggauaccgcccuauacuauugugcuaaggacaugagagaauacgagugcgaagagugggcaagcgauuauuacgacuucggaagggauuacccaugucaggacccgcggggcgugguuggcacauuugauauaugggggcagggaacuauggugaccgucaguucc

SEQ ID NO: 25055 - RNA, 432 nt, Artificial Sequence
  derived and/or modified sequence opt3 from anti-HIV_cap256-048-116469_VR-Chain
caggugcaacuggucgagagcggcgggggaguugugcagcccgguagaucccucaggcuuucuugcgccgcuucaggcuucaccuuuaguagcuacgcaaugcacuggguacggcaggccccugggaagggacuggaauggguggcgaucauuuccuaugacggcucuaacaaauacuaugcugauucggucaagggucgcuucacaauaucacgagacaauccgaaaaacacuuuguacuuacagaugaauagccugcgugccgaggauacggggcuauauuacugugcaaaggacaugggagaaagugagaaagaagagugggccuccgauuauuacgacuuuggcagagauuacccaggccaagagcccagggcuaugguggggaccuucgacaucuggggacaggguacaaugguuacugugucuagc

SEQ ID NO: 25056 - RNA, 432 nt, Artificial Sequence
  derived and/or modified sequence opt3 from anti-HIV_cap256-048-113917_VR-Chain
gaggugcagcuggucgaaagcggcgggggacucguucaacccgguggcucccuuagacugucuugcgccgcuucaggguugaccgugagugacacauacaugaacugguuaaggcaggcaccuggaaagggccuggaguggguagccguggucagcuccgaugguucuaauaaaaacuaugcggacucggugaaggggcgguucacuaucucacgcgauaauagcaaaaacacgguuuaccuacagaugaauagucuccgagcugaagacaccgccguguauuacugugcaaaggaucugggagccaacaaagacgaugagugggcuacagacuauuacgaucuuuccgucgcauauccagugccggacccccgugccguaguuggcgcuuuugauguguggggccaggggacuauggucaccgugucuagc

SEQ ID NO: 25057 - RNA, 432 nt, Artificial Sequence
  derived and/or modified sequence opt3 from anti-HIV_cap256-048-112368_VR-Chain
caggugcaacuggucgagagcggcgggggaguugugcagcccgguagaucccucaggcuuucuugcgccgcuucaggcuucaccuuuagucggaacgcaaugcacuggguacgccaggccccugggaagggacuggaauggguggcggucaucagcuacgacggcuccaauaaauauuacgcugauucugugaagggucgauucacaauuucgcgugacaacagcaaaaauacuuuguauuuacagaugaacucacugagagccgaggauacggcaguuuacuauugugccaaggaccuagggggaggcgaaguggaggaaugggcuaccgauuacuaugacuggaguacagcauacccagucgagcauccgagggccgugguaggcguuuuugauauaugggggcaaggaacuaaagugaccgucuccucu

SEQ ID NO: 25058 - RNA, 432 nt, Artificial Sequence
  derived and/or modified sequence opt3 from anti-HIV_cap256-048-112047_VR-Chain
gaggugcagcuggucgaaagcggcgggggacucguucaacccgguggcucccuuagacugucuugcgccgcuucaggguugaccgugaguggauacuauaugagcuggguaaggcaggcaccuggcaaggguuuagaguggcuggccuucauccacuuugacggguccaaaauucauuacgcgggaucugugaagggccggauaacagucucgcgcgauaacagcaaaaauacucuagaccuccagaugaacucacugcgagcugaagauacggccguguauuacugugcaaaggacguuggcgauaguaaauccgacgagugggccaccgauuauuacgaccuuucuguggcuuauccagucccggauccccgugcagugguaggggccuucgacaucuggggacaggguacaaugguuacugugagcucc

SEQ ID NO: 25059 - RNA, 432 nt, Artificial Sequence
  derived and/or modified sequence opt3 from anti-HIV_cap256-048-112029_VR-Chain
caggugcaacuggucgagagcggcgggggaguugugcagcccgguagaucccucaggcuuucuugcgccgcuucacaguucaccuuuaguagcuacggcaugcacuggguacggcaggcaccugggaagggacuggaauggguggccggcaucuccuucgcggguauuaaaaaguauuacgcugacucugucaaagggcgcuuuacaauaucgcgagauaacucaaagaauacuuuguauuuacaaaugaacagccugcguggagaggacacggcccuauacuauugugcaaaagaucucagagaauacgagugcgaagagugggccagugacuauuacgauuucggcagggacuacccaugucaggauccgcggggcgugguugggaucuuugacauuuggggacaggguaccauggugacagucuccucu

SEQ ID NO: 25060 - RNA, 432 nt, Artificial Sequence
  derived and/or modified sequence opt3 from anti-HIV_cap256-048-110957_VR-Chain
caggugagacuggucgagagcggcgggggaguugugagguccggucggucucuccgccuuucaugcgccgcuaguggcuucaccuuuagcaacuucgcacugcacuggguacgacaagcccccgggaagggauuggaauggguggcggucaucuccuacgacggcaauucuaaauuuuaugcugauucggugaagggucguuucacaauuucaacugacaacagcaaaaauacguuauaccugcagaugaacagucuaaccgccgaggauacagcaguuuauuacugugccaaggaccucgggggaaauaaagaugacgaauggggcacugauuauuacgacuuuuccguggcuuauccuguccaggauccaagagcagugucuggcauauucgacguaugggggcauggaaccaugguuacagugagcucc

SEQ ID NO: 25061 - RNA, 432 nt, Artificial Sequence
  derived and/or modified sequence opt3 from anti-HIV_cap256-048-110526_VR-Chain
caggugcaacuggucgagagcggcgggggaguugugcagcccgguagaucccucaggcuuucuugcgccgcuucaggcuucaccuuuaguaauuucggguuucacuggguacggcaggcaccuggaaagggccuggaauggguggccgcgaucagcuucgcugguaauaacaaauacuaugccgacuccgucaaggggcgcuuuacaauuucucgagaaaauucgaaaaacauauuguacuuacagaugaacucacugcguggagaggauacugcaguguauuacugugccaaggaccuaagagaguucgaaugcgaggagugggcuagcgauuauuacgacuggaguacggcauauccaguugaacauccgagggccguggucggcguguuugauaucuggggccaagggaccaaaguaacaguuuccucu

SEQ ID NO: 25062 - RNA, 432 nt, Artificial Sequence
  derived and/or modified sequence opt3 from anti-HIV_cap256-048-109336_VR-Chain
gaggugcagcuggucgaaagcggcgggggacucguucaacccgguggcucccagagacuuucuugcgccgcuucagggcugaccgugaacaguaauuacaugacauggguaaggcaggcaccuggaaagggcuuggaguggguggccaucauuagcuccgacgguucugggcaguauuacgcggauucggucaaaggacgguucacuauaucacgcgacaacagcaagaauacguuaagucugcaaaugaacucccuacgaccagaagauaccgcuguguauuacugugccaaagaccucggcgcaucuaaggaugacgagugggccacagauuauuacgacuuuagcaucgcuuauccgguucaggauccccgugcaguggucggcgccuucgacauuugggggcagggaacuauggugaccguauccuca

SEQ ID NO: 25063 - RNA, 432 nt, Artificial Sequence
  derived and/or modified sequence opt3 from anti-HIV_cap256-048-108152_VR-Chain
caggcccaacugguggagagcggcgggggagucguucagcccgguagaucccucgugcuuucuucaguagcuaguggcuucagcuuuuccaccuacgcaaugcacugggugaggcaggccccugggaagggacuggaaugggucgcggugaucucuuaugacggcgguaacaaauacuaugcugauucgguuaaggggcgguucucaauuagccgcgacaauaguaaaaacacaguguacuugcagauaaauuccuuacgagccgaggauacugcagucuauuacugcgccaaggaccugggagcuaacaaagaugacgaaugggcaacggauuauuacgaccuaucuguggccuacccaguaccggauccccgugcuguugugggcgccuuugacgucuggggccaagggaccauggugacagugagcucc

SEQ ID NO: 25064 - RNA, 432 nt, Artificial Sequence
  derived and/or modified sequence opt3 from anti-HIV_cap256-048-107799_VR-Chain
gaggugcaggucguugaaagcggcgggggagugguacaacccgguagaucccugaggcucucuugcgccgcuucaggcuucaccuuuaguaacuacgcaauggacugggugcggcaggccccugggaagggacuugagugggucgcguucgugagcuccgauggcucuaauaaaaacuaugcugacucgguuaagggucgcuuuacaaucucacgagauaauagcaaaaacacucugaguuugcagaugaacuccuuacgugccgaagacacggcaguguacuauugugccaaggaggucggggaaaauaaagaugacgagugggcuucugauuacuaugaccugagcauugcauacccaauacacgauccgagagccgugguaggaggcuucgacaucuggggccaggggaccaugguuacaguguccuca

SEQ ID NO: 25065 - RNA, 432 nt, Artificial Sequence
  derived and/or modified sequence opt3 from anti-HIV_cap256-048-107384_VR-Chain
gaggugagacuggucgaaagcggcggggcccucguuaagcccggaaccucccuuaggcugucuugcgcugcaucagguuucacauuuacucacuacgccauggacugggugcggcaggcgccuggcaaaggguuggaguggguagcuaucauuaguagcgauggauccacgaagaacuaugccgacucugugaaaggccgcuucaccauaucgcgagauaauucaaagaacacauuaagccugcaaaugaauagucuacguccagaagacacugcagucuacuauugugccaaagaugugggugcuaacaaggacgaugagugggcaaccgacuacuaugaucucuccaucgccuacccgguucccgacccuagagcuguggucggggccuuugauauuuggggacagggcacaauggugaccguaucuagc

SEQ ID NO: 25066 - RNA, 432 nt, Artificial Sequence
  derived and/or modified sequence opt3 from anti-HIV_cap256-048-106530_VR-Chain
gaggugcagcugcucgaaagcggcgggggacuuguccaacccgguggcucccugagauugucuugcgccgcuucaggguucaccuuuaguagcuacgcaauggacuggguuaggcaggccccuggaaagggcuuagaguggguggcgguaaucuccucugaugguucgaacaaaaauuaugcugacucagugaaggggcgguucacaauuagccgcgauaacaguaaaaauacucuguaccuacagauguccucucuccgaccagaagacacggccgucuauuacugugcaaaggaugugggagacagcaaauccgaugagugggccaccgacuauuacgauuuuucaauagcuuauccgauccaggacccccgugcaguugugggcgccuucgauauuuggggccaagggacaauggucacugugaguagc

SEQ ID NO: 25067 - RNA, 432 nt, Artificial Sequence
  derived and/or modified sequence opt3 from anti-HIV_cap256-048-106464_VR-Chain
gaggugcagaugguccaaagcggcgggggacugguucagcccgguggcucccucagacuuucuugcgccgcuuucggguuuaccuucacaaaccacgcaauggacugggugaggcagguaccuggaaagggccuggaauggguggccuuuaucucaagugaugguagcaauaaaaacuacgcggacuccgucaaggggcgguucacuauuucucgcgauaauucgaaaaacacgguguauuugcagaugagcucauuacgaccagaggacaccgcuguuuacuauugugccaaggaugugggagacaguaaauccgaugaaugggcaacagacuacuaugaucugucugucgccuacccggugcccgacccucgugcuguaguuggcgcauuugauauauggggccaagggacuauggugaccgucagcucc

SEQ ID NO: 25068 - RNA, 432 nt, Artificial Sequence
  derived and/or modified sequence opt3 from anti-HIV_cap256-048-106411_VR-Chain
caggugcaacuggucgagagcggcgggggaguugugcagcccgguagaucccucaggcuuucuugcgccgcuucaggcuucaccuuuaguuacagcgggaugcacuggguacggcaggcaccuggaaagggcauggaauggguggccgucaucuccuaugacgguucuaacaaauacuaugcggauucggugaaggggcgcuucacaauuucacgagacaauagcaaaaacacucuguacuugcagaugaauaguuuacguguugaggauacggcuguguaucauugugccaaggaccugggaggcaccaaauccgaugaaugggcaacagacuacuaugaucuaucuauagccuacccaauccaagacccgggcgcugucguggggguauuugauauuuggggacaggguacuaugguuaccgugagcucc

SEQ ID NO: 25069 - RNA, 432 nt, Artificial Sequence
  derived and/or modified sequence opt3 from anti-HIV_cap256-048-106306_VR-Chain
gaggugcagcuggucgaaagcggcgggggacucguucaacccgguggcucccuuagacugucuugcgaggccucaggguucaccuuuaacaauuacggaaugguguggguaaggcaggcuccuggcaaggguuuggaauggguggcaaucauuaguuaugacgggacagagaaauacuaugucgauagcgugaagggacgguucacuauaucccgcgacaacucuaaaaauacguuaucgcugcagaugaacucacuacgagccgaagauaccgcgguuuacuauugugcuaaggaggugggcgagaauaaagacgaugaaugggccagcgacuacuaugaucucaguaucgcauacccaauucacgacccgcgugccgucgugggcggguuugauaucuggggacaggguacaaugguaacuguuuccucu

SEQ ID NO: 25070 - RNA, 432 nt, Artificial Sequence
  derived and/or modified sequence opt3 from anti-HIV_cap256-048-104496_VR-Chain
caggugcaacuggucgagagcggcgggggacucguuaagcccgguggcucccuuagacugucuugcgccgcuucaggguucaccuuuaguagcuacggaaugcacugggugaggcaggcaccuggcaaagguuuggaauggguagccuucguguccucugacgggaacaauaagaacuaugcggauucggucaaaggacgguuuacaaucucacgcgacaauagcaagaacacuguguacuuacagaugaauagucugcgaguugaggauacggcuguguauuacugugccaaagaccuaggcgcaaacaaggaugacgaaugggccaccgauuauuacgaccucuccgucgcuuauccagugccggauccccgugcaguaguuggcgccuucgacgugugggggcagggaacaauggucacugugucuagc

SEQ ID NO: 25071 - RNA, 432 nt, Artificial Sequence
  derived and/or modified sequence opt3 from anti-HIV_cap256-048-103074_VR-Chain
caggugcaccuggucgagagcggcgccgggguugugcaacccggagguucccucagacuuucuugcgcuguaucaggcuucaccuuuaacaguuacgggaugcauugggugaggcaggcaccuggaaagggccuggaaugggucgccgugaucagcuaugacgguuccgauaaauacuaugcggacucuguuaaggggcgguucacaauuucgcgcgauucaagcaaaaauacuuuguacuuacagaugaacagucugcgaguggaggacacggcugucuauuacugugccaaggaucuaggagcaaauaaagacgaugaaugggccaccgacuauuacgaucucuccguggcuuacccaguaccggacccccgugcaguugugggcgccuuugaugucuggggccaggggacaauggugacugugucuagc

SEQ ID NO: 25072 - RNA, 432 nt, Artificial Sequence
  derived and/or modified sequence opt3 from anti-HIV_cap256-048-100832_VR-Chain
caggugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguggccgucguguccucugacgguacaaacaaaaauuauggggauucgguuaagggacgcuucacuaucucacgagacaacagccguaauacgguguacuugcagaugaguuccuuaagaccagaggauaccgcggucuauuacugugcuaaagacgugggcgauacaaagucugacgaaugggccacugauuauuacgacuuuagcauugcauauccgguacaagaucccagggccguugugggcgcuuucgacauaugggggcagggaaccauggucacaguguccuca

SEQ ID NO: 25073 - RNA, 432 nt, Artificial Sequence
  derived and/or modified sequence opt3 from anti-HIV_cap256-048-100188_VR-Chain
caggugcaccuggucgagagcggcgggggaguugugcaacccgguagaucccucaggaucuacugcgccguaucugaguucaccuuucggaacuaugcuaugcauugggugcgccuugcaccuggcaaggggcugcagugggucgccgugauuucauacaauggaggcaaaaaguauuacgcggacaguguuaaaggucgauucacaauaagccgugauaacuccaagaaugcuuuguauuuacagaugaacucucugagagccgaagacacugggcuauacuauugugcaaaagaucucagggaauuugagugcgaagagugggccucggacuacuacgauuucggacgggaguauccaugucaggacccgcgcggcguggucggcacguuugauaucugggggcaaggaaccauggugacaguaucaagc

SEQ ID NO: 25074 - RNA, 432 nt, Artificial Sequence
  derived and/or modified sequence opt3 from anti-HIV_cap256-048-099645_VR-Chain
caggugcaacuggucgagagcggcgggggaguugugcagcccgguagaucccucaggcuuucuugcgccgcuucaggcuucaccuuuagucgguacgcacugcacuggguacgccaggccccugggaagggauuggaauggguggcggucaucagcuaugacggcuccucuaaauacuaugcugauucggugaagggucgauucucaauuagccgugacaacaguaaauacacauuauaucugcagaugaacucccuaagagccgaugacacugcaguuuacuuuugugccaaggaucucggggugaauaaaaaugacgagugggcuacggauuauuacgaccugucugucgcauacccagugcaagauccgaggggaguagccggcauauucgacaucuggggccaggggaccaugguuacagugagcucc

SEQ ID NO: 25075 - RNA, 432 nt, Artificial Sequence
  derived and/or modified sequence opt3 from anti-HIV_cap256-048-098137_VR-Chain
caggugcaacuggucgagagcggcgggggaguugugcagcccgguagaucccucaggcuuucuugcgccgcuucaggcuucacccugcggaacuacgcaaugcacuggguacgccaggccccugggaagggauuggaauggguggcggucaucaguagcgacggcaauaacaaauauuacgcugauuccgugaagggucgauuuacaguuucucgugacaauucgaaagauacuuuauaucugcagaugaacucacuaagaccagaggacacggcccucuacuauugugcaaaggaucugggggaaagggagugcgaagagugggccagcaauuacuaugacuucggacgggauuacccgugucaagacccccgcggcguggucggcaccuuugauauuugggggcagggaacaauggugacuguaaguucc

SEQ ID NO: 25076 - RNA, 432 nt, Artificial Sequence
  derived and/or modified sequence opt3 from anti-HIV_cap256-048-097878_VR-Chain
caggugcaacugcucgagagcggcgggggagucguucagcccgguaagucccuuagacugucuugcgccgcuucaggcuucaccuuuaauacauacgggaugcacugggugaggcaggcaccuggaaaaggcuugcaguggguagccgugaucaguuaugacgguacuauucaaaaguacgcggauagcgucaaagggcgguucacgauaucccgcgaaaauucuaagaacauguuauaucugcagaugaacucgcuacgaggagaggacaccgcuguguacuauugugccaaagaucuccgugaauuugagugcgaagagugggcaucagacuacuaugauuucggcagagacuacccaugucaggauccgaggggcguuguggggacauuugacgucuggggacaugguagccuggugacuguaaguucc

SEQ ID NO: 25077 - RNA, 432 nt, Artificial Sequence
  derived and/or modified sequence opt3 from anti-HIV_cap256-048-097510_VR-Chain
caggugcaacuggucgagagcggcgggggaguugugcagcccgguagaucccucuggcuuucuugcgccgcuucagaguucacccugaggaguuacggcaugcacuggguacggcaggcaccugggaagggauuggaauggguggccuuugucgcguucgacgaaagcgauaaauauuacgcugacuccgugaagggccgcuuuacaaucucucgagauaacucgaaaaauacuuuaucacugcagaugaacagccuacgugccgaggacacggcaguuuauuacugugccaaggaagugggugauaauaaagacgaugagugggcuagugacuauuacgaucucuccauugcauauccaguccaugacccgagagccgugguagggggauucgauauauggggccaaggcaccaugguuacagugucuagc

SEQ ID NO: 25078 - RNA, 432 nt, Artificial Sequence
  derived and/or modified sequence opt3 from anti-HIV_cap256-048-097313_VR-Chain
caggugcaacuggucgagagcggcgggggacucguucagcccgguggcgcccuuagacuguccugcuuggugucuggguucaccuuugacgauuacgcuuuacacuggguaaggcaggcaccuggaaagggcccagaauggguggccguccugucaagugacgguagcuauaaauacuauacagaguccgugcaggggcgguucacuaucucucgcgauaacucgaagaauacgguuuaccuacaaaugaacucacuccgaggaguggacaccgcggucuauuacugugcuaaagaucugggcggcggggaaguggaggaaugggccacagacuauuacgauuggagcauugcauacccgguagagcauccccgugccguugugggagucuuugacauauggggucagggcacuaaggugaccgugaguucc

SEQ ID NO: 25079 - RNA, 432 nt, Artificial Sequence
  derived and/or modified sequence opt3 from anti-HIV_cap256-048-096626_VR-Chain
gaggugcagcuggucgaaagcggcgggggacucguucaacccggugagucccuuagacugucuugcgccggcucaggguucaccuuuaguagcuacuggauguccugggugaggcaggcuccuggaaagggcuuggaauggauggcauuaaucucuuaugacgguucgaacaaauacuauguagauucagugaaggggcgguucacaauuagccgcgacaauaguaaaaacacucuguaccuacagaugaacucccuccgagccgaggauacggcggucuauuacugugcuaaggaccugggaggcaauaaagaugacgaaugggccaccgauuauuacgaccuuucuauagcauacccagugcaggauccgcguguuguggucggcaucuuugacauuugggggcaaggaacaauggugacuguaagcucc

SEQ ID NO: 25080 - RNA, 432 nt, Artificial Sequence
  derived and/or modified sequence opt3 from anti-HIV_cap256-048-096483_VR-Chain
gaggugcagcuggucgaaagcggcgggggacucguucaacccgguagaucccuuaggcugucuugcgccgcuucaggcuucaguuuugaggacuacgcaaugcacugggugcggcaggccccugggaagggauuggaauggguagcgggcaucagcuucgcugguaccaaaaaguauuacgccgauuccgugaaagggcgcuuuacaauuucucgagacaacucgaagaaugcauuauaucugcagaugaacucacuacgugccgaggauacugcucucuacuauugugcaaaagaccugagagaauacgagugcgaggaaugggccagcgauuauuacgacuucggaagggauuacccaugucaggacccgcggggcgucgugggcacguuugauauaugggggcaaggaaccaugguuacagugaguucc

SEQ ID NO: 25081 - RNA, 432 nt, Artificial Sequence
  derived and/or modified sequence opt3 from anti-HIV_cap256-048-095691_VR-Chain
caggugcaacuggucgagagcggcgggggaguugugcagcccggucggucccucaggcuuucuugcgccgcuucaggcuucaccuuuaguagcuacgggauggcauggguacggcaggccccuggaaagggccuggaaugggugacagcgaucuccuucgcugguacuaacaaauauuacgccgacucugucaaggggcgcuuuacgauuucgcgagauaauucaaaagacaccuuguauuuacagauggauggacugcguccagaggacacagcacuauacuauugugccaaggaucucggcgaaagagagugcgaagagugggcuagcaacuacuaugacuucggcagggauuacccgugucaagaccccagaggggugguuggaacuuuugauauauggggucagggcaccauggugacagucaguucc

SEQ ID NO: 25082 - RNA, 432 nt, Artificial Sequence
  derived and/or modified sequence opt3 from anti-HIV_cap256-048-095525_VR-Chain
caggugcaacugguccagagcggcggguccguugugcagcccggaaagucucucagacuuucaugcgccgcuagugguuucaccuuuagcuccuucggcaugcacuggguaaggcagacaccugggaaaggacuggaguggguggcagucaucucuuacgacggcucggaaaagucauaugccgauagcgugaaaggucgguuuacuauuagucgcgacaacuccaagaauacguuguacuuacaaaugaacucucugcgagcggaggauaccgcuguuuauuacugugccaaagaccuagggggaacaaaggaugacgaaugggcaacugauuauuacgacauaagcaucgccuauccagugcaggauccgcgugcugucgcaggcgccuucgacauuuggggccaggggaccauggugacaguauccuca

SEQ ID NO: 25083 - RNA, 432 nt, Artificial Sequence
  derived and/or modified sequence opt3 from anti-HIV_cap256-048-094783_VR-Chain
gaggugcagcuggucgaaagcggcgggggacucguuaagcccgguggcucccuuagacugucuugcgccgcuucagggaucaccuucaguacauacgagaugaacugggugaggcaagcaccuggaaaaggcauggaauggguagccgugauuagcuaugacgguuccaauaaguacuaugcggauucugucaaagggcgguuuacuauaucgcgcgacaacucaaagaauacgguguacuugcagaugaacagcuuacgaggaguugauaccgcuguguauuacugugccaaagaccugggcggcggggaggucgaagagugggcaacagauuauuacgacuggaguaucgccuacccaguggagcacccgcgugcuguaguuggaguguucgauauuuggggucagggcacuaaggucaccguguccucu

SEQ ID NO: 25084 - RNA, 432 nt, Artificial Sequence
  derived and/or modified sequence opt3 from anti-HIV_cap256-048-094356_VR-Chain
caggugcaacuggucgagagcggcgggggaguugugcagcccgguagaucccucaggcuuucuugcgccgcuucaggcuucaucuuuacccacuacgcaauggacuggguacggcaggccccugggaagggacuggaauggguggcggucauuaguagcgauggcuccucuaaaaacuaugcugacucggugaagggucgcuucacaauaucacgagauaauagcaaaaacacuguuaguuugcagaugaacuccuuacguccagaggacacggccguguacuauugugcaaaggaugucggggacaauaaaucugaugaaugggccaccgacuacuaugauuuuagcaucgcuuacccggugcccgacccuagagcaguaguuggagccuucgaucuguggggccaaggcacaauggugacugucuccuca

SEQ ID NO: 25085 - RNA, 432 nt, Artificial Sequence
  derived and/or modified sequence opt3 from anti-HIV_cap256-048-090756_VR-Chain
caggugcaacuggucgagagcggcgggggaguugugagacccgguaggucccuccggcuuucuugcgccguaucaggcuucaccuuuaguaacuacgcuauccacugggugcgccaggcaccugggaagggacuggaaugggucgccgugauuagcuaugacggcuccgauaaauacuaugcggacucuguuaagggucgauucacaauaucgcgugagaauagcaaaaauauguuguacuuacagaugaacucacugagaggggaagauacugcuguguauuacugugccaaggaccuaagggaguuugaaugcgaggagugggcaagugauuauuacgacuucggacgggauuacccaugucaggacccgcgcggcgucgugggcacguuugauguaugggggcauggaucccucguuaccgugucuagc

SEQ ID NO: 25086 - RNA, 432 nt, Artificial Sequence
  derived and/or modified sequence opt3 from anti-HIV_cap256-048-089065_VR-Chain
caggugcaacuggucgagagcggcgggggaguugugcagcccgguagaucccucaggcuuucuugcgccgcuucaggcuucaccuuuaguacauacgcaaugcacuggguacggcaggccccugggaagggacuggaauggguggcguugaucagcuaugacggcacuaacaaauacuaugucgauuccgugaagggucgcuucacgauuucucgagacaauucgaaaaacaccuuauaccugcagaugaacucacuaacagcugaggauacugccguuuauuacugugcaaaggaccucgggggaaauaaagaugacgaauggggcaccgauuauuacgacuuuagcguggccuacccaguccaagauccgcgugcugugaguggcauauucgacguaugggggcauggaacaaugguuaccguguccucu

SEQ ID NO: 25087 - RNA, 432 nt, Artificial Sequence
  derived and/or modified sequence opt3 from anti-HIV_cap256-048-084986_VR-Chain
caggugcaacuggucgagagcggcgggggaguugugcagcccgguagaucccucaggcuuucuugcgccgcuucaggcuucaccuuuagugacuacgcaaugcacuggguacggcaggccccugggaagggacuggaauggguggcguugaucagcuaugauggcuccaacaaauacuaugcugacucugucaagggucgcuucacaauuucgcgagauaauagcaaaaacacuuuauaccugcagaugucaagucuaacggccgaggacaccgcaguguauuacugugccaaggaucucgggggaaauaaaaacgacgaaugggcuacagauuauuacgaccuguccauagcauacccaauccaugauccgcgugccguucuuggcgcuuuugacguguggggccaagggacuaugcugaccgucucuagc

SEQ ID NO: 25088 - RNA, 432 nt, Artificial Sequence
  derived and/or modified sequence opt3 from anti-HIV_cap256-048-083355_VR-Chain
caggugcaacuggucgagagcggcgggggaguugugcagcccgguagaucccucaggcuuucuugcgccguaucaggcuucaucuuuaguagcuacgcuaugcggugggugcgccaggcaccugggaagggacuggaaugggucgccgugauuuccuaugacggcucuaaaaccaacuacgcggauucgguuaagggucgauucacaauaucacgugacaauagcaaaaacacuuuguauuuacagaugaauagucugacguccgaggauaccgcuguguacuauugugccaaggaccuagggggaucuaaaacagaugaauggggcacugacuacuaugaguuuuggaacgcauacccaguccaagauccgagagugguaguuggcgccuucgacaucugggggcacggaaccauggugacagucagcucc

SEQ ID NO: 25089 - RNA, 432 nt, Artificial Sequence
  derived and/or modified sequence opt3 from anti-HIV_cap256-048-082462_VR-Chain
caggugcaccuggucgagagcggcgggggaguugugcaacccgguaagucccucagacuuucuugcaccgccucaagguucaucuuucggaacuacgcuauggacuggguacgccaggcaccuggcaaagggcuggaauggguggccgucauuaguuaugauggagugaaggagcauuacgcggaaagcguuaaaggccgauucacaauaucccgugacaauucuaagaacacuguguauuugcagaugaacucguuaagagucgaggauacggcuguguacuauugugccaaagaccugggugcaaauaaggaugacgaaugggccaccgauuacuaugaccuaucaguagcuuacccaguuccggaucccagggcaguggucggggccuuugacguguggggacagggcacaauggugacugucagcagu

SEQ ID NO: 25090 - RNA, 432 nt, Artificial Sequence
  derived and/or modified sequence opt3 from anti-HIV_cap256-048-082246_VR-Chain
caggugcaccuggucgagagcggcgggggaguugugcaacccgguagaucccucaggaucucuugcgccgcuucaggcuucaccuuuaguaagaacgcaaugcauuggguacggcaggccccugggaaaggacuugaauggguggcguucgucgcuuuugacgagagcgauaaguacuaugccgacuccgugaaaggccgcuucacaauuucucgagauaauucgaagaacauacugucauugcagaugaauagcuuacgugcagaagacacugccguuuacuauugugcuaaagagguggaugaauacaaggacgaugagugggcaagugacuauuacgaucuguccaucgccuauccagucagagacccgagggcugugguagguggguuugauauuuggggacagggcacgaugguuaccgugucugcc

SEQ ID NO: 25091 - RNA, 432 nt, Artificial Sequence
  derived and/or modified sequence opt3 from anti-HIV_cap256-048-080752_VR-Chain
caggugcaacuggucgagagcggcgggggaguugugcagcccgguggcucccucagacuuucuugcgccgcuucaggguucaccuuuaguaauuacggaaugcacuggguaaggcaggcaccuggcaagggucuggaauggguggccuucauccgguaugacggggauauuacauacuaugucgacagcgugaaaggacgcuuuacuauaucccgagauaauucuaagaacgcguuguacuuacagaugaacucgcugcgugcugaggacacggcccuauauuacugugcaaaagaucucagagaauaugagugcgaagagugggccucagacuacuacgauuucggcagggaguauccaugucaagacccgcggggcguuguggggaccuuugauaucuggggacaggguacaauggucacugugagcagu

SEQ ID NO: 25092 - RNA, 435 nt, Artificial Sequence
  derived and/or modified sequence opt3 from anti-HIV_cap256-048-078409_VR-Chain
caggugcaacuggucgagagcggcgggggaguugugcagcccgguagaucccucaggcuuucuugcgccgcuucaggcuucaccuuuaauaauuacgcaauggacuggguacggcaggccccugggaagggacuggaauggguggcguugaucaguuaugauggcagcaacaaauacuaugcugaguccgucaagggucgcuucacaauuucucgagacaauucgaaaaacacuuuauaccugcagaugaacucacuacgugccgaagauacggcaguguauuacugugccaaggacguuggggagaaacaaagcaugaugagaugggcuaccgauuauuacgaccucaguauagcauacccagugccggaucccagggccgucgugggagcuuuugaccuguggggccggggcacaaugguaacuguuuccucu

SEQ ID NO: 25093 - RNA, 432 nt, Artificial Sequence
  derived and/or modified sequence opt3 from anti-HIV_cap256-048-078273_VR-Chain
gaggugcagcuggucgaaagcggcgggggacucguucaacccgguggcucccuuagacugucuugcgccgcuucaggguucaccgugaguagcaacuacauguccuggguaaggcaggcaccuggaaagggcuuggaguggguggccgucaucucuucggacgguucaaauaaaaacuaugcggauagcgugaaggggcgguuuacaauuagucgcgacaauuccaaaaacacuuuauuccugcagaugaacucucuacgaccagaagauacggcuguuuacuuuugugccaaggaccucggagcaaauaaagaugacgagugggccaccgauuauuacgaccugagcauagcuuauccggugcacgauccccgugcagucgugggcaucuucgaccuuuggggccaggggacaaugguaacuguuuccuca

SEQ ID NO: 25094 - RNA, 432 nt, Artificial Sequence
  derived and/or modified sequence opt3 from anti-HIV_cap256-048-078062_VR-Chain
gacguguaccuggucgagagcggcgggggacucguucagcccgguggcucccuuagacugucuugcaccgccucagggaucacauucaguacuuaugaaaugaacugggugaggcaagcuccuggaaagggcuuggaguggguagcauuuguggccuucgaugguagcgacaaauacuaugcggauuccgucaaggggcgguuugugauuucucgcgacaauucgaaaaacacguuaucacugcagaugaauagccuacgagcugaagauaccgccguuuacuauugugcaaaggaggugggagaagacaaagaugacgagugggccagugauuacuaugaccucuccauagcuuacccaguccacgauccgcgugcagugguaggcggcuucgacaucugggggcagggaacaaugguuacugugucuagc

SEQ ID NO: 25095 - RNA, 432 nt, Artificial Sequence
  derived and/or modified sequence opt3 from anti-HIV_cap256-048-077798_VR-Chain
caggugcaacuggucgagagcggcgggggaguugugcagcccgguagaucccucaggcuuucuugcgccgcuucaggcuucaccuuuaguaacuacgggaugcacuggguacggcagacaccuggaaagggccuggaauggguggcagucaucagcuaugacgguuccaauaaauucuacgccgauucugugaaggggcgcuuuacuauuucgcgagacaacagcaaaaauacguuguauuuacagaugaacucacugcguguugaggauaccgcgguguaccauugugcuaaggaccuaggaggcaguaaauccgaugaaugggccacagacuauuacgauuggucuauagcauauccaguccacgacccgagagccgugguaggcguuuucgauaucugggggcaaggaacucucgugaccgucagcucc

SEQ ID NO: 25096 - RNA, 432 nt, Artificial Sequence
  derived and/or modified sequence opt3 from anti-HIV_cap256-048-073853_VR-Chain
gaggugcagcuggucgaaagcggcgggggacucguuaagcccgguggcucccuuagacugucuugcgccgcuucaggguucaccuuuagugacgcauggaugaacugggugaggcaagccccuggaaaaggcuuggaguggguagcggguaucagcuucgcugggacaaauaaguacuaugccgauuccgugaaaggacgguuuacuauuucucgcgacaacucgaagaauacguuauaccugcagaugaacucacuacgagcagaagauaccgcccucuauuacugugcuaaagacaugcgugaguaugaaugcgaggagugggcaagcgauuacuaugacuucggcagagauuacccaugucaggacccgaggggcgucguggggacauuugauauauggggacaggguacuaugguuaccgugaguucc

SEQ ID NO: 25097 - RNA, 435 nt, Artificial Sequence
  derived and/or modified sequence opt3 from anti-HIV_cap256-048-071661_VR-Chain
caggugcaacuggucgagagcggcgggggaguugugcagcccgguagaucccucggccuuucuugcgaaguaucaggguucaccuuuagugacuacuucaugagcuggaucaggcaggccccuggaaagggccuggaguggguggcugucauuucccacgaugguaacaauaaauauuacccagacucugugcaggggcgguuuacaauaucgcgcgaaaacucaaagaauacuuuguauuuacaaaugaacagccugaaaccggaggauacggcaguuuacuucugugccaaggaccuaggaggcgaaagugagguggaggaaugggcguccgauuauuacgacuuuggccgagauauccccgggccugacccacguggagucguggguacccucgauauuuggggccaugggacaaugguaacuguuucuagc

SEQ ID NO: 25098 - RNA, 432 nt, Artificial Sequence
  derived and/or modified sequence opt3 from anti-HIV_cap256-048-071360_VR-Chain
caggugcaacuggucgagagcggcgggggaguugugcagcccgguagaucccucaggcuuucuugcgccgcuucaggcuucacccugacaaacuacgcaauggacuggguacggcaggccccugggaagggauuggaauggguggcggucaucaguagcgauggcuccaauaaaaacuaugaggacucugugaagggucgcuuuacuauuucgcgagauaauagcaaaaacacguuauaccugcagaugucaagucuacguccagaagacaccgcuguuuauuacugugccaaggaugugggggacaauaaauccgaugagugggcaacagacuauuacgauuucucuauagccuauccgguccccgacccuagagcugugguaggagcauuugaucucuggggccaaggcacuaugguuaccgugagcucc

SEQ ID NO: 25099 - RNA, 432 nt, Artificial Sequence
  derived and/or modified sequence opt3 from anti-HIV_cap256-048-070955_VR-Chain
gaggugcagcuggucgaaagcggcgggggacucguucaacccgguggcuccgugagacuuucuugcgccguaucaggguucaccuuuaguagcuacuggauguccugggugaggcaggcuccuggaaagggccuggagugggucgcagugaucucugacucggguucaaauaaauauuacgccgauagcguuaaggggcgguucacaauuagucgcgacaauuccaaaaacacuuuguauuuacagaugaacucucugcgagcggaagauacggcuguguacuuuugugccaaggaccuaggaggccgugagaccgaagagugggcaagcgauuauuacgacuucggcagagauuuuccagggcaggaccaaagggccgucgcuggaguguucgauauguggggucagggcacaaugguaacuguuuccuca

SEQ ID NO: 25100 - RNA, 432 nt, Artificial Sequence
  derived and/or modified sequence opt3 from anti-HIV_cap256-048-070061_VR-Chain
gaggugcagcugcucgaaagcggcgggggacuuguccaacccgguggcucccugagauugucuugcgccgcuucaggguucaccuuuaguagcuacgcaaugcacuggguuaggcaggccccuggaaagggcuuagaguggguggcgguaacauccuaugacgguucuaacaaauacuaugcugauucggugaaggggcgguucacuaucucacgcgacaauagcaaaaacacgcuguacaugcagaugaauagucuacgagccgaagauaccgcagucuauuacugugccaaggaccagggagaguccgaaaaagaggagugggcuucugauuauuacgacuuuggccgugauuacccaggcagagacccgaggcgggugguugcaacauucgccauuugggggcaaggaacuauggugaccgucagcucc

SEQ ID NO: 25101 - RNA, 432 nt, Artificial Sequence
  derived and/or modified sequence opt3 from anti-HIV_cap256-048-069669_VR-Chain
caggugcaacuggucgagagcggcgggggaguugugcagcccgguagaucccucaggcuuucuugcgccguaucaggcuucaccuuuaguaaguucccuaugcacugggugcggcaggcuccagggaaaggacuggaaugggucgcagugaucagcuacgacggcaacaagaaauauuacguugauuccgccaagggucgcuuuacaauuucucgagacaauucgcguaaaacuuuguauuuacagaugacggggcugagaccggaggauaccgcgguguacuauugugcuaaggaccuaggaggcggcgaaugcgagacaugggccucagauuacuaugacuucgggaaggauuaccccugucucgacccuagggaugucgugggaacuuuugacauauggggucaaggcacccugguaacaguuagcagu

SEQ ID NO: 25102 - RNA, 432 nt, Artificial Sequence
  derived and/or modified sequence opt3 from anti-HIV_cap256-048-069205_VR-Chain
caggugcaacuggucgagagcggcgggggaguugugcagcccgguagaucccucaggcuuucuugcgccgcuucaggcuucaccuuuaguagcuacgcaaugcacuggguacggcaggccccugggaagggacuggaauggguggucgugaucuccaacgacggcaauaacaaauauuacgcggauucuguuaagggucgcuucacaauuucgcgagacaauucaaagaacacuguguauuugcagaugaauagcuuacgugcugaggauacggccgucuacuauugugcaaaagacgugggggauaccaaaaaggacgaaugggccacagauuacuaugaccugaguauagcuuacccaguacaagauccgcaggcaguugugggagccuuugacaucuggggccagggcacuauggucaccguguccucu

SEQ ID NO: 25103 - RNA, 432 nt, Artificial Sequence
  derived and/or modified sequence opt3 from anti-HIV_cap256-048-068882_VR-Chain
caggugcaacuggucgagagcggcgggggaguugugcagcccgguagaucccucaggcuuucuugcgccgcuucaggcuucaccuuuaguacauacgcaaugcacuggguacggcaggccccugggaagggacuggaauggguggcguugaucagcuaugacggcacugauaaauacuaugcugacuccgucaagggucgcuucacgauuucucgagauaacucgaaaaauaccguguacuuacagaugaacucacugcgugggguugacacagccguguauuacugugcaaaggaucuaggaggcggcgaggucgaagagugggccacugacuauuacgauuggagcaccgcuuacccaguggaacauccgagagcaguaguugggguguuugacauauggggacaagguacaaaagucaccgugaguucc

SEQ ID NO: 25104 - RNA, 432 nt, Artificial Sequence
  derived and/or modified sequence opt3 from anti-HIV_cap256-048-067764_VR-Chain
gaggugcagcugguccaaagcggcgggggacucguuaagcccgguggcucccuuagacugucuugcgccgcuucaggguucaccuuuaguacauacagcaugaacugggugaggcaggcaccuggaaaaggcuuggaauggguagccgugaucuccucugacgguucgucaaagaauuaugcggauagcgucaaagggcgguucacuauuagucgcgacaacuccaagaauacggugucuuuacagaugaacagccugcgaccagaggauaccgcuguuuacuauugugccaaagacgugggagcaaauaaggaugacgaaugggccacagauuacuaugaccuauccauagcuuacccgguccccgauccucgugcagugguaggcgccuuugacaucuggggccaggggacuaugguuaccgugucaagu

SEQ ID NO: 25105 - RNA, 432 nt, Artificial Sequence
  derived and/or modified sequence opt3 from anti-HIV_cap256-048-066845_VR-Chain
caggugcugcucgucgagagcggcgggggaguugugcaacccgguggcucccuuacccugucuugcgccgcuucaggguucacauuuaguaacuacggaaugcacuggguaagacaggcaccuggcaaggguuuggaauggguggccuucaucagguaugacgggaauaacaaauacuaugcggauagcgucaagggacgguuuacuauuucccgcgacaauucuaaagauacguuauaccugcagauggacggccuacgaccagaggauaccgcucucuauuacugugccaaggaccugggcgaacgugagugcgaagagugggcaucgaacuauuacgauuucgggagagacuacccgugucaggaucccaggggagugguugguacauuugacauauggggccaagggacuauggugaccgucucaagc

SEQ ID NO: 25106 - RNA, 432 nt, Artificial Sequence
  derived and/or modified sequence opt3 from anti-HIV_cap256-048-065226_VR-Chain
gaggugcagcuggucgaaagcggcgggggacucguuaagcccgguggcucccuuaggcugucuugcguggccucaggguucaccuuuaguaacuacggaaugcacuggguaaggcaagcuccuggcaaagguuuggugugggucgcagggaucagcuucgccggaacaaauaaguauuacgcggcuuccgugaaaggccgguuuacuauuucucgcgacaacucgaagaauacguuauaucugcagaugaacucacuacgagccgaggauaccgcacucuacuauugugccaaagacaugcgugaauacgagugcgaagagugggcuagcgauuauuacgacuucggcagagauuacccaugucaggacccgagagggguugugggaacauuugauauauggggucagggcacuauggucaccgugaguucc

SEQ ID NO: 25107 - RNA, 432 nt, Artificial Sequence
  derived and/or modified sequence opt3 from anti-HIV_cap256-048-063717_VR-Chain
caggugcaacuggucgagagcggcgggggaguugugcagcccgguagaucccucaggcuuucuugcgccgcuucaggcuucaguuuuagcaaccacgcaauggacuggguacggcaggccccugggaagggacuggaauggguggcggucaucuccucugauggcucggacaaaauuuacgcugagucagugaagggucgcuucaccauaagccgagauaauaguaaaaacacauuguauuuacagaugaacucccugcguguugaagacacugccguguacuuuugugcaaaggaucuaggggccaauaaagacgaugagugggcuacggacuauuacgaucucucuaucgcauauccagucccggaccccagagccgugguaggagcuuucgauauuuggggccaaggcaccaugguuagcguguccuca

SEQ ID NO: 25108 - RNA, 432 nt, Artificial Sequence
  derived and/or modified sequence opt3 from anti-HIV_cap256-048-063150_VR-Chain
gaggugcagcuggucgaaagcggcgggggaguugugcaacccgguagaucccucaggcuuucuugcgccgcuucaggcuucaccuuuaguagcuacgcaaugcacuggguacggcaggccccugggaagggacuggaguggguggcgcauauccgcuaugacggcuccaauaaauacuauauugauucuguccagggucgauucacaauaucgcgugacaauccaaagaacacuuuguacuuacagaugaacucacugagaacggaagauaccgcuguguauuacugugccaaagaccuagggggaggcgagguugaagagugggcaacagauuauuacgacuggagcaucgccuacccgguggagcaccccagggcugucgugggcguauuugauauuugggggcaaggaacuaagguuaccgugaguucc

SEQ ID NO: 25109 - RNA, 432 nt, Artificial Sequence
  derived and/or modified sequence opt3 from anti-HIV_cap256-048-062431_VR-Chain
caggugcaacuggucgagagcggcgggggaguugugcagcccgguagaucccucaggcuuucuugcgccgcuucaggcuucaccuuuaguaacuucgcaauggacuggguacggcaggccccugggaagggacuggaauggguggcggucaucagcuccgauggcucuaaaaagaauuacggugacucggugaaagggcgcuuuacaauuucacgagauaacagcaagaauacuuuguucuuacagaugaacagucugcguccagaggacacggcucuauauuacugugccaaagaucucggaggcuauaaguccgacgaaugggcaaccgauuacuaugaccugucuauagccuacccgguucaagaucccagaccuuggcuugagcuguuguauaucuggggccagggggcuauggugacagucagcucc

SEQ ID NO: 25110 - RNA, 432 nt, Artificial Sequence
  derived and/or modified sequence opt3 from anti-HIV_cap256-048-060745_VR-Chain
caggugcaacuggucgagagcggcggguccguugugcagcccggaagaucucucaggcuuaccugcacagccucagguuucacuuuuagucacuacgcuauggacuggguacggcaggcaccuggcaaggggcuggaauggguggccgucaucagcuccgaugcgacgaacaaaaauuaugcugacucugugaagggacgcuucaccauuucgcgagauaacagcaaaaauacaguuuacuugcagauggacucauuacgugccgaggauacugcaguguauuacugugccaaggacgucggcgauuauaaagacgaugaaugggcuaccgacuacuaugauuuuaguauagcauacccagugccggaccccagagccguaguuggugcuuucgauuuuugggggcaaggaacaauggugaccgucuccucu

SEQ ID NO: 25111 - RNA, 432 nt, Artificial Sequence
  derived and/or modified sequence opt3 from anti-HIV_cap256-048-060420_VR-Chain
caggugcaacuggucgagagcggcgggggaguugugcagcccgguagaucccucaggcuuucuugcgccgcuucaggcuucaccuuuaguagcuacgggauggcauggguacggcaggccccuggaaagggccuggaaugggugacagucaucuccuucgcgggugugaaaaaguauuacgcugacucuguuaaagggcgcuuuacuauuucgcgagauaacucaaagggaacguuguauuuacagaugaauagccugcgugccgaggacaccgcaguguacuauugugccaaagaugucggcgacacaaagaaggaugaaugggcuacugacuacuaugaucuaaguauagcauacccagugcaagacccgcaggccguaguuggcgcuuucgauaucugggggcagggaaccauggugacagucuccucu

SEQ ID NO: 25112 - RNA, 435 nt, Artificial Sequence
  derived and/or modified sequence opt3 from anti-HIV_cap256-048-060014_VR-Chain
caggugcaacuggucgagagcggcgggggaguugugcagcccgguaggucccucaggcuuucuugcgccgcuucaggcuucaccuuuaguaacuacgggaugcacuggguacggcaggcaccuggaaagggccuggaauggguggccuugaucagccaugacgguuccaauaaaaacuucgcggauucugucaaggggcgcuuuacaauuucgcgagacaauucaaagaacacuuuauaucugcagaugaauagccuacguacggaggauaccgcuauauacuauugugccaaagaccucggaggcgaaagugagaucgaagaguggccauccgauuacuaugacuucggcagagauuacccggugcccgacccuagagggguugugggaacauuugauuucuggggucaaggcacuauggucaccgugucuagc

SEQ ID NO: 25113 - RNA, 432 nt, Artificial Sequence
  derived and/or modified sequence opt3 from anti-HIV_cap256-048-059747_VR-Chain
caggugcaacuggucgagagcggcgggggaguugugcagcccgguagaucccucaggcuuucuugcgccgcuucaggcuucaccuuuacacacuacgcaauggacuggguacggcaggccccugggaagggacuggaauggguggcggucaucaguagcgauggcuccucuaaagacuaugcugauucggugaagggucgcuucacuauuucacgagacaacagcaaaaauacguugaguuuacagaugaacucccugcguccagaggauaccgccguuuacuauugugcaaaggaccuaggggccucuaaagaugacgaaugggcuacagauuacuaugaccucagcauagcauacccggugcaugaucccagagccgucgugggaggcuuugacaucuggggccaagggacuaugguaaccguuuccuca

SEQ ID NO: 25114 - RNA, 432 nt, Artificial Sequence
  derived and/or modified sequence opt3 from anti-HIV_cap256-048-058393_VR-Chain
caggugcaacuggucgagagcggcgggggaguugugcagcccgguggcucccucagacuuucuugcgccgcuucaggguucaccuuuaacacauacggaaugcacuggguaaggcaggcaccuggcaagggucuggaaugggugacuuucauccgguaugacgggaguaaugaguacuaugccgauagcgucaaaggacgcuuuacgauuucccgagacaacucuaagaauaccuuguacuuacagaugaacucgcugucaguggaagauacagcgguuuauuacugugcuaaagaccuaggcaagaauaaagaugacgagugggccacugauuauuacgacauaagcaucgcauacccagugccggauccccgugccgucgugggcguauucgacauuugggggcaaggaaccguugugacagucaguucc

SEQ ID NO: 25115 - RNA, 432 nt, Artificial Sequence
  derived and/or modified sequence opt3 from anti-HIV_cap256-048-058159_VR-Chain
caggugcaacuggucgagagcggcgggggaguugugcagcccgguagaucccucaggcuuucuugcgccgcuucaggcuucaccuuuaguagcuacccuaugcacuggguacggcaggcaccagggaaaggacuggaauggguggccgucaucuccuucgcgggcacaaacaaauauuacgcucauucugugaagggucgcuuuacuauuucgcgagacaauucaaagaacacguuguauuuacagaugaauagccugcgugccgaggauaccgcacuauacuauugugccagagaccucagggaaagugagugcgaagagugggcuuccgauuacuaugacuucgggcgggaguacccgugucaagauccccgcggaguugugggcacauuugacauauggggcagagggacuauggucaccgugucuagc

SEQ ID NO: 25116 - RNA, 432 nt, Artificial Sequence
  derived and/or modified sequence opt3 from anti-HIV_cap256-048-057127_VR-Chain
gacguguaccuggucgagagcggcgggggacucguucagcccgguggcucccuuagacugucuugcguggccucagggaucaccuucaguagcuauggaaugcacuggguaaggcaagcuccuggcaaggguuuggaaugggcagccuuuauucgguacgaugggcgcaacaaauauuacgcggacuccgugaagggacgauucacaauaucucgugauaauucgaaaaacacuuuaucacugcagaugaauaaccuaagagcugaggacacggccgucuauuacugugcaaaggaagugggcgauaauaaagacgaugagugggccagcgacuauuacgaucucaguaucgcuuacccaguucaggacccgagggcaguggucggcggguaugauauuuggggacaggguaccauggugacaguauccucu

SEQ ID NO: 25117 - RNA, 432 nt, Artificial Sequence
  derived and/or modified sequence opt3 from anti-HIV_cap256-048-056251_VR-Chain
gaggugcagcuggucgaaagcggcgggggacucguucaacccgguagaucccuuaggcugucuugcgccggcucaggguucaccuuuaguaacuucggauuucacugggugcggcaggcuccuggcaaggguuuggaguggguagcagccaucagcuucgcgggguacaauaaauauuacgcugacuccgugaagggacgcuuuacaauuucucgagaaaacucgaauaacauguuauaucugcagaugucaagccuacgugccgaggauacugcagucuacuauugugccaaagaccucagagaaagugagugcgaggaaugggcuuccgauuacuaugacuucggcaaggauuacccaugucaggacccgaggggcgugguugggacguuugauguguggggacaugguucucuggucaccgugagcucc

SEQ ID NO: 25118 - RNA, 432 nt, Artificial Sequence
  derived and/or modified sequence opt3 from anti-HIV_cap256-048-055421_VR-Chain
caggugcaacuggucgagagcggcgggggaguugugcagcccgccagaucccucaggcuuucuugcgcugcaucagguuucaucuuuaguaccuacggcaugcacuggguacggcaggccccugggaagggacuggaauggguggcggucauuagcuccgacgguucuucgaaagauuaugcugacucagugaagggccgcuucacaauaagccgagauaacaguaaaaauacuuuguccuuacagaugaacucucugcguccagaggacacggccguuuacuauugugcaaaggaucuaggggccagcaaagacgaugaaugggcuaccgacuacuaugauuuuuccaucgcauacccggugcaagaccccagagccgucgugggagcuuucgauauuuggggccagggcacaaugguaacuguuucaagu

SEQ ID NO: 25119 - RNA, 432 nt, Artificial Sequence
  derived and/or modified sequence opt3 from anti-HIV_cap256-048-054989_VR-Chain
caggugcaacuggucgagagcggcgggggaguugugcagcccgguggcucccucagacuuucuugcgccgcuucaggguucaccuuuaguacaaacggaaugcacuggguaaggcaggcaccuggcaagggucuggaauggguggccuucauccgguacgacgggagcaauaaauauuacgcggauuccgucaagggacgcuuuacuauuucucgagacaacucgaaaaauacgguguauuugcagaugaacucauuacguggcguugauaccgcuguguacuauugugccaaggaccugggcgggggagaggucgaagagugggcaacagauuacuaugacuggagcauagccuacccaguggaacauccgagagcuguaguugguguguucgauaucuggggccaagggacuaaagucaccgugaguucc

SEQ ID NO: 25120 - RNA, 435 nt, Artificial Sequence
  derived and/or modified sequence opt3 from anti-HIV_cap256-048-054759_VR-Chain
caggugcaacuggucgagagcggcgggggaguugugcagcccgguagaucccucaggcuuucuugcgccgcuucaggcuucaguuuuagcaagaacgggaugcacuggguacggcaggcaccuggaaaaggccuggaauggguggccuucgucgcguuugacgaguccgauaaguacuaugcugacucugugaaaggucgcuucaccaucucgcgagauaauucaaagaacacauugagcuuacagaugaauagucugcguguugaagacacugccguguacuauugugcaaaagaggucggggaaaacaaggaugacgagugggccgcuccagauuacuaugacuuuuccauugcauacccggugcaagaucccagagccguaguuggaggcuucgacauauggggccaggggacgauggugaccgucucuagc

SEQ ID NO: 25121 - RNA, 432 nt, Artificial Sequence
  derived and/or modified sequence opt3 from anti-HIV_cap256-048-052573_VR-Chain
caggugaagcuggucgagagcggcgggggaguugugcaacccgguagaucccucaggcuuucuugcgccgcuucaggcuucaguuuuagcaacuacgcaauggacuggguacggcaggccccugggaaaggacuggaauggguggcggucguguccucugauggcucgaauaagaacuaugcugacucaguuaaaggucgcuucaccaucagccgagauaauaguaagaacacaguguacuugcagaugaacuccuuacgugccgaggacacugcagucuauuacugugccaaagaucugggggcuaauaaggacgaugaaugggcaacggacuauuacgauuggucuauugccuauccagugcacgacccgagagcuguaguuggaguguuugauauauggggccagggcacccuagucacagugagcucc

SEQ ID NO: 25122 - RNA, 432 nt, Artificial Sequence
  derived and/or modified sequence opt3 from anti-HIV_cap256-048-051477_VR-Chain
caggagcaacugguggaaagcggcgggggagucguucagcccgguagaucccucaggcuuucuugcgccgcuucaggcuucaccuuuaguaacuacgcaaugcacugggugcggcaggccccugggaagggacuggaguggguagcggcuaugagccaugacggcuccgauaaauauuacgccgacucugugaagggucgcuucacaaucucgcgagauaauucaaagaacacuuuguauaugcagaugaauagcuuacgugcagaagacacggccgucuacuauugugcuaaagaucaaggggagagugaaaaagaggagugggcauccgacuacuaugaucugucuauugccuacccaauacaggacccgagagcuauggugggagccuuugauaucuggggccagggcaccaugguuacagugagcucc

SEQ ID NO: 25123 - RNA, 432 nt, Artificial Sequence
  derived and/or modified sequence opt3 from anti-HIV_cap256-048-051299_VR-Chain
caggugcaacuggucgagagcggcgggggaguugugcagcccgguagaucccucaggcuuucuugcgccgcuucaggcuucaccuuuaguacauucgggaugcacuggguacggcaggcaccuggaaagggccuggaauggguggccuugaucagccaugacgguaacaauaaauacuaugcggauuccuuaaaggggcgcuuuacuauuucucgagagaacucgaaaaauacgcuguuccuacagaugaacucacuccgugcugaagacaccagcgucuacuauugugccaaggaucugggagacagugagugcgaagagugggcauccgauuacuaugacuuuggcaaagauuacccaugucuucacccgagaggcgugguugggacauucgacuuuuggggacaugguacuauggugaccgucucuagc

SEQ ID NO: 25124 - RNA, 432 nt, Artificial Sequence
  derived and/or modified sequence opt3 from anti-HIV_cap256-048-050815_VR-Chain
caggugcaacuggucgagagcggcgggggaguugugcagcccgguggcucccucagacuuucuugcguagugucaggguucaccuuuaguagcuacggaaugcacugggucaggcaggccccuggcaagggucuggaauggguguccuucauccgguuugacgggaacuaugaguacuauguugauucugugaaaggacgcuucacaauuucgcgagacaauucaaagaacacugucuacuugcagauggauagcuuacgugcugaagacacggcaguguauuacugugccaaagauguaggcgacuauaaggaugacgagugggcgaccgauuacuacgacuuuaguauagcuuauccaguuccggaucccagagccguggucggcgcauucgacuuuugggggcaaggaacaauggugacuguguccucu

SEQ ID NO: 25125 - RNA, 432 nt, Artificial Sequence
  derived and/or modified sequence opt3 from anti-HIV_cap256-048-049884_VR-Chain
caggugcaacuggucgagagcggcgggggaguugugcagcccgguagaucccucaggcuuucuugcgccgcuucaggcuucaguuuuaacaccuacgcaaugcacuggguacggcaggccccugggaagggacuggaauggauggcguugaucagcuaugacggcuccaauaaauacuauguggauucugucaagggucgcuucacaauuucgcgagacaacagcaaaaauacuuuauaccugcagaugaacucacuacgugcugaggauacggccguguauuacugugcaaaggaccucgggggaaauaaagaugacgaaugggccaccgauuauuacgaccugaguauagcuuacccaguucaagauccgagaguggucgugggcaucuuugacauuuggggccaggggacaaugguaacuguuuccucu

SEQ ID NO: 25126 - RNA, 432 nt, Artificial Sequence
  derived and/or modified sequence opt3 from anti-HIV_cap256-048-049170_VR-Chain
caggugcaacuggucgagagcggcgggggaguugugcagcccgguagaucccucaggcuuucuugcgccgcuucaggcuucaucuuuaguagcuacgggaugcacuggguacggcaggcaccuggaaagggccuggaauggguggccgucauuuccggugacgggaccaaaaaggauuucgcggacucugugaaaggacgcuuuacaauaucgaaggauaacagcaaaaauaugguuucauugcagaugaacaguuuacgagcugaggacgccgcaguguauuacugugccaaggaucugggcgaauccgacaaugaggaauggccaucugauuauuacgacuucggccgugauuuuacugggcaaaacccgagagcugucgugggaacguucgaccuauggggucagggcaccaugguaacaguuagcucc

SEQ ID NO: 25127 - RNA, 435 nt, Artificial Sequence
  derived and/or modified sequence opt3 from anti-HIV_cap256-048-048531_VR-Chain
caggugcaacuggucgagagcggcgggggaguugugcagcccgguagaucccucaggcuuucuugcgccgcuucaggcuucaccuuuaguagcuacgggcugcacuggguacggcaggcaccuggaaagggcuuggaauggguggccuucaucuccuaugacgguaacaauaaacauuacgucgauucugugaaggggcgcuuuacaauuucgcgagacaacagcaaaaauacuuuauaucugcagaugaacucacuacgugcggaggauacggcuguuuacuauugugccaaggaccucggaggcgaaagugagauagaagagugggcaaccgauuacuaugacuucuccaucgccuacccagugaaagagucuagaggcgucguggggauuuuugauauguggggacaagguacaaugguaacuguuagcucc

SEQ ID NO: 25128 - RNA, 432 nt, Artificial Sequence
  derived and/or modified sequence opt3 from anti-HIV_cap256-048-048259_VR-Chain
caggugcaacuggucgagagcggcgggggaguugugcagcccgguagaucccucaggcuuucuugcgccgcuucaggcuucaccuuuaguacaugugcaaugcacuggguacggcaggccccugggaagggacuggaauggguggcggucaucagcuacgacggcuccaacaaauauuacguggauucuguuaagggucgcuucacuauuucgcgagacaauucaaagaacacguuguauuuacagaugaauagccugcgugcugaggauaccgccguguacuauugcgcaaaagaagucgacauaaacaaagaggaugaaugggccagugacuacuaugauuuuuccaucgcuuacccagugcaagacccgagagcaguaguugggggauucgauauuuggggccagggcacaauggugacugucucuagc

SEQ ID NO: 25129 - RNA, 432 nt, Artificial Sequence
  derived and/or modified sequence opt3 from anti-HIV_cap256-048-047313_VR-Chain
caggugcaacuggucgagagcggcgggggaguugugcagcccgguagaucccucaggcuuucuugcgccgcuucaggcuucaccuuuaguacauucgggaugcacuggguacggcaggcaccuggaaagggccuggaauggguggccgucaucagccaugacgguaacaauaaauacuaugcggauuccgugaaggggcgcuuuacuauuucucgagacaacucgaaaaauacgguuuacuugcagaugaacucauuacgugcugaggauaccgccguguauuacugugcaaaggaccugggagccaauaaagaugacgaaugggcuacagauuauuacgaccuaagcgucgcauauccagugccggaucccagagccguaguuggcgcuuucgacguguggggccaagggacuauggucaccgugaguucc

SEQ ID NO: 25130 - RNA, 432 nt, Artificial Sequence
  derived and/or modified sequence opt3 from anti-HIV_cap256-048-046596_VR-Chain
caggugcaacuggucgagagcggcgggggaguugugcagcccgguggcucccucagacuuucuugcgccgcuucaggguucaccuuuaguagcuacggaaugcacuggguaaggcaggcaccuggcaagggucuggaauggguggccuucaugcgguuugacggguccaaccgcuauuacggagauucugucaaaggccgauucacaaucucgcgugacaauucaaagaacacuuuguauuuacagaugaauagccugagaacggaggaugcggcucuauacuauugugccaaagacaugagggaauuugagugcgaagagugggcaagugauuacuaugacuucggccgggauuacccaugucaagacccgcgcggggugguuggaauuuuugauauauggggucagggcaccauggugacagucuccucu

SEQ ID NO: 25131 - RNA, 432 nt, Artificial Sequence
  derived and/or modified sequence opt3 from anti-HIV_cap256-048-044781_VR-Chain
caggugcaacuggucgagagcggcgggggaguugugcagcccgguagaucccucaggcuuucuugcgccgcuucaggcuucaccuuuacaaguuacgcaauccacuggguacggcaggccccugggaagggacuggaauggguggcggucauuagcuaugacggcuccaaaaagaacuacgcugauucugugaaaggucgcuucacuauaucgcgagacaauucaaagaacacguuguauguucagaugaauagcuuacgugccgaggauaccgcaguguacuauugugccaaagaagucggggaggacaaggaugacgaaugggcuagugauuacuaugaccuguccaucgcauacccagugcaugauccgagagccguaguuggaggcuuugacauuuggggccaagggacaauggugacugucucuagc

SEQ ID NO: 25132 - RNA, 432 nt, Artificial Sequence
  derived and/or modified sequence opt3 from anti-HIV_cap256-048-042599_VR-Chain
caggugcaacuggucgagagcggcgggggaguugugcagcccgguagaucccucaggcuuucuugcgccgcuucaggcuucaccuuuaguaacuacgggaugcacuggguacggcagacaccuggaaagggccuggaauggguggcagucaucagcuaugacgguuccaauaaauucuacgccgauucugugaaggggcgcuuuacuauuucgcgagacaacagcaaaaauacguuguauuuacagaugucaagucugcgugcggaugacaccgcuguuuacuauugugccaaggaggugggagaagauaaagacgaugagugggcauccgacuacuaugaucuaucuauagccuacccaguccaugacccgagagcugugguaggcggcuucgauaucugggggcaaggaacaaugguuacugugagcucc

SEQ ID NO: 25133 - RNA, 432 nt, Artificial Sequence
  derived and/or modified sequence opt3 from anti-HIV_cap256-048-041276_VR-Chain
caggugcaacuggucgagagcggcgggggaguugugcagcccgguagaucccucaggcuuucuugcgccgcuucacgguucaccuuuaguagcuacgcaaugcacuggguacgccaggccccuggcaaggggcuggaauggguggcgaucauuuccuaugacggaucuaacaaauacuaugcugauucggucaagggccgauucacaauaucacgugacaauagcaaaaacacuuuguuuuuacagaugaauagucugagagccgaggauacggcacuauacuauugugccaaggaccucgguggguacaaauccgaugaaugggcuaccgacuauuacgaucugucuaucgcauacccaauucaagacccgagggccgugguuggagcuuucgauaucuggggccagggcacaauggugacugucagcucc

SEQ ID NO: 25134 - RNA, 432 nt, Artificial Sequence
  derived and/or modified sequence opt3 from anti-HIV_cap256-048-040200_VR-Chain
caggugcaacuggucgagagcggcgggggaguugugcagcccgguagaucccucaggcuuucuugcguagccucaggcuucaccuuuaguagcuucgggaugcacugggugcggcaggcuccuggaaagggccuggaaugggucgcagugaucucccaugacggucacaacaaauacuaugccgauucuuugaaggggcgcuuuacaguuucgcgagagaauagcaaaaauacuuuauuccugcagaugaacucacuacgugcggaagacacgaguguguacuauugugcuaaggaucucggaggcggcgagugcgaagagugggccuccgacuacuaugauuuugggagagacuacccaugucugaccccgaggggagucguggguacauucgauauuuggggccaugggacuaccguaacaguuucuagc

SEQ ID NO: 25135 - RNA, 432 nt, Artificial Sequence
  derived and/or modified sequence opt3 from anti-HIV_cap256-048-039061_VR-Chain
gaggugcagcugcucggcagcgggggaggucuuguccaacccggcgggucccugagauugaccugcgccguuucuggauucacauuuucaaguuucgcuaugagcugggugaggcaggcaccuggcaaggguuuagaauggguagcccugaucuccuacgacgggacugauaaauauuacgcggacucugugaagggacgguuuacgauuucgcgcgauaacagcaaaaauacccuauaucuccagaugaacucacugcgagucgaggacacagcuauauaccacugugccaaggaucuuggcggcacuaaaagugacgaaugggcaaccgauuauuacgaccuguccaucgccuauccaauucaggauccgggggcugugguuggaguguucgacaucuggggucaaggcacaauggucaccgugucuagc

SEQ ID NO: 25136 - RNA, 432 nt, Artificial Sequence
  derived and/or modified sequence opt3 from anti-HIV_cap256-048-038515_VR-Chain
caggugcaacuggucgagagcggcgggggaguugugcagcccgguagaucccucaggcuuucuugcgccgcuucaggcuucaccuuuaguacauacgcaaugcacuggguacggcaggccccugggaagggacuggaauggguggucgugaucagcuaugacggcuccaacaaauacuaugcggauucuguuaagggucgcuucacuauuucgcgagacaauucaaagaacacguuguuuuuacagaugaauagccugcgugcugaggauaccgcccuauacuauugugcaaaagacgugggggaauacaaaagugaugagugggccacagacuauuacgaucucuccauagcuuacccaauccaagacccgagagcaauggucggagccuucgauauuuggggccagggcacuauggugaccguaucuagc

SEQ ID NO: 25137 - RNA, 432 nt, Artificial Sequence
  derived and/or modified sequence opt3 from anti-HIV_cap256-048-038255_VR-Chain
caggugcaacuggucgagagcggcgggggaguugugcagcccgguagaucccucaggcuuucuugcgccgcuucaggcuucacccugaguagcuacgcaaugcacuggguacggcaggccccugggaagggauuggaauggguggcggucaucuccuaugacggcucuaacaaauacuaugcugauucggugaagggucgcuuuacaauuucacgagacaauagcaaaaacgccuuauaccugcagaugaauagucuacgugcagaggauacugcccucuauuacugugcuaaggaccugagagaauaugagugcgaagagugggcauccgauuacuacgacuucgggagggauuauccaugucaagacccgcggggaguugugggcacguuugauauauggggccaggggaccauggucacagugucuagc

SEQ ID NO: 25138 - RNA, 432 nt, Artificial Sequence
  derived and/or modified sequence opt3 from anti-HIV_cap256-048-038177_VR-Chain
caggugcaacuggucgagagcggcgggggaguugugcagcccgguagaucccucaggcuuucuugcgccgcuucaggcuucaccuuuaauacauacgggauccacuggguacggcaggcaccuggaaagggccuggaauggguggccuugauuaguuaugacgguacugauaaauacuaugcggacagcgucaaggggcgcuucacgauaucccgagauaauucuaaaaacaccuuauaccugcagaugaacucgcuacguguggaggacacagcuaucuaucauugugccaaggaucucggaggcacuaaaucagacgaaugggcaaccgauuacuaugaccugagcauugccuacccaauccaagauccgggcgcuguugugggggucuuugacauuuggggacaggguacaauggugaccguaaguucc

SEQ ID NO: 25139 - RNA, 432 nt, Artificial Sequence
  derived and/or modified sequence opt3 from anti-HIV_cap256-048-035513_VR-Chain
caggugcaacuggucgagagcggcgggggaguugugcagcccgguagaucccucaggcuuucuugcgccgcuucaggcuucaccuuuaguagcuacgggauggcauggguacggcaggccccuggaaagggccuggaaugggugacagucaucuccuucgcgggugugaaaaaguauuacgcugacucuguuaaagggcgcuuuacuauuucgcgagauaacucaaagggaacguuguauuuacagauggacggccugcguccagaggauaccgcccuauacuauugugcaaaagaccucggcgaaagagagugcgaagagugggccagcgauuacuaugacuucgggagggauuuuccgugucaagacccccggggaguggucgguacauucgauauauggggccaggggacuauggugaccguaaguucc

SEQ ID NO: 25140 - RNA, 432 nt, Artificial Sequence
  derived and/or modified sequence opt3 from anti-HIV_cap256-048-034112_VR-Chain
cagaugcaacugguggagagcggcgggggagucguucagcccgguagaucccucaggcuuucuugcgccgcuucaggcuucaccuuuaacaguuacgcaaugcacugggugcggcaggccccugggaagggacuggaauggguagcggugaucagcuaugacggcuccaauaaauacuaugcugauucugucaagggucgcuucacaauuucgcgagacaacagcaaaaauacuguguacuugcagaugaacucauuacgugggguugauacggccguguauuacugugcaaaggaccugggaggcggcgaggucgaagagugggccaccgauuauuacgacuggaguauagcuuacccaguggaacauccgagagcaguaguugggguguuugauaucuggggacaagguacaaaagucacuguguccucu

SEQ ID NO: 25141 - RNA, 432 nt, Artificial Sequence
  derived and/or modified sequence opt3 from anti-HIV_cap256-048-033983_VR-Chain
caggugcaacuggucgagagcggcgggggaguugugcagcccggugaaucccucagacuuucuugcgccgcuucaggcuucacccugaguagccacgggauccauuggguaaggcaggcaccuggaaagggcuuggaguggguggccuuuauuuccucugacgguucgaacaaaaauuacggggauucagucaagggacgguucacaauaagccgcgacaacaguaaaaauacuuuauuucugcagaugaacucccuacgagcggaagauacggcucucuauuacugugccaaggacgugggcgaguauaaaucugaugaaugggcaaccgacuacuaugaucugagcaucgccuacccaauucaagacccgcgugcuaugguuggcgcauucgauaucugggggcagggaacaauggugacugucuccuca

SEQ ID NO: 25142 - RNA, 432 nt, Artificial Sequence
  derived and/or modified sequence opt3 from anti-HIV_cap256-048-032688_VR-Chain
caggugcaacuggucgagagcggcgggggaguugugcagcccgguagaucccucaggcuuucuugcgccgcuucaggcuucaucuuuaacaguuacgggaugcacuggguacggcaggcaccuggaaagggccuggaauggguggccgucgugcauggugacgggggaaauaaauauuacgcggauagcguuaagggccgcuucaccauuucccgagacaacucuaaaaauacauuguauuuagagaugaacucgcugcgugcugaagauacugccgaguacuauugugcaaaggaccuaggcgaaucagauaaagaggaguggccaagcgacuacuaugauuuugggagagacuucacgggacaggugccgagggccgucgugggugcuuuugauauauggggccaagggaccaugguaacaguuaguucc

SEQ ID NO: 25143 - RNA, 432 nt, Artificial Sequence
  derived and/or modified sequence opt3 from anti-HIV_cap256-048-031092_VR-Chain
caggugcaacuggucgagagcggcgggggaguugugcagcccgguagaucccucaggcuuucuugcgccgcuucaggcuucaguuuuuacaacuucgcaauggacuggguacggcaggccccugggaagggacuggaauggguggcggucaucagcuccgauggcgguaauaaaaacuauguggacucuguuaaggggcgcuuuaccauuucgcgagauaauucaaagaacacauuguacuuacagaugaauagccugcgugcugaggacacugccguguauuacugugcaaaagaucuaggaggcacgaaagacgaugaaugggccaccgacuauuacgauauaaguaucgcuuauccaguccaagacccgagagcaguggccggcgcuuucgauauuugggggcagggaacaaugguaacuguuuccucu

SEQ ID NO: 25144 - RNA, 435 nt, Artificial Sequence
  derived and/or modified sequence opt3 from anti-HIV_cap256-048-030464_VR-Chain
caggugcaacuggucgagagcggcgggggacucguuaagcccgguggcucccuuagacugucuugcgaagccucaggguucaguuuuaccaacuacuauaugagcuggaucaggcaggcuccuggaaaaggcuuggaguggguggcaguaauuuccuucaauggucggaacaaguacuaugccgacuuugugaaagggcgcuucacaauaucucgagauaauucgaagaacacuuuaucacugcagaugaauagccuacgugucgaagacacggcgguguacuauugugcuaaagagguuggagaaaacaaggaugacgagugggccgcaccagauuacuaugacuuuaguaucgccuacccggugcaggaucccagagcugucgugggcggcuucgacauuugggggcaaggaaccaugguaacaguuuccucu

SEQ ID NO: 25145 - RNA, 432 nt, Artificial Sequence
  derived and/or modified sequence opt3 from anti-HIV_cap256-048-030289_VR-Chain
caggugcaacuggucgagagcggcgggggaguugugcagcccgguggcucccucagacuuucuugcgccgcuucaggguucaccuuuaguagcuacggaaugcacuggguaaggcaggcaccuggcaagggucuggaauggguggccuucauccgguaugacggguccaacaaauacuaugcggauucugucaagggacgcuuuacaauuucgcgagacaauucaaagaacacuguguacuugcagaugaauagcuuacguguugaggauacggcuguguauuacugugccaaagaccugggcgcaaacaaagaugacgaaugggccaccgauuauuacgaccuaagugucgcuuacccagugccggaucccagagcaguaguuggcgccuucgacgugugggggcaaggaacaauggucacuguguccucu

SEQ ID NO: 25146 - RNA, 432 nt, Artificial Sequence
  derived and/or modified sequence opt3 from anti-HIV_cap256-048-030261_VR-Chain
caggugcaacuggucgagagcggcgggggaguugugcagcccgguggcucccucagacuuucuugcgccgcuucaggguucaccuuuaguacauucggaaugcacuggguaaggcaggcaccuggcaagggucuggaauggguggccgucaucagccaugacggguccaacaaauacuaugcggauucuuugaagggacgguuuacuauuucgcgcgagaauagcaaaaauacguuauaccugcagaugaacucacuacgacucgaagacaccgcuguguaucacugugccaaggaucugggcggcaguaaauccgacgagugggcaacagauuacuaugaccuuucuguugccuacccagugcaagauccgcgugcugucguggggguauucgacauauggggacaggguacuaugguuaccgugagcucc

SEQ ID NO: 25147 - RNA, 432 nt, Artificial Sequence
  derived and/or modified sequence opt3 from anti-HIV_cap256-048-029362_VR-Chain
caggugcaacuggucgagagcggcgggggaguugugcagcccgguagaucccucaggcuuucuugcgccgcuucacaguucaccuuuaguagcuacggcaugcacuggguacggcaggcaccugggaagggacuggaauggguggccggcaucuccuucgcggguacaaacaaauauuacgcugacucugucaaggggcgcuuuacuauuucgcgagauaauucaaagaacacguuguauuuacaaaugaauagccugcguaccgaggacgccgcacuauacuauugugccaaagauaugagagaguucgaaugcgaagagugggcuagugacuacuaugauuuuggaagggacuacccaugucaggauccgcggggcgugguuggcauauucgacaucugggggcagggaacaauggugacugucuccucu

SEQ ID NO: 25148 - RNA, 432 nt, Artificial Sequence
  derived and/or modified sequence opt3 from anti-HIV_cap256-048-027638_VR-Chain
caggugcaacuggucgagagcggcgggggaguugugcagcccgguagaucccucaggcuuucuugcguagccucaggcuucaucuuuaguagcuacgggauucacugggugcggcaggcuccuggaaagggccuggaaugggucgcagugauauccggugacgggaccaacaaauauugugccgauucuguuaagggacgcuucacaaucucgcgagacaauucaaagaacacuguguuuuugcagaugaauagcuuacgugcggaggauacggcugucuucuacugcgccaaagaccugggcgaaagugauaaagaggaauggccauccgacuauuacgauuuuggcagagacuucaccgggcaagugccgagggcaguaguuggagccuuugauauuuggggucagggcacaauggugacugucucuagc

SEQ ID NO: 25149 - RNA, 432 nt, Artificial Sequence
  derived and/or modified sequence opt3 from anti-HIV_cap256-048-027613_VR-Chain
gugcagcaacuggucgagagcggcggggacguugugcagcccggaaccucccucagacuuucuugcgaagccucaggucugaucuugaguggcuacggguuacacuggguaaggcaggcuccuggaaagggcauggaguggguggcagucauuagcuaugaugguuccaacaaauacuaugccgacucugugaaggggcgguucacaauaucgcgcgauaauucaaagaacacuguuuaccugcagaugaauagccuacgaggaguggacacggcggucuauuacugugcuaaagaucucggcggcggggaaguggaggaaugggccaccgacuauuacgauuggaguacagcauacccaguagagcauccgcgugccguugugggagucuuugacaucuggggucaaggcacuaaagugaccguguccucu

SEQ ID NO: 25150 - RNA, 432 nt, Artificial Sequence
  derived and/or modified sequence opt3 from anti-HIV_cap256-048-026627_VR-Chain
caggugcaacugcucggcagcgggggagguuccguccagcccggcgggucucuuagacugaccugcgccguuucaggauucacauuuaguagcuucgcuauguccugggugaggcaggcaccuggcaaggguuuggaguggguagccuuuaucucuucggacgggacuaacaaaaauuacggagauucagugaagggccgguucacgauuagccgcgacaacaguaaaaauaccuuauuucugcagaugaacucccuacgagcggaagauacagcucucuauuacugugccaaggaccugggcggguauaaaucugaugagugggcaacugacuacuaugaucuuagcauagccuacccaauccaagacccgcgugcugucgugggagcauucgauauuuggggucagggcaccaugguuacaguguccuca

SEQ ID NO: 25151 - RNA, 432 nt, Artificial Sequence
  derived and/or modified sequence opt3 from anti-HIV_cap256-048-026239_VR-Chain
cagaugcaacugguggagagcggcgggggagucguucagcccgguagaucccucaggcuuucuugcgccgcuucaggcuucaccuuuaacaguuacgcaaugcacugggugcggcaggccccugggaagggacuggaauggguagcggugaucagcuaugacggcuccaauaaauacuaugcugauucugucaagggucgcuucacaauuucgcgagacaacagcaaaaauacuuuguacuuacagaugaacucacugcguacggaggaugccgcacuauauuacugugccaaggacaugagagaauuugagugcgaagagugggcuagugauuauuacgacuucgggagggauuacccaugucaagacccgcggggagugguuggcauauuugauaucuggggccaggggaccauggugacagucuccucu

SEQ ID NO: 25152 - RNA, 432 nt, Artificial Sequence
  derived and/or modified sequence opt3 from anti-HIV_cap256-048-025518_VR-Chain
caggugcaacuggucgagagcggcgggggaguugugcagcccgguagaucccucaggcuuucuugcgccguaucaggcuucaccuuuagucagcacgcuaugcauugggugcggcaggcaccugggaagggacuggaaugggucacauugaucagcaacgacggcacugagaaauucuacgccgauuccgugaagggucgcuuuacgauuucucgagacaauucgaaaaacaccuuauaucugcaaaugaacucacuaagcguugaagauacagcgguguacuauugugcuaaggaccucgggaaaaauaaggaugacgagugggccacugauuacuaugacauaaguaucgcauacccagucccggauccccgugccgugguaggaguuuucgacauuuggggccagggcaccguggucacaguguccucu

SEQ ID NO: 25153 - RNA, 432 nt, Artificial Sequence
  derived and/or modified sequence opt3 from anti-HIV_cap256-048-024854_VR-Chain
caggugcaacuggucgagagcggcgggggaguugugcagcccgguagaucccucacccuuucuugcgccgcuucaggcuucacauuuaauaauuacgacaugcacuggguaaggcaggcaccugggaagggacuggaauggguggccuucacucgguaugauggcaguaaccaguacuaugcggacagcgucacgggucgcuuuaccaucucccgagauaauucuaaaaacacaguguacuugcaaaugaacucguuacgugggguugacacugcuguguauuacugugccaaggaucugggaggcggcgaggucgaagagugggcaaccgacuauuacgauuggucaauugccuacccaguggaacauccgagagcuguaguugggguguucgacauauggggacaggguacaaaagucaccgugagcagu

SEQ ID NO: 25154 - RNA, 432 nt, Artificial Sequence
  derived and/or modified sequence opt3 from anti-HIV_cap256-048-024537_VR-Chain
caggugcaacuggucgagagcggcggggccguugugcagcccggaagaucccucaggcuuucuugcguagcuucagguuucaccuuuaguagcuacgcaaugcacugggugcggcaggccccuggcaaggggcuggacugggucgcguugaucuccuaugauggaucuaacaaauacuucgcugacucggugaagggccgcuuugccauuucacgagauaauagcaaaaacacauuauaucugcagaugaauagucuacguccagaagacacugcaguuuacuauugugccaaggaucucggugggggagagugcgaaacgugggcuuccgacuacuaugauuucggcaaagacuacccgugucuggaucccagagacguggucggcaccuuugauauaugggugcaagggacacuuguaacuguuucuagc

SEQ ID NO: 25155 - RNA, 432 nt, Artificial Sequence
  derived and/or modified sequence opt3 from anti-HIV_cap256-048-021781_VR-Chain
caggugcaccuggucgagagcggcgggggacucguuaagcccgguggcucccuuagacugucuugcgaagccucaggguucaguuuuagcaacuacgcuauggacugggugaggcaagcaccuggaaaaggcuuggaguggguagccuucguguccucugaugguucgaauaagaacuaugcggacucagucaaagggcgguuuaccaucagccgcgauaauaguaagaacacaguguacuuacagaugaacucccugcgaguugaagacacugcuguguauuacugugccaaagaucuaggagcaaauaaggacgaugagugggccacggacuauuacgaucucucugucgcuuauccagugccggacccccgugcaguaguuggcgccuucgauguguggggccaggggaccauggucacagugagcucc

SEQ ID NO: 25156 - RNA, 432 nt, Artificial Sequence
  derived and/or modified sequence opt3 from anti-HIV_cap256-048-021758_VR-Chain
caggugcaacuggucgagagcggcgggggaguugugcagcccgguagaucccucaggcuuucuugcgccgcuucaggcuucaccuuuagucgguacgggaugcacuggguacgccaggcaccuggaaagggccuggaauggguggccgucaucagcuaugacgguuccaaagaguacuaugcggauucugugaaggggcgauucacaauuucgcgugacaacucaaaagauacuuuguacuuacagaugagcagucugagaguugaagacacggcuguguauuacugugccaaggaugucggagcaaauaaagacgaugagugggccaccgacuauuacgaucuauccauagcuuacccagugccggaccccagggcaguaguuggcgccuuugauaucuggggccaagggacaauggugacugucucuagc

SEQ ID NO: 25157 - RNA, 432 nt, Artificial Sequence
  derived and/or modified sequence opt3 from anti-HIV_cap256-048-020988_VR-Chain
caggugcaacuggucgaaagcggcgggggaguugugcagcccgguagaucccucaggcuuucuugcgaagccucagcuuucaccuuuaguagcuacggcaugcacuggguacggcaggcaccugggaagggacuggagugggugacauucaucuccuauucuggcaacaauaaauacuaugccgacucggucaagggucgcuuuacugugucacgagauaacagcaaaaauacguuguacuuacagaugaacagucugaccuccgaagacacagcgguuuauuacugugcuaaggaucuagggggaucuaaaacugacgaguggggcaccgauuauuacgaguucuggaaugccuacccagugcaagacccgcgugucgugguaggcgcauuugauauuugggggcauggaacaaugguuaccgugagcucc

SEQ ID NO: 25158 - RNA, 435 nt, Artificial Sequence
  derived and/or modified sequence opt3 from anti-HIV_cap256-048-020663_VR-Chain
caggugcaacuggucgagagcggcgggggaguugugcagcccgguaugucccucagacuuucuugcgccgcuucaggcuucaccuuuaguaauuucgggaugcacuggguaaggcaggcaccuggaaagggccuggaauggguggccgucaucagccaugacgguaauaacaaauacuauccagauuccgugcaggggcgguuuacaauuucucgcgaaaauucgaagaacacuuuguacuuacaaaugaacucacugaaaccggaggacacggcgguuuauuucugugcuaaggaucuaggaggcgagagcgaaguggaggagugggccagugacuacuaugauuuuggccgagacauacccgggccugauccacguggagucguggguacccucgacaucuggggccacgggacaaugguaacuguuuccucu

SEQ ID NO: 25159 - RNA, 432 nt, Artificial Sequence
  derived and/or modified sequence opt3 from anti-HIV_cap256-048-020590_VR-Chain
caggugcaacuggucgagagcggcgggggaguugugcagcccgguggcguaccuagacucgccugcgcugcauccggguucaccuuuucuucauacgccaugcacugggugaggcaggcgccaggaaagggccuugaaugggucacagugaucaguuaugacgguagcaauaaauacuaugcugauuccguuaaggggcgguucacuauuucucgcgacaauucgaaaaacacgcuguacuugcagaugaacucauuacgagccgaggauaccgcaguguauuacugugccaaggaccugggaggcacaaaagaugacgaaugggcuacugauuauuacgacauaagcaucgcauacccgguccaagauccccgugccguggcuggcgccuuugacauuugggggcagggaaccaugguaacaguuaguucc

SEQ ID NO: 25160 - RNA, 432 nt, Artificial Sequence
  derived and/or modified sequence opt3 from anti-HIV_cap256-048-019765_VR-Chain
caggugcaacuggucgagagcggcgggggaguugugcagcccgguagaucccucaggcuuucuugcgccgcuucaggcuucaucuuuaccaacuacgcaauggacuggguacggcaggccccugggaagggacuggaauggguggcggucauuaguagcgauggcuccaauaaaaacuaugcugacucugugaagggucgcuucacaauaucgcgagauaauagcaaaaacacuguuucauugcagaugaauaguuuacgugccgaggacacggcaguguacuauugugccaaggaucugggggacuccaaaaaggaugaaugggcuaccgacuacuaugaucuaucuaucgcauacccagucccggaccccagagccgugguaggagcuuuugauauuuggggccaaggcacaaugguuacugugagcucc

SEQ ID NO: 25161 - RNA, 432 nt, Artificial Sequence
  derived and/or modified sequence opt3 from anti-HIV_cap256-048-019254_VR-Chain
caggugcaacuggucgagagcggcgggggaguugugcagcccgguagaucccucaggcuuucuugcgccgcuucaggcuucaccaguagcacauacgcaaugcacuggguacggcaggccccugggaagggacuggaauggguggcguugaucuccuaugacggcacugauaaauacuaugcugacucugucaagggucgcuuuacgauuucgcgagauaacagcaaaaauaccuuauaccugcagaugaacucacuacguguggaggacacagccguuuaucauugugcaaaggaucucgggggaaauaaaccagacgaaugggccacugauuacuaugaccugaguauagcuuacccggugcaagaucccagagcagucgugggcguauucgacaucuggggccaggggaccauuaucacaguuuccucu

SEQ ID NO: 25162 - RNA, 432 nt, Artificial Sequence
  derived and/or modified sequence opt3 from anti-HIV_cap256-048-018073_VR-Chain
caggugcaacuggucgagagcggcgggggaguugugcagcccgguagaucccucaggcuuucuugcgccgcuucaggcuucagucugagcuccuacgcaauggacuggguacggcaggccccugggaagggauuggaauggguggcggucaucucuucggauggcaccaacaaauauuacgcugacucagugaagggucgcuuuacaauuacucgagauaauagcaaaaacacguuauaucugcagaugaauagucuacguguugaggacaccgcccucuacuauugugcaaaggauaugggggaauccgagaaagaagagugggccucugacuacuaugauuucggaagagacauaccaggccaagauccgaggggcgagguggggagcuuugacaucuggggacaggguacaauggucacuguguccuca

SEQ ID NO: 25163 - RNA, 432 nt, Artificial Sequence
  derived and/or modified sequence opt3 from anti-HIV_cap256-048-016775_VR-Chain
gaggugcagcuggucgaguucggcgggggacucguucaacccgguagaagccuuaggcuguccugcgccgcuucugcauuuaccuucucacacuacggcauccauugggugcggcaggccccugggaagggauuggaauggguagcggugauuagucacgacggcagcacaaaagauuaugcugacuccgucaagggucgcuuuacuauaucucgagauaacucgaaaaauacgauguacuuacagaugaacucacugcgugccgaagacaccgcaguguauuacugugccagagaucuaggggagagcgaaacagaggagugggcuacugacuauuacgauuucaguaucgcauauccaguucagaauccgaggggagugauuggcguccucgacaucuggggccuggggaccauggugacaguauccucu

SEQ ID NO: 25164 - RNA, 432 nt, Artificial Sequence
  derived and/or modified sequence opt3 from anti-HIV_cap256-048-016069_VR-Chain
caggugcaacuggucgagagcggcgggggaguugugcagcccgguagaucccucaggcuuucuugcgccgcuucaggcuucaccuuuaguaaguacgcaaugcacuggguacggcaggccccugggaaaggacuggaauggguggcguucgucgcuuuugacgagagcgccaaguucuaugcagauuccgugaaaggccgcuuuacaaucucucgagacaacucgaagaauacuuugucauuacagaugaacagccugcgugccgaagauacggcuguuuacuauugugcaaaagaggugggugaaaauaaggacgaugagugggccagugacuacuaugaucuauccauugcuuacccaguccaugacccgagagccgugguagggggauucgauguuuggggccaaggcaccauggugacagucucuagc

SEQ ID NO: 25165 - RNA, 432 nt, Artificial Sequence
  derived and/or modified sequence opt3 from anti-HIV_cap256-048-015867_VR-Chain
caggugcaacuggucgagagcggcgggggaguugugcagcccgguagaucccucaggcuuucuugcucagccaguggcuucagcuuuaccaacuacgcuauggacuggguacggcaggcaccugggaagggacuggaauggguggccgucaucuccucugauggcucgaauaaaaacuaugcggacucagugaagggucgcuucacaauuagccgagauaauaguaaaaacacuuuguuuuuacagaugaacucccugcguccagaggacacggcuguuuacuucugugccaaggaucuaggggcaaauaaagacgaugaaugggccaccgacuauuacgaucucucuauagcuuauccggugcacgaccccagagcagucgugggaaucuuugaucuguggggccaaggcacaaugguaacuguuagcucc

SEQ ID NO: 25166 - RNA, 432 nt, Artificial Sequence
  derived and/or modified sequence opt3 from anti-HIV_cap256-048-015673_VR-Chain
caggugcaccuggucgagagcggcgggggaguugugcaacccgguagaucccucaggcuuucuugcgccgcuucaggcuucaccuuuaguaacuucgcaaugggguggguacggcaggccccuggaaagggccuggaauggguggcguuuaucagcuccgacgguacaaauaaaaacuacggggauucugucaagggacgcuucacuauuucgcgagacaauucaaagaacacguuguuuuuacagaugaauagccugcgugcugaggauaccgcccuauauuacugugcaaaagaccucggcggcuauaaaagugaugaaugggccacagacuacuaugaucuguccauagcuuacccaauccaggacccgagagcagugguuggggccuucgauauuuggggacaagguacuauggugaccgucucuagc

SEQ ID NO: 25167 - RNA, 432 nt, Artificial Sequence
  derived and/or modified sequence opt3 from anti-HIV_cap256-048-015156_VR-Chain
caggugcaacuggucgagagcggcgggggaguugugcagcccgguagaucccucaggcuuucuugcgccgcuucaggcuucaccuuuaguguauacgcacugcacugggugcggcagacaccugggaagggauuggaaugggucgccuuaaucagcuaugacggcacuaacaaauacuauguggauuccguuaagggucgcuucacgauuucucgagacaauucgaaaaacacccuguaccuacagaugaacucacucacagcggaggauacugcuguguauuacugugccaaggaccuugggggaagcaaaaaugaugaaugggcaaccgacuauuacgaucugaguauagccuacccaauccaagacccgcgugcugucgcaggcauuuuugauguguggggcagagggacaaugguaaccguuuccucu

SEQ ID NO: 25168 - RNA, 432 nt, Artificial Sequence
  derived and/or modified sequence opt3 from anti-HIV_cap256-048-014521_VR-Chain
gaggugcagcuggucgaaagcggcgggggacucguucaacccgguagaucccuuaggcugucuugcgccgcuucaggcuucaucuuuaguagcuacgggauucacugggugcggcagggaccuggcaaggguuuggaguggguagcauuaauauccggggacggaaacaauaaauauuacgccgauucugugcagggccgcuucucgaucucacgagacaacagcaagaauacccuguaucuacagaugaacagucuccgugcggaagauacagcugucuacuauugugccaaagaccugggcgaguccgauaaggaagaguggccaucugacuacuaugauuuugggagagacuucacuggacaagauccgagggcagugguugguguguuugacauuuggggccaggggacgaccgucaucgugagcucc

SEQ ID NO: 25169 - RNA, 432 nt, Artificial Sequence
  derived and/or modified sequence opt3 from anti-HIV_cap256-048-014475_VR-Chain
caggugcaacuggucgagagcggcgggggaguugugcagcccgguagaucccucaggcuuucuugcgccgcuucaggcuucaccuuuaauacauucgggaugcacuggguacggcaggcaccuggaaagggccuggaauggguggccgucaucagucaugacgguaauaacaaauacuaugcggauagcuugaaggggcgcuuuacuauuucccgagaaaauucuaaaaacacguuauuccugcagaugaacucgcuacgugcugaggacaccucaguguacuauugugccaaggaucucggacacggcgagugcgaagagugggcaagcgacuacuaugauuuuggcaaagacuacccaugucugacaccgagagggguugccggaacuuucgauauauggggucauggcaccacagugaccgucaguucc

SEQ ID NO: 25170 - RNA, 432 nt, Artificial Sequence
  derived and/or modified sequence opt3 from anti-HIV_cap256-048-013798_VR-Chain
caggugcaacuggucgagagcggcgggggaguugugcagcccgguagaucccucaggcuuucuugcgccgcuucaggcuucaccuuuaacaauuacgggacacacuggguacggcaggcaccuggaaagggccuggaauggguggccgucaucagugacagcgguuccaacaaauauuacgcggauucugugaaggggcgcuucacuauuucgcgagacaauucaaagaacacguuguauuuacagaugaauagccugcgugcugaggauaccgccguuuacuuuugugcaaaagaccuaggaggcagagaaacagaggaaugggccagugauuauuacgacuucggcagggauuuuccagggcaagaccagcgggcuguggcaggagucuucgauauguggggucagggcacuauggugaccguauccucu

SEQ ID NO: 25171 - RNA, 432 nt, Artificial Sequence
  derived and/or modified sequence opt3 from anti-HIV_cap256-048-013271_VR-Chain
gaggugcagcuggucgaaagcggcgggggaguugugagacccgguggcucccucaggcuuucuugcgccgcuucaggguucaucuuuaguagcuacggcauucacuggguacggcaagcaccuggaaagggucuggaguggguggccgucauauccggggacggaaccaacaaauauugugcggauucugugaagggccgcuucacaaucucgcgagacaauagcaaaaacacuuuguacuuacagauuaauucacugcguguugaagauacggcuguguauuacugcgccaaggaccuaggcaaaaacaaggaugacgagugggcaaccgauuauuacgaccucaguaucgccuauccagucccggaucccagagcugugguagggguuuuugacauuuggggacaggguacaguggucacuguguccucu

SEQ ID NO: 25172 - RNA, 432 nt, Artificial Sequence
  derived and/or modified sequence opt3 from anti-HIV_cap256-048-013180_VR-Chain
caggugcaacuggucgagagcggcgggggaguugugcagcccgguagaucccucaggcuuucuugcgccgcuucaggcuucaccuuuaguaagaacgggaugcacuggguacggcaggcaccuggaaaaggccuggaauggguggccuucgucgcguuugacgguagcgauaaguacuaugcugacuccgugaaagggcgcuucguuaucucucgagauaauucgaagaacacauugucauuacagaugaauagccugcgugccgaggacacugcaguguacuauugugccaaagaagucggagaggauaaggacgaugaaugggcuagugacuacuaugaucuauccauugcauacccagugcaugacccgagagccguaguuggcggcuuugauauaugggggcaaggaacgauggugaccgucucuagc

SEQ ID NO: 25173 - RNA, 432 nt, Artificial Sequence
  derived and/or modified sequence opt3 from anti-HIV_cap256-048-012148_VR-Chain
caggugcaacuggucgagagcggcgggggaguugugcagcccgguagaucccucaggcuuucuugcgccgcuucaggcuucaccuuuacacacuacgcaauggacuggguacggcaggccccugggaagggacuggaauggguggcggucaucaguagcgauggcuccucuaaaaacuaugcugacucggugcgcggucgauucacuauuucacgugauaauagcaagaacacguugaguuuacugaugaaugggcuaagaccagaggacaccgccguuuacuauugugcaaaagaugugggagacgucaagaacgaugaaugggccacagacuacuaugaucucuccauagcuuacccggugcaggaccccagggcaguaguuggcgccuuugauuucuggggccaagggacuauggugaccgucucugcu

SEQ ID NO: 25174 - RNA, 432 nt, Artificial Sequence
  derived and/or modified sequence opt3 from anti-HIV_cap256-048-011870_VR-Chain
caggugcaacuggucgagagcggcgggggaguugugcagcccgguagaucccucaggcuuucuugcgccguaucaggcuucaccuuuaguuucuacgggaugcacugggugcggcaggcuccuggaaagggccuggaaugggucgcagugaucagcuaugacgguaacaauaaauacuauguugauuccgugaaggggcgcuuuauuauaucucgagacaacucgaaaaauacauuguacuuacagaugaacucacugcgugucgaggauacugccguguauuacugugcgagagaccuaggagaaagggagaaugaagagugggcuacggauuauuacgacuucagcaucgccuacccaauugagggcccgcggggcguaguugggguguuugauaucuggggacgcgguaccauggucacagugaguucc

SEQ ID NO: 25175 - RNA, 432 nt, Artificial Sequence
  derived and/or modified sequence opt3 from anti-HIV_cap256-048-011530_VR-Chain
caggugcaccuggucgagagcggcgggggaguugugcaacccgguagaucccucaggcuuucuugcgccgcuucaggcuucaguuuucggaacuacgcaauggacuggguacgccaggccccugggaagggacuggaauggguggcggucaucagcuccgauggcucugacaaacauuaugcugauucggugcgaggucguuucaccauuucaagagacaauagcaagaacacauuguacuuacagaugaauagucugaggguugaggauacugccguguauuacugugcaaaagaccuaggggccaacaagaaugaugaaugggcuacggacuauuacgauuuuuccauagcauauccagucccggacccccgggccgugguaggagcuuucgauaucuggggccagggcaccaugguuacagugucuagc

SEQ ID NO: 25176 - RNA, 432 nt, Artificial Sequence
  derived and/or modified sequence opt3 from anti-HIV_cap256-048-010968_VR-Chain
caggugcaacuggucgagagcggcgggggaguugugcagcccgguagaucccucaggcuuucuugcgccgcuucaggcuucaucuuuaguagcuacgggaugcacuggguacggcaggcaccuggaaagggccuggaauggguggccuugauuuccggugacgggucuaacaaauauuacgcggauucggucaagggacgcuucaccauaucacgagacaauagcaaaaacacauuauaucugcagaugaauagucuacgugcugaggauuccgcccucuacuuuugugcaaaggaccugggcgaaucugauaaagaggaauggccaagcgacuauuacgauuucggcagagacuuuacugggcaagugccgagggccguugugggaaucuucgauauguggggucagggcacgauggucaccguguccuca

SEQ ID NO: 25177 - RNA, 426 nt, Artificial Sequence
  derived and/or modified sequence opt3 from anti-HIV_cap256-048-010224_VR-Chain
gaggugcaccuggucgaaagcggcggggaccucguucagcccggagguucccuuagacugucuugcgugguaucagaguucaccuuuaguagcuacggcaugcauugggugaggcaagccccugggaagggauuggaaugggucgcuuucauccgguaugauggcuccaacaaauacuaugcagacucugugaagggucgcuuuacaauuucgcgagauaauucaaaaguuuacuuagagaugaacagccugcgugccgaagacacugcgguguauuacugugcuaaggaggucggggagaauaaagaugacgaaugggccagugauuauuacgaccuauccauagcauacccaauccacgauccgagagccgugguaggaggcuucgacauuuggggccaggggacgaugguuaccgugucuagc

SEQ ID NO: 25178 - RNA, 432 nt, Artificial Sequence
  derived and/or modified sequence opt3 from anti-HIV_cap256-048-009749_VR-Chain
caggugcaacuggucgagagcggcgggggaguugugcagcccgguagaucccucaggcuuucuugcggcgccucaggguucaccuuuaguagcuacgcuaugcacuggguacggcaggcaccuggacgcggccuggaauggguggccuucacauccucugacgguucgaacaagaauuauggggauucagucaaaggacgauuuacuaucagccgugacaacaguaagaauacguuguucuuacagaugaacucccugagagcggaggauaccgcucuauacuauugugccaaagacgugggcgaauacaagucugaugagugggcaacagacuauuacgaucucagcauugccuauccaauacaagacccgagggcuaugguuggcgcauuugauaucugggggcagggaacuauggugaccgucuccuca

SEQ ID NO: 25179 - RNA, 432 nt, Artificial Sequence
  derived and/or modified sequence opt3 from anti-HIV_cap256-048-009623_VR-Chain
caggugcaacuggucgagagcggcgggggaguugugcagcccgguagaucccucaggcuuucuugcgccgcuucaggcuucaguuuuagcaaguacgggaugcacuggguacggcaggcaccuggaaaaggccuggaauggguggccuucgucgcguuugacgagggugauaaguauuacguggacuccguuaaagggcgcuucaccaucucucgagauaacucgaagaauacauugucauuacagaugaacagccugcgugcugaagacacugccguguauuacugugcaaaagaggucggagaaaauaaggaugacgagugggccagugauuauuacgaccuauccauugcuuauccaauacaugauccgagagcagugguaggcggcuuugacaucugggggcaaggaacgaugguuaccgugucuagc

SEQ ID NO: 25180 - RNA, 432 nt, Artificial Sequence
  derived and/or modified sequence opt3 from anti-HIV_cap256-048-008234_VR-Chain
caggugcaacuggucgagagcggcgggggaguugugcagcccgguagaucccucaggcuuucuugcgccgcuucaggcuucaccuuuacaaacuacgcaauggacuggguacggcaggccccugggaagggacuggaauggguggcggucaucaguagcgauggcuccaauaaaaacuaugcugacucugugaagggucgcuucacuauuucgcgagauaauagcaaaaacacgguuuacuugcagaugucaaguuuacguccagaggacaccgccguguauuacugugcaaaggaugucggggacacaaaauccgaugaaugggccacugacuauuacgaucugucuauagcuuauccggugcaagaccccagagcaguaguuggagccuuugauaucuggggccagggcaccauggugacagucagcucc

SEQ ID NO: 25181 - RNA, 432 nt, Artificial Sequence
  derived and/or modified sequence opt3 from anti-HIV_cap256-048-008149_VR-Chain
caggugcaacuggucgagagcggcgggggaguugugcagcccgguagaucccucaggcuuucuugcgccgcuucaggcuucaccuuuaguguauacacaaugcacugggugcggcaggcaccugggaagggacuggaaugggucgccgugaucagcuaugacggccgcaacaaauacuaugcggauuccguuaagggucgauucacuauuucucgugacaauucgaaaaacacgguguacuugcagaugaacucauuaagagucgaggauaccgcuguguauuacugugccaaggaccugggggcaaauaaagaugacgaaugggccacagauuauuacgaccuaagcguagcuuacccaguuccggaucccagggcaguggucggagccuuugacguguggggccaaggcacuauggugaccgucaguucc

SEQ ID NO: 25182 - RNA, 432 nt, Artificial Sequence
  derived and/or modified sequence opt3 from anti-HIV_cap256-048-007301_VR-Chain
caggugcaacuggucgagagcggcgggggaguugugcagcccgguagaucccucaggcuuucuugcgccgcuucaggcuucaguuuuaacuacuaugcaauggacuggguacggcaggccccugggaagggacuggaauggguggcggucaucagcuccgauggccgcaauaaaaacuacgcugacucugugaagggucgauucaccauuucgcgugauaauucaaagaacacauuguauuuacagaugaauagccugaguguugaggacacugccguguacuauugugcaaaagaucuagggaaaaacaaggacgaugaaugggccacggacuacuaugauauauccaucgcuuacccagucccggaccccagagcagugguaggaguuuuugauauuuggggccaaggcaccguggucacagugucuagc

SEQ ID NO: 25183 - RNA, 432 nt, Artificial Sequence
  derived and/or modified sequence opt3 from anti-HIV_cap256-048-007174_VR-Chain
caggugcaacuggucgagagcggcgggggaguugugcagcccggucggucccucaggcuuucuugcgccgcuucaggcuucaccuuuaacaguuacgggauggcauggguacggcaggccccuggaaagggccuggaauggguggcguugaucagcuaugacgguuccaauaaauacuaugcugauucuguccgcgggcgauucacaauuucgcgugacaacucaaaggauacuuuauaccugcagauggacggacuaagaccagaggauacggcccucuauuacugugcaaaagaccugggcgaaagcgagugcgaagagugggccagugauuauuacgacuuuggcagggauuacccgugucuugcucccagaggggugccuggaaccuucgacauauggggucaaggcacaaugguuacuguguccucu

SEQ ID NO: 25184 - RNA, 432 nt, Artificial Sequence
  derived and/or modified sequence opt3 from anti-HIV_cap256-048-007079_VR-Chain
caggugcaacuggccgagagcggcgggggagucguucagcccgguagaucccucaggcuuucuugcgcugcaucaggcuucaccuuuaguaucuacgggaugcacugggugcggcaggccccuggaaagggccuggaauggguagcguucauuuugagcgacgguacagauaaauauuccgcugacucugugaaggggcgcuuuacuauaucgcgagauaacagcaaaaauacguuauaccugcagaugaacucacuacgugccgaggacaccgcagucuauuacugugccaaggaucucggaaaagcuaaggacgaugaaugggcaacagacuauuacgauuucaguaucgccuauccagugcaugacccgagaggcguugcuggcauuuuugauaucugggggcaaggaacuauggugaccgucuccucu

SEQ ID NO: 25185 - RNA, 432 nt, Artificial Sequence
  derived and/or modified sequence opt3 from anti-HIV_cap256-048-007033_VR-Chain
caggugcaacuggucgagagcggcgggggaguugugcagcccgguagaucccucaggcuuucuugcgccgcuucaggcuucaccuuuaguaauuucggguuucacuggguacggcaggcaccuggaaagggccuggaauggguggccgcgaucagcuucgcugguaauaacaaauacuaugccgacuccgucaaggggcgcuuuacaauuucucgagaaaauucgaaaaacauauuguacuuacagaugaacucacugcguggagaggauacugcaguguauuacugugccaaggaccuaagagaguucgaaugcgaggagugggcuagcgauuauuacgacuuuggcagggauuauccaugucaagacccgcggggcguuguggggacguucgaugucuggggacaugguagucucgugaccguauccucu

SEQ ID NO: 25186 - RNA, 432 nt, Artificial Sequence
  derived and/or modified sequence opt3 from anti-HIV_cap256-048-006128_VR-Chain
caggugcaacuggucgagagcggcgggggaguugugcagcccgguagaucccucaggcuuucuugcgccgcuucaggcuucaccuuuaguacauacgcaaugcacuggguacggcaggccccugggaagggacuggaauggguggcguugaucagcuaugacggcacugauaaauacuaugcugacuccgucaagggucgcuucacgauuucucgagauaacucgaaaaauaccuuauaccugcagaugaacucacuacguguggaggacacagccguuuaucauugugcaaaggaucucgggggaagcaaaagugacgaaugggccacugauuacuaugacugguccauagcuuacccagugcacgauccgagagcagucgugggcguauuugacaucuggggccaagggacccugguuacagugucuagc

SEQ ID NO: 25187 - RNA, 432 nt, Artificial Sequence
  derived and/or modified sequence opt3 from anti-HIV_cap256-048-005999_VR-Chain
caggugcaacuggucgagagcggcgggggaguugugcagcccgguagaucccucaggcuuucuugcgccgcuucaggcuucaccuuuacacacuucgcaauggacuggguacggcaggccccugggaagggacuggaauggguggcggucaucaguagcgauggcuccucuaaaaacuacgcugacucggugaagggucgcuuuacuauuucacgagauaauagcaaaaacacgguuaguuugcagaugaacuccuuacguccagaggacaccgccguguauuacugugcaaaggaucugggggccaauaaagacgaugaaugggcuacagacuauuacgaucuaucuauagcauauccgguccccgacccuagagccgugguaggagcuuucgauaucuggggccaaggcacuaugguuaccgugagcucc

SEQ ID NO: 25188 - RNA, 432 nt, Artificial Sequence
  derived and/or modified sequence opt3 from anti-HIV_cap256-048-005394_VR-Chain
caggugcaacuggucgagagcggcgggggaguugugcagcccgguagaucccucaggcuuucuugcgccgcuucacaguucaccuuuaguagcuacggcaugcacuggguacggcaggcaccugggaagggacuggaauggguggccgcgaucuccuucgcuggcacaaacaaauauuacgccgacucugucaagggucgcuuuacuauuucgcgagauaauucaaagaacgcauuguauuuacaaaugaauagccugcgugccgaggacacggcucuauacuauugugcaaaagaucucagagaguucgaaugcgaagagugggccagugacuacuaugauuuugggagggacuacccaugucaggauccgcggggagugguuggcaccuucgacauauggggccaggggacaauggugacugucuccucu

SEQ ID NO: 25189 - RNA, 432 nt, Artificial Sequence
  derived and/or modified sequence opt3 from anti-HIV_cap256-048-004226_VR-Chain
caggugcaacuggucgagagcggcgggggaguugugcagcccgguagaucccucaggcuuucuugcgccgcuucaggcuucaccuuuaacaagcacgggaugcauuggguacggcaggcaccuggaaaaggccuggaauggguggccuucgucgcguuugacgguagugauaaguacuaugcugacagcgugaaagggcgcuucacaaucucccgagauaauucuaagaacacuuugucguuacagaugaauaaccugcgugccgaggacacggcaguuuacuauugugccaaagaagugggagauaauaaggacgaugagugggcuucagacuacuaugaucuaagcauugcauacccaguccaagacccgagagccgugguaggcggcuaugauauaugggggcagggaaccaugguuacagugaguucc

SEQ ID NO: 25190 - RNA, 432 nt, Artificial Sequence
  derived and/or modified sequence opt3 from anti-HIV_cap256-048-004097_VR-Chain
caggugcaacuggucgagagcggcgggggaguugugcagcccgguagaucccucaggcuuucuugcgccgcuucaggcuucaccuuuagugcauacacaguacacugggugcggcaggccccugggcgcggacuggaaugggucagcgugaucuccuaugacgaucgaaacaaguacuaugcgcauucuguuaaaggccguuucacuauuucgagagacaauucaaagaacacguuguacuuacagaugaauagccugaggcgggaggauaccgcuguguauuacugugccaaagaccuaggugcaaacaaggaugacgaaugggccacagauuauuacgaccucaguauagcuuacccagucccggauccccgcgcagugguaggggccuuugacaucuggggacaaggcacuaugguuaccguguccucu

SEQ ID NO: 25191 - RNA, 432 nt, Artificial Sequence
  derived and/or modified sequence opt3 from anti-HIV_cap256-048-003289_VR-Chain
caggugcaacuggucgagagcggcgggggaguugugcagcccgguagaucccucaggcuuucuugcgccgcuucaggcuucaccuuuaguaaguacgggaugcacuggguacggcaggcaccuggaaaaggccuggaauggguggccuucgucgcguuugacgguagcuccaagaacuaugcugauucugugaaagggcgcuucacaaucucgcgagacaauucaaagaacacuguuagcuugcagaugaauaguuuacguccagaggauacggccguguacuauugugcaaaagaccugggagccaacaaggaugacgaaugggcuaccgauuacuaugaccuauccauugcauacccgguccccgauccuagagccgugguaggcgcuuuugacauauggggccaagggacaaugguuacugugucuagc

SEQ ID NO: 25192 - RNA, 432 nt, Artificial Sequence
  derived and/or modified sequence opt3 from anti-HIV_cap256-048-002601_VR-Chain
caggugcaacuggucgagagcggcgggggaguugugcagcccgguagaucccucaggcuuucuugcgccgcuucaggcuucaguuuuaacaauuacgcaauggacuggguacggcaggccccugggaagggacuggaauggguggcggucaucagcuccgauggccgcaacaaaaauuaugcugagucugugaagggucgauucaccauuucgcgugacaacagcaaaaauacaguuuacuugcagaugaacucauuaagagccgaagauacugcaguguauuacugugccaaggacgucggggauacgaaaaaggacgagugggcuaccgauuauuacgaccugaguauagcauauccagugcaagauccgcaggccguaguuggagcuuuugacaucuggggccagggcacaauggugacugucuccucu

SEQ ID NO: 25193 - RNA, 432 nt, Artificial Sequence
  derived and/or modified sequence opt3 from anti-HIV_cap256-048-002129_VR-Chain
caggugcaacuggucgagagcggcgggggaguugugcagcccgguagaucccucaggcuuucuugcgccgcuucaggcuucaccuuuaguacauacgcaaugcacuggguacggcaggccccugggaagggacuggaauggguggcguugaucagcuaugacggcacugauaaauacuaugcugacuccgucaagggucgcuucauuauaucucgagauaacucgcguucaacguuauaccugcagaugaauagccuaagacucgaggacaccgccguguaucauugugcaaaagaucuugggggaaguaaguccgacgaaugggccacagauuacuaugaccugucuguugcuuacccagugcaagauccgagggcagucgugggcguauuugacaucuggggccaggggacuaugguuaccgugagcucc

SEQ ID NO: 25194 - RNA, 432 nt, Artificial Sequence
  derived and/or modified sequence opt3 from anti-HIV_cap256-048-001875_VR-Chain
caggugcaacuggucgagagcggcgggggaguugugcagcccgguggcucccucagacuuucuugcgccaccucagggcugacauucaguaacuacggaaugcacuggguaaggcaggcuccuggccgggguuuggaauggguggcauuuacucgcuaugacgggacguacaauuauuacgccgauagcgucaagggacgauucaccaucucccgugacaacucuaaaggcacauuauaucugcagauggauggccuaagaccagaggacacugcgcucuacuauugugcuaaggaucugggggaaagggagugcgaagagugggccucggacuacuacgauuuuggacgggacuucccgugucaagauccccgcggugugguuggcaccuuugacauuugggggcagggaacaauggugaccgucucaagc

SEQ ID NO: 25195 - RNA, 432 nt, Artificial Sequence
  derived and/or modified sequence opt3 from anti-HIV_cap256-048-001302_VR-Chain
caggugcaacuggucgagagcggcgggggaguugugcagcccgguagaucccucaggcuuucuugcgccgcuucaggcuucaccuuuaguuacagcgggaugcacuggguacggcaggcaccuggaaagggcauggaauggguggccgucaucuccuaugacgguucuaacaaauacuaugcggauucggugaaggggcgcuucacaauuucacgagacaauagcaaaaacacuguuuaccugcagaugaauaguuugcguggaguggauacggcugucuauuacugugccaaggacuuaggcggcggggagguggaagagugggcaaccgauuauuacgacugguccauagccuacccaguagaacauccgagagcuguugugggagucuuugauaucuggggucaaggcacaaaagugacugugucuagc

SEQ ID NO: 25196 - RNA, 432 nt, Artificial Sequence
  derived and/or modified sequence opt3 from anti-HIV_cap256-048-001203_VR-Chain
caggugcaacuggucgagagcggcgggggaguugugcagcccgguagaucccucaggcuuucuugcgccgcuucaggcuucaccuuuaguagcuacgcaaugcacuggguacggcaggccccugggaagggacuggaauggguggcgaucauuuccuaugacggcacaauaaaauacuaugcugauucugucaagggucgcuucacuaucucgcgagacaacagcaaaaauacggugucauugcagaugaacaguuuacguccagaggauaccgccguuuacuauugugcaaaggacgugggggccaauaaagaugacgaaugggcuacagauuacuaugaccuguccauugcauacccgguccccgauccuagagccgugguaggagcuuuugacaucuggggccaaggcacuaugguuaccgugucuagc

SEQ ID NO: 25197 - RNA, 432 nt, Artificial Sequence
  derived and/or modified sequence opt3 from anti-HIV_cap256-048-000383_VR-Chain
caggugcaacuggucgagagcggcgggggaguugugcagcccgguagaucccucaggcuuucuugcaccgccucaggcuucacauuuaaccacuacgcuauggacuggguacggcaggcaccugggaagggacuggaauggguggccgucaucaguagcgauggcuccgacaaaacuuaugcggauucugugaagggucgcuucacgauuucgcgagacaauucaaagaacaccguuuacuugcagaugaauagcuuacgugcugaggauacagccguguauuacugugcaaaagacgucgggggaaguaaagaugacgaaugggccacugauuauuacgaccuguccauagcuuauccagugccggaucccagagcaguaguuggcgccuuugacuucuggggcccugggaccauggugacagucucuagc

SEQ ID NO: 25198 - RNA, 432 nt, Artificial Sequence
  derived and/or modified sequence opt3 from anti-HIV_cap256-038-261791_VR-Chain
caggugcaacuggucgaguucggcgggggaguugugcagcccgguggcagccucagacuuuccugcgccgcuuuuggguucaccaucucuucauacggaaugcacuggguaaggcaggcaccuggcaagggucugcaguggguggccuuuauucgguaugacgaaaguagcaaauucuacgcggauuccgucaaggggcgcuuuacaauaucucgagacaacucggagaauacuuuguauuuacaaaugaacucacugcgugcugaagauacggccguguacuauugugcaaaagaccuaggagagagcgaaaaugaggagugggccaccgauuacuaugacuucaguaucgcuuacccaggccaggauccgagaggcguuguggggauuuuugacaucuggggacaggguacaauggucacuguguccucu

SEQ ID NO: 25199 - RNA, 432 nt, Artificial Sequence
  derived and/or modified sequence opt3 from anti-HIV_cap256-038-241540_VR-Chain
caggugcaacuggucgagagcggcgggggaguugugcagcccgguagaucccucaggcuuucuugcgccgcuucaggcuucaccuuuaguaacagcgcaaugcacuggguacggcaggccccugggaagggacuggaauggguggcguugaucuccuacgucggcgguaauauuuauuacgcugacucugugaaagggcgcuucacaguuucgcgagauaacucaaagaaaacuuuauaucugcagaugaauagccuacguguggaggacacggccgucuacuauugugugaaggauguaggagaaagugagaacgaagagugggcauccgacuacuaugauuuuggcagagacuacccaggccaagauaccagggccguugugggggcuuucgacauauggggacaggguacaauggucacugugucuagc

SEQ ID NO: 25200 - RNA, 432 nt, Artificial Sequence
  derived and/or modified sequence opt3 from anti-HIV_cap256-038-235677_VR-Chain
cuggugcagcucgucgagagcggcgggggaguugugcaacccgguggcucccuuagacugucuugcgccgcuucaggguucagguuuaguagcuacggaaugcacuggguacggcaggcaccuggcaaggguuuggaauggguggccuucauccgcuaugacggguccuuuaaagauuacgcggacucuguccgaggacguuucaccauuucgagagagaacucaaagaauacauuauaucugcagaugaacagccuaaggacugaugacacggcuguguacuauugugccaaagaucucggcgaaagugagaccgaagaguggccauccgacuacuaugauuuuggccgggacuacccggggcaggauccccgcggaguuguggguacauucgacauauggggccaugggacuauggucaccgugucuagc

SEQ ID NO: 25201 - RNA, 435 nt, Artificial Sequence
  derived and/or modified sequence opt3 from anti-HIV_cap256-038-234314_VR-Chain
gaggugcagcugcucgaaagcggcgggggacuuguccaacccgguggcucccugagauugucuugcgccgcuucaggguucaccuuuaguagguacgcaaugagcuggguucggcaggccccuggaaagggcuuagaguggguggcgguaaucuccuaugacgguucuaacaaauacuaugcugauucggugaaggggcgcuucacaauuucacgagacaauagcaaaaacacucuguaccuacagaugaauagucuccgugccgucgauacggcaguguauuacugugccaaggaccugggagaaggcgagaacgaagagugggcuaccgauuauuacgacuuuuccuacuggcuuccaugcccgaaauaucacggcgcauggcuggaguugcucuacauaugggggcagggaacaaugguuacugugucuagc

SEQ ID NO: 25202 - RNA, 432 nt, Artificial Sequence
  derived and/or modified sequence opt3 from anti-HIV_cap256-038-234273_VR-Chain
gaggugcagcuggucgaaagcggcgggggacucauccaacccgguggcucccuuagacugucuugcgccgcuucaggguucaccguuaguacaaacuuuaugagcugggugaggcaggcaccuggaaagggcuuggaguggguagccgugauuuccuacgacgguaauaacaaauauuacgcggauucugucaaggggcgguucacuauaucgcgcgaaaauucaaagaacacguuauaucugcagaugaauagccuacgaaccgacgauacagcuguguacuauugugccaaagaccucggagagagugaaacugaggaguggccauccgauuacuaugacuuuggccgugauuacccgggccaggaccccagagggguugugggaaccuucgauaucuggggucacggcacaauggucaccgugucuagc

SEQ ID NO: 25203 - RNA, 432 nt, Artificial Sequence
  derived and/or modified sequence opt3 from anti-HIV_cap256-038-223164_VR-Chain
gaggugcagcuggucgaaagcggcgggggacucguuagacccgguggcucccuuaggcugucuugcgccgcuucaggguucaguuugggaagcuacuggaugaccugggugcggcaagcaccuggcaaggguuuagaguggguagccgugaucuccuaugacgggucuaacaaauacuaugcggauucggucaagggacgcuuuacaauuucacgagacaauagcaaaaacacucuguaccuacagaugaauagucuccgugcugaagauacggcccuguauuacugugcaaaggaccuuggcgaguccgaaaacgaggagugggccucugauuauuacgacuucggcagagauuacccagggcaggacccgaggggagugguugguaccuuugauauauggggccaggggacaauggugacugucagcucc

SEQ ID NO: 25204 - RNA, 432 nt, Artificial Sequence
  derived and/or modified sequence opt3 from anti-HIV_cap256-038-220289_VR-Chain
gaggugcagcuggucgaaagcggcgggggacucguucaacccgguggcucccuuagacugucuugcaccgccucaggguucacauuuaguagcuacgagaugaacugggugaggcaggcuccuggaaagggcccagaauggguagcagugaucuccuaugacgguaauaacaaauacuaugccgauucugucaaggggcgguucacuauuucgcgcgagaauagcaaaaauacguuguacuuacagaugaacucacugcgaaccgacgauacagcgguguauuacugugcuaaggaccuaggagaaagugagacugaggaauggccguccgauuauuacgacuuuggccgugauuaccccggccaggacccuagagggguugugggaaccuucgauauauggggucacggcacaauggucaccgugucuagc

SEQ ID NO: 25205 - RNA, 432 nt, Artificial Sequence
  derived and/or modified sequence opt3 from anti-HIV_cap256-038-220020_VR-Chain
caggugcaacuggucgagagcggcgggggaguugugcagcccgguagaucccucaggcuuucuugcgccgcuucaggcuucaccuuuagucggaacgcaaugcacuggguacgccaggccccugggaagggacuggaauggguggcguugaucagcuacgacggcuccaauaaauauuacgucgauucugugaagggucgauucacaauuucgcgugacaacagcaaaaauacuuuauaucugcagaugaacucacuaagagcugaugacacggccguuuacuauugugcaaaggaucucggggagagugaaaccgaggaauggggaacagacuacuaugauuuuuccacuggcuacccagugcaagacccgaggggcgucgugggggccuucgauauauggggacaggguaccaugguaucuguuagcucc

SEQ ID NO: 25206 - RNA, 432 nt, Artificial Sequence
  derived and/or modified sequence opt3 from anti-HIV_cap256-038-216853_VR-Chain
caggugcaacuggucgagagcggcgggggaguugugcagcccgguagaucccucaggcuuucuugcgccgcuucaggcuucaccuuuaguagcuacgcaaugcacuggguacggcaggccccugggaagggacuggaauggguggcggucaucuccuaugacggcucuaacaaauacuaugcugauucggugaagggucgcuucacaauuucacgagacaauagcaaaaacacuuuguacguucagaugaauaguuuacgugccgaggauacggcaguguauuacugugccagagaccugggggaauccgagaccgaagaguggccaucugauuauuacgacuuuggaagggauuacccgggccaagacccccggggcgucguggggacauucgauauauggggacaugguacuaugguaaccguuagcucc

SEQ ID NO: 25207 - RNA, 432 nt, Artificial Sequence
  derived and/or modified sequence opt3 from anti-HIV_cap256-038-213466_VR-Chain
gaggugcagcuggucgaaagcggcgggggacucguucaacccgguagaucccuuagggugucuugcgccgcuucaggcuucaccuuugaggacuacgcaaugcacuggguacggcaggccccugggaagggacuggaauggguggcggucaucagugaugacggcaacaauaaauauuacgcugauagcgugaagggucgcuucacaauuucccgagacaacucuaaaaauacuuuguauuuacagaugaacucgcugcguguugaggauacggccguguacuauugugucaaggacgugggggaaucagagaaugaggaaugggcaagcgauuacuaugacuuuggaagagauuacccaggccaggacaccagggccguaguuggcgcuuucgauauaugggggcaaggaacaauggugacugucaguucc

SEQ ID NO: 25208 - RNA, 432 nt, Artificial Sequence
  derived and/or modified sequence opt3 from anti-HIV_cap256-038-213212_VR-Chain
caggugcaacuggucgagagcggcgggggaguugugcagcccgguggcucccucagacuuucuugcgccgcuucaggguucaucuuuagugacuacggaaugcacuggguaaggcaggcaccuggcaagggucuggaauggguggccagcauuuggcaugauggguccaaaaaguauuacgcggacucugucaaaggacgguucaccauaucgcgcgagaacucaaagaauacauuguauuuacagaugaacagccugcgagcugaagauacugccguguaccacugugcaaaagaccuaggcgagagugaaaucgaggaguggacguccgauuauuacgacuuuggccgugauuauccagggcaagacccgagaggaguuuucgguaccuuugauauuuggggccaugggacaauggugacugucucuagc

SEQ ID NO: 25209 - RNA, 432 nt, Artificial Sequence
  derived and/or modified sequence opt3 from anti-HIV_cap256-038-213120_VR-Chain
caggugcaccuggucgagagcggcgggggacucguuaagcccgguggcucccuuagacugucuugcgccgcuucaggguucaccuuuagugacuacuauaugaucuggauuaggcaagcaccuggaaaaggcuuggaauggguggccguaauaagcuccgaugguucuaacaagaauuacgcggacucggugaaagggcgguucacaaucucacgcgauaacagcaagaauacuuuauaucugcagaugaacagucuacgagcugaggacacggccgucuacuauugugcaaaagaucucggagaauccgagaaugaagagugggccaccgacuacuaugauuuugcuacaggcuacccagugcaggacccgcgugcaguugugggcgccuucgauauuugggggcagggaacuauggucaccgugucuccc

SEQ ID NO: 25210 - RNA, 432 nt, Artificial Sequence
  derived and/or modified sequence opt3 from anti-HIV_cap256-038-212592_VR-Chain
cuggugcagcucgucgagagcggcgggggaguugugcaacccgguaagucccuuagacugucuugcgccgcuucaggcuucaccuuuaguagcuacgcaaugcacuggaucaggcaggccccugggaaaggauuggaauggguagcggugauuuccgacgauggcucuauaaagaacuaugcugacucggucaaaggucgguucacaaucucacgcgauacuagcaagaaauuaauguaccugcagaugaauagucuauccgccaacgacacggcaguguauuacugugccaaggaucucggggagcgagaaaaugaggaaugggcuucugacuauuacgauuuuggacgugacuauccaggccaggauccgagaggcguuguggggagcauugacaccuggggacaugguacaauggucacuguguccuca

SEQ ID NO: 25211 - RNA, 432 nt, Artificial Sequence
  derived and/or modified sequence opt3 from anti-HIV_cap256-038-211790_VR-Chain
gagcugcagcucguggaaagcggcgggggacuuguccaacccgguggcucccugagauugucuugcguugugucaggguucaccguaaguacaaacuacaucagcugggugaggcaggccccuggaaagggcuuagagugggucgcugugauuuccuaugacgguucuaauaaauacuaugcagauucgguuaaggggcgguuuacuauaucacgcgacaacagcaaaaauacgcuguaccuacagaugaacagucuccgagccgaagauaccgcgcuguauuacugugcuaaggaccuuggagaguccgaaaaugaggagugggccucugauuauuacgacuucggccgugauuacccaggccaggacccgagagggguggucggaacauuugauaucuggggucaaggcacuauggugaccguaagcucc

SEQ ID NO: 25212 - RNA, 432 nt, Artificial Sequence
  derived and/or modified sequence opt3 from anti-HIV_cap256-038-209916_VR-Chain
caggugcaacuggucgagagcggcgggggaguugugcagcccgguggcucccucagacuuucuugcgccgcuucaggguucaccuuuaguagcuucggaaugcacuggguaaggcaggcaccuggcaagggucuggaauggguguccuuuauccggaacgacgggggcauucgcuacucugccgauucgguccgaggacguuucacaauaucaagagacaauagcaaaaacacuuuguauuuacagaugaauagucugaggacggaugacaccgcgguguacuauugugcuaaggaucuaggcgaguccgaaacagaggaauggccaucugacuacuaugauuuugggcgggacuacccgggacaagauccccgcgguguugugggcacuuucgacaucugggggcauggaaccauggucacagugagcucc

SEQ ID NO: 25213 - RNA, 432 nt, Artificial Sequence
  derived and/or modified sequence opt3 from anti-HIV_cap256-038-207938_VR-Chain
caggugcaacuggucgagagcggcgggggaguugugcaccccgguaggucccucaggcuuucuugcgccgcuucaggcuucaccuuuaguagcuacgggaugcauuggguacggcaggcaccuggaaagggccuggaauggguggccgucaucucccacgacgguucuaacaaauauuacgcggauucggugaaggggcgcuucacaauuucacgagacaauagcaaaaacacuuuguauuuacagaugaauagucugcgugcugaggauacggccguuuacuauugugcaaaggaccuaggagaauccgagaacgaagagugggccucugauuacuaugacuuuggcagagauuacccaggccaggacccgagagggguggucggaguguucgauauauggggucaaggcaccaugguaacaguuagcucc

SEQ ID NO: 25214 - RNA, 432 nt, Artificial Sequence
  derived and/or modified sequence opt3 from anti-HIV_cap256-038-202245_VR-Chain
caggugcaccuggucgagagcggcgggggaguugugcaacccgguaggucccucaggcuuucuugcaccguaucaggcuucacauuugggaguuacgcccugcauugggugcggcaggcuccuggaaagggcuuggaaugguuaagcgucaucuccuaugacgguaacaauaaauacuaugcagauucugugaaggggcgcuucacuauuucgcgagagaacagcaaaaauacgcuguaccuacagaugaacucacuccgugccgaagacaccgcgguuuaucacugugcuaaggaucugggagagagugaaaaagaggagugggccuccgacuacuaugauuuuggcagagacuacccaggccaggauccgagagggguggucggaacauucgacauauggggucauggcacuauggugaccguaucuagc

SEQ ID NO: 25215 - RNA, 432 nt, Artificial Sequence
  derived and/or modified sequence opt3 from anti-HIV_cap256-038-197721_VR-Chain
caggugcaacuggucgagagcggcgggggaguugugcagcccgguaagucccucagacuuucuugcgccggcucaggguucaucuuuaguaacuacccuaugcacuggguaaggcaggcuccaggaaaaggccuggaauggauggcagacgugagcuaugaugguuccaauaaggacuacgccgauucugucaaagggcgguucaccauuucgcgcgacaacucaaagaauacauuguauuuacagaugaacagccugcgagcggaggauacugcuguguacuauuguguuaaagacgugggagaaagugagaaugaagagugggccuccgauuacuaugacuuuggccgugauuacccgggccaagacacgagagcagucgugggggccuucgauauauggggacaggguaccaugguaacaguuucuagc

SEQ ID NO: 25216 - RNA, 432 nt, Artificial Sequence
  derived and/or modified sequence opt3 from anti-HIV_cap256-038-196679_VR-Chain
gaggugcagcugcucgaaagcggcgggggacuuguccaacccgguggcucccugagauugucuugcgccgcuucaggguucaccuuuaguagcuacgcaauguccuggguuaggcaggccccuggaaagggcuuagaguggguggcgguaaucucuuaugacggugggaacaaauacuaugcugauucggugaagggacgguucacaauuucacgcgacaauagcaaaaacacucuguaccuacagaugaauagucuccgagccgaagauacggcacuguauuacugugccaaggaccuuggcgaguccgaaaacgaggagugggcuucugauuauuacgacuuuggccgugauuacccagggcaggacagcagaggagucguggguaccuucgauguuuggggccaagggacaauggugacugucuccuca

SEQ ID NO: 25217 - RNA, 438 nt, Artificial Sequence
  derived and/or modified sequence opt3 from anti-HIV_cap256-038-196118_VR-Chain
caggugcaacuggucgagagcggcgggggaguugugcagcccgguggcucccucagacuuucuugcgccgcuucaggguucaccuuuaguacauacggaaugcacuggguaaggcaggcaccuggcaagggucuggaaugggugacuuucauccggaacgacgggacgaauaaauauuacgccgauagcgucaagggacgcuuuaccauuucccgagacaacacuaaaaauacauuguauuuacagauguacucucugcgugcggaggauaccgcuguguauuacugugccaaggaccuaggcgaaucggagaacgaagaugaggagugggcaucagacuauuacgauuucggcagagacuacccagggcaagauagcaggggaguuguggguacauuugacauguggggccaggggaccauggucacugugaguucc

SEQ ID NO: 25218 - RNA, 429 nt, Artificial Sequence
  derived and/or modified sequence opt3 from anti-HIV_cap256-038-195382_VR-Chain
caggugcaccuggucgagagcggcgggggaguugugcaacccgguaggucccucaggcuuucuugcgccgcuucaggcuucaccuuuaguaauuacccuguacauugggugcggcaggcaccagggaagggacuggaaugggucgccgugaucagcuucgacggcauuaauaacuaugcggguuccguuaaagggcgcuuuauaaucucucgagauaauucgaagaacacauuguacuuacagaugaacucacugcgugcugaggacacugccguguauuacugugucaaagaucuaggagaaagcgagaaggaagaguggccgagugacuauuacgauuucggcagagacuaucccggccaggauuccagaggggugguaggaguuuuugacauuuggggucaaggcacgauggugaccgucucuagc

SEQ ID NO: 25219 - RNA, 432 nt, Artificial Sequence
  derived and/or modified sequence opt3 from anti-HIV_cap256-038-180001_VR-Chain
gaggugcagcuggucgaaagcggcgggggacucguucaacccgguaggucccuuaggcugucuugcaccgccucaggcuucacauuuggggacuacgcuaugaguugguuccggcaggcaccuggaaagggcuuggaguggguggccgauaucagcuaugacgguuccaacaaauacuaugcggauucuguaaaggggcgcuuaacuauuucgcgagacaauucaaagaacacgcuguaccuacagaugaauagccuccgugcugaagauaccgccguguauuacugugucaaagaccugggagagagugaaaaagaggaguggccauccgauuauuacgacuuuggcagagauuacccgggccaggacucuagaggggugguuggaguguucgauauauggggucaaggcacaauggucacugugagcucc

SEQ ID NO: 25220 - RNA, 432 nt, Artificial Sequence
  derived and/or modified sequence opt3 from anti-HIV_cap256-038-178021_VR-Chain
caggugaagcuggucgagagcggcgggggaguugugcaacccgguggcucccucagacuuucuugcgccgcugcaggguucaucuuuucaaacaguggaaugcacuggguaaggcaggccccugacaaaggccuggaauggguggcguucgucccauacgaugguagcaauaaguauuacgcugacuccgugaaagggcgguuuaccauuucucgcgauaacucgaagaauacauugucauuacagaugaacagccugcgaacugaggacacggccguuuauuacugugcaaaagaucuaggagaaagugagaccgaagaguggccguccgacuauuacgauuucggccgugacuaucccggccaggauccuagagggguggucggaacauuugacauauggggucauggcacuauggugaccguaucuagc

SEQ ID NO: 25221 - RNA, 432 nt, Artificial Sequence
  derived and/or modified sequence opt3 from anti-HIV_cap256-038-177104_VR-Chain
gaggugcagcugcucgaaagcggcgggggacuuguccaacccgguggcucccugagauugucuugcgccgcuucaggguucaccuuuaguagcuacgcaaugaacuggguuaggcaggccccuggaaagggcuuagaguggguggcgguaaucuccuaugacgguggggauaaauacuaugcugacucugugaagggacgguucacaauuucgcgcgauaauucaaagaacacucuguaccuacagaugaauagccuccgagucgaagacacggccguguauuacuguguuaaagaugugggcgagagugaaaacgaggagugggcauccgacuauuacgauuuuggccgugacuacccagggcaggauaccagagccgucgugggagcuuucgacauauggggucaaggcacaaugguaacuguuucuagc

SEQ ID NO: 25222 - RNA, 432 nt, Artificial Sequence
  derived and/or modified sequence opt3 from anti-HIV_cap256-038-171261_VR-Chain
caggugcaacuggucgagagcggcgggggaguugugcagcccgguagaucccucaggcuuucuugcgccgcuucaggcuucaccuuuaguagcuacgcaauguauuggguacggcaggccccugggaagggacuggaauggguggcggucaucuccucugacggcucggauaaaaacuacgcugacucagugaagggucgcuucacaauuagccgagauaauaguaacaauacuuuguauuuacagaugaacucccugcgugccgaggacacggcaguuuacuauugugccagagaucuaggggaaucugagaaugaagaguggccaagcgacuacuaugauuuuggaagggacuacccgggccaagauccccggggcgugauagggaccuucgacgucuggggacaggguacaauggugacuguauccuca

SEQ ID NO: 25223 - RNA, 432 nt, Artificial Sequence
  derived and/or modified sequence opt3 from anti-HIV_cap256-038-169090_VR-Chain
caggugcaacuggucgagagcggcgggggaguugugcagcccgguagaucccucaggcuuucuugcgccgcuucacgguucaccuuuaagacauacacuaugcacuggguacgccaggcaccuggcaaagggcuggaauggguggccuugaucaguuaugacggaagcaauaaguacuaugcggauuccgucaaaggccgauuaacgauuucucgugacaauucgaagaacacccuguaccuacagaugaacucacucagagcugaggauacagccguguauuacuguguuaaagaccugggugaaagcgagaaggaagaguggccaagugauuauuacgacuucgggagggauuacccgggacaagacucccggggcguggucggcguguuugauauaugggggcagggaacuaugguaaccguuucuagc

SEQ ID NO: 25224 - RNA, 432 nt, Artificial Sequence
  derived and/or modified sequence opt3 from anti-HIV_cap256-038-168705_VR-Chain
gaggugcagcuggucgaaagcggcgggggacucguuaagcccgguggcucccuuagacugucuugcgccgcuucaggguucaccuuuaguagcuacuccaugaacugggugaggcgggcaccuggaaaaggcuuggaguggguagccuuaaucucuuaugacgaaaauaagaaauacuaugcggauucggugaagggucgcuucacaauuucacgagagaacagcaaaaauacucuguaccuacaaaugaacagucuccgugcugaagacacggccgucuauuacugugcaaaggaucugggggagagagagaaugaagagugggccuccgacuauuacgauuuuggaagggacuacccaggccaggauccgcggggcgugguugggucuauagacaccuggggacacgguacaauggugacugucagcucc

SEQ ID NO: 25225 - RNA, 432 nt, Artificial Sequence
  derived and/or modified sequence opt3 from anti-HIV_cap256-038-167685_VR-Chain
caggugcaacuggucgagagcggcgggggaguugugcagcccgguagaucccucaggcuuucuugcgccgcuucaggcaucaccuucaguagcuacgcaauucacuggguacggcaggccccugggaagggacuggaauggguggcggucauauccuaugacggcucuaacaaauacuaugcugauucggugaagggucgcuuuacaaucucacgagacaauagcaaaaacacuuuguacuuacagaugaauagucugcgugccgaggauacggcaguuuauuacugugccaaggaccuaggggaauccgagaacgaagagugggcuaccgauuauuacgacuucucuauuggauacccaggccaagauccgagaggcguggucggggcauuugacaucuggggacaggguacaauggugacuguaagccuc

SEQ ID NO: 25226 - RNA, 432 nt, Artificial Sequence
  derived and/or modified sequence opt3 from anti-HIV_cap256-038-158775_VR-Chain
caggugcaacuggucgagagcggcgggggaguugugcagcccgguggcucccucagacuuucuugcgccgcuucaggguucaccuuuaguacauacggaaugcacuggguaaggcaggcaccuggcaagggucuggaauggguggccuucauccgggacaacgggagcaauaaauauuacgcggauuccgucaagggacgcuuuacuauuucucgagacaacucgaaaaauacguuguauuuacagaugaacucacugcgugcugaggauaccgcccuauacuauugugcaaaggaccucggcgaaagcgagaaugaagagugggccagugauuacuaugacuucggcagagauuacccagggcaagacuccaggggagugguugguacauuugauguguggggccaggggacuauggucaccgugucuagc

SEQ ID NO: 25227 - RNA, 432 nt, Artificial Sequence
  derived and/or modified sequence opt3 from anti-HIV_cap256-038-157318_VR-Chain
cacgugcagcuggucgagagcggcgggggaguugugcaacccgguagaucccucaggcuuucuugcgccgcuucaggcaucaccuucaguacauacgacaugcauuggguacggcaggcaccugggaagggacuggaauggguggccgucauuagcaacgauggcuccaauaaauauuacgcggacucugugaagggucgcuuuacuauaucgcgagauaacagcaaaaauacguuguauuuacagaugaacucacugcgugcugaggacaccgcccuauacuauugugcaaaggaucucggggaaagugagaaagaagagugggccuccgacuacuaugauuucggaagagacuacccaggccaggauccgaggggcguuguggcuacauuugacaucugggggcaaggaacuauggucaccgugucuagc

SEQ ID NO: 25228 - RNA, 432 nt, Artificial Sequence
  derived and/or modified sequence opt3 from anti-HIV_cap256-038-153058_VR-Chain
caggugcaacuggucgagagcggcgggggaguugugcagcccgguaggucccucaggcuuucuugcgccgcuucaggcuucaccuuuaguacauacgcaaugcacuggguacggcaggccccugggaagggacuggaauggguggcggucaucagcuaugacggcucccauucuuacuaugcugguucggugaaagggcgcuucacuacgucacgagauaacagcaagaauaccuugaacuuacagaugaauagucugcguccagaggacacagcccuauacuauugugcaaaagaucucggagaauccgagaacgaagagugggccucugacuacuaugauuuuggcagagacuacccgggccaagauagcagagggguugugggaacuuucgacgucuggggucagggcaccauggugacaguauccuca

SEQ ID NO: 25229 - RNA, 432 nt, Artificial Sequence
  derived and/or modified sequence opt3 from anti-HIV_cap256-038-150027_VR-Chain
cuggugcagcucgucgagagcggcgggggaguugugcaacccgguggcucccuuagacugucuugcgccgcuucaggguucagguuuaguagcuacggaaugcacuggguacggcaggcaccuggcaaggguuuggaauggguggccuucauccgcuaugacggguccuuuaaagauuacgcggacucuguccgaggacguuucaccauuucgagagauaacucaaagaauacaguguauguucagaugaacagcuuaagggcugaggacacugccguguacuauugugcaaaagaucugggcgaaagugagaaugaagagugggccacggacuacuaugauuuugcuaccggcuacccaguccaggacccgcgggcagugguaggggccuucgauauauggggacaagguacaaugguuacuguguccccc

SEQ ID NO: 25230 - RNA, 432 nt, Artificial Sequence
  derived and/or modified sequence opt3 from anti-HIV_cap256-038-146372_VR-Chain
caggugcaacuggucgagagcggcgggggaguugugcagcccgguagaucccucaggcuuucuugcgccgcuucaggcuucaccuuuaguagcuucgggaugcacuggguacggcaguccccuggaaagggccuggaauggguggcagucaucucuuacgacgguaacaauaaauauuacgccgauucggugaaggggcgcuuuacaauuucacgagagaacagcaaaaauacuuuguauuuacagaugaacagucugcguacggacgauaccgcgguuuacuauugugcuaaggaccuaggagaauccgagacagaagagugggccacugauuacuaugacuucgcaaccggcuacccagugcaagauccgagagccgucgugggcgcuuuugacauaugggggcagggaacaaugguaaccguuucuccc

SEQ ID NO: 25231 - RNA, 432 nt, Artificial Sequence
  derived and/or modified sequence opt3 from anti-HIV_cap256-038-141868_VR-Chain
gagcugagacucguggaaagcggcgggaaccuuguccagcccggagguucccugaccuugucuugcguugccucaggcuucacauuugacaguuacgggaugagcugggugaggcaagcuccuggaaagggcuuagaguggguagcacugaucuccuaugaugaaaauaaaaaguacuaugccgacucugugaaaggucgguucacuauuucgcgcgagaacucaaagaauacgcuauaccuccagaugaacagccugcgagcggaagauaccgcugucuauuacugugccaaagaccuuggggagcgugagaaugaagagugggcaagugauuauuacgacuuuggaagagauuacccaggccaggacccgaggggcgugguuggguccauagauacauggggacacgguacuauggugaccgucucuagc

SEQ ID NO: 25232 - RNA, 432 nt, Artificial Sequence
  derived and/or modified sequence opt3 from anti-HIV_cap256-038-141616_VR-Chain
gaggugcagcugcucgaaagcggcgggggacuuguccaacccgguggcucccugagguugucuugcgccgcuucaggguucaccuuuaguagcuacgcaauguccuggguuaggcaggccccuggaaagggcuuagaguggguggcgguaaucucuaaagacgguucggauaacucauauguggacagcgucaaggggcgguucacaauuagucgcgauaauuccaaaaacacucuguaccuacagaugaacucucuccgagcugaagacacggccguguauuacugugcacgugaucugggagagagcgaaaaugaggaguggccauccgacuauuacgauuuuggcagagacuauccgggccaggaucccagagggguuauaggaaccuucgacguguggggucaaggcacaauggucacugugucaagu

SEQ ID NO: 25233 - RNA, 432 nt, Artificial Sequence
  derived and/or modified sequence opt3 from anti-HIV_cap256-038-127989_VR-Chain
caggcccaacugguggagagcggcgggggagucguucagcccgguagaucccucaggcuuucuugcgcugcaucaggcuucaccuuuaguaacuucgccaugcacugggugcggcaggcgccugggaagggacuggaauggguagcugugaugagcgacgauggcuccaauaaauacuaugccgacucugucaagggucgcuuuacaaucucgcgagauaacucagagaauacuuuguacuuacagaugaacagccugcgugcagaagacacggccguguauuacugugcuaaagaucuaggggagagugaaaccgaggagugggcaacagacuauuacgauuucggaacuggcuauccaggccaagacccgagagccaugauugggaccuuugauauauggggaagggguacaaugguuaccguguccucu

SEQ ID NO: 25234 - RNA, 432 nt, Artificial Sequence
  derived and/or modified sequence opt3 from anti-HIV_cap256-038-118109_VR-Chain
caggugcaacuggucgagagcggcgggggaguugugcagcccgguggcucccucagacuuucuugcaccgccucaggguucacauuuagugcuuacgacaugcacuggaucaggcaggcaccuggaaagggccuggguuggguagccuucauuacuaacgaagggagcuccaaaaauuauguggauucugucaagggacgguuuacgauaucgcgcgacaacagcaaaaauaccuuguacuuacagaugaacucacugcgagcggaggauacagcuguguauuacugugccaaggaccuaggcgaaagugagaaugaagagugggcaacugauuauuacgacuucuccaucgccuauccaggccaagauccgcgugggguugugggaauuuuugacaucuggggucagggcaccauggucacagugucuagc

SEQ ID NO: 25235 - RNA, 432 nt, Artificial Sequence
  derived and/or modified sequence opt3 from anti-HIV_cap256-038-112226_VR-Chain
gaggugcagcuggucgaaagcggcgggggacucguucaacccgguggcucccuuagacugucuugcgccgcuucaggguucaccuuuaguagcuacuggaugacaugggugaggcaggcaccuggaaagggcuuggaguggguagccgugaucuccgacgaugguaacaauaaauauuacgcggacucugucaaggggcgguucacuauuucgcgcgauaacagcaaaaauacguuauaucugcagaugaacucacuacgaguggaagacaccgcuguuuacuauugugugaaggaugucggagagagugaaaaugaggagugggccuccgacuacuaugauuuuggccgugacuacccaggccaggauacaagagcagugguaggggccuucgacauauggggacaagguacuaugguuaccgugucuagc

SEQ ID NO: 25236 - RNA, 432 nt, Artificial Sequence
  derived and/or modified sequence opt3 from anti-HIV_cap256-038-105918_VR-Chain
gaggugcagcugcucgaaagcggcgggggacuuguccaacccgguggcucccugagauugucuugcgccgcuucaggguucaccuuuaauauccacccuaugcauuggguuaggcaggcaccaggaaagggcuuagaguggguggccguaauuaguuacgacgguaauaacaaauauuacgcggauagcgugaaggggcgguucacaauaucccgcgaaaauucuaaaaacacucuguaucuacagaugaacucgcuccgaacggacgauaccgcugucuacuauugugccaaggaccugggagagucagaaacagaggaguggccgagcgauuacuaugacuuuggccgugauuaccccggccaggacccuagaggggugguuggaacuuucgauaucuggggucacggcaccauggugacagucaguucc

SEQ ID NO: 25237 - RNA, 432 nt, Artificial Sequence
  derived and/or modified sequence opt3 from anti-HIV_cap256-038-104487_VR-Chain
cuggugcagcucgucgagagcggcgggggaguugugcaacccgguaagucccuuagacugucuugcgccgcuucaggcuucaccuuuaguagcuacgcaaugcacuggaucaggcaggccccugggaaaggauuggaauggguagcggugauuuccgacgauggcucuauaaagaacuaugcugacucggucaaaggucgguucacaaucucacgcgauaauagcaagaacacuuuauaccugcagaugaauagucuacgagccgaggacacggcaguguauuacugugccaaagaucucggggaauccgagaacgaagagugggcuaccgacuauuacggauuuucuauuggcuauccaggccaggauccgcgugggguugugggaaucuucgacauuugggcacaagguacaauggucacugugagcucc

SEQ ID NO: 25238 - RNA, 432 nt, Artificial Sequence
  derived and/or modified sequence opt3 from anti-HIV_cap256-038-102308_VR-Chain
caggugcaacuggucgagagcggcgggggaguugugcagcccgguggcucccucagacuuucuugcgccgcucuggacuucccuuuuucaaguuucgggaugcacuggguaaggcagaccccaggacggggcuuggaauggguggcaaucauuuggagcgaugguuccaaccgcuacuaugucgacucugugaaggggcgauuuacaauaucgcgugauaauucaaagaacacuuuauaccugcagaugaauagccuaagaccggacgauacggccguuuauuacugugugaaagaccucggagagagugaaaacgaggaaugggcgaccgauuauuacgacuucuccgucggcuaucccggccaagggccuaggggagugguagguaucuuugauauuuggggccaggggacaaugguuacugugucuagc

SEQ ID NO: 25239 - RNA, 432 nt, Artificial Sequence
  derived and/or modified sequence opt3 from anti-HIV_cap256-038-091115_VR-Chain
caggugcaacuggucgagagcggcgggggaguugugcagcccgguagaucccucaggcuuucuugcgccguaucaggcuucaccuuuaguagcuacgggcugcacugggugcggcaggcuccuggaaagggcuuggaaugggucgcagugaucuccuaugacgguucuaacaaauacuaugccgauucgguuaaggggcgcuucacaauuucacgagacaauagcaaaaacacuuuauaccugcagauaaauagucuacgugcggaggauacggcuguguauuacugugccaaggaccucggagaauccgagaacgaagagugggcaaccgauuauuacgacuuuucuaucggcuacccaggccaagauccgagagccgucgugggggcuuucgacauuuggggacaggguacaaugguaacuguuagcucc

SEQ ID NO: 25240 - RNA, 432 nt, Artificial Sequence
  derived and/or modified sequence opt3 from anti-HIV_cap256-038-090262_VR-Chain
caggugcaacuggucgagagcggcgggggaguugugcaggccgguggcucccucagacuuucuugcgcugcaucaggguucaccuuuaacaauuacggaaugcacuggguaaggcaggcccccggcaagggucuggaaugggcggcuuucauccgguaugacgggaguaacaaauacuaugccgauagcgugcgcggacgauuuacaauuucccgugacaauucuaagaacacuuuguacuuacagaugaacucgcugagagcagaggauacggccgucuauuacugugugaaagacguuggcgaaucagagaaugaagagugggcuagcgauuauuacgacuucggcagggauuacccugggcaagacacccgggcaguggucggagccuuugauauauggggucagggcacaauggugacuguaaguucc

SEQ ID NO: 25241 - RNA, 432 nt, Artificial Sequence
  derived and/or modified sequence opt3 from anti-HIV_cap256-038-083260_VR-Chain
caggugcaacuggucgagagcggcgggggacucguuaagcccgguggcucccuuagacugucuugcgccgcuucaggguucaccuuuagugacuacuauaugacauggaucaggcaggcaccuggaaaaggcuuggaauggguggccguaauuagcuacgauggugggaacaaguauuacgcggacuccgugaaaggacgguucacuauaucucgcgauaauucgaagaacacguuauaucugcagaugaacucacuacgagcugaggacaccgcccucuacuauugugcaaaagaucugggcgaaagcgagaaugaagagugggccagugacuacuacgauuuuggccgugacuauccagggcaggauuccagaggagucguggguacauucgacguuuggggccaagggacuauggugaccgucucuagc

SEQ ID NO: 25242 - RNA, 432 nt, Artificial Sequence
  derived and/or modified sequence opt3 from anti-HIV_cap256-038-080981_VR-Chain
caggugcaacuggucgagagcggcgggggaguugugcagcccgguagaucccucaggcuuucuugcgccgcuucaggcuucaccuuuaguagcuacgggaugcacuggguacggcaggcaccuggaaagggcauggaauggguggccgucaucuccuaugacgguucuaacaaauacuaugcggauucggugaaggggcgcuucacaauuucacgagacaauagcaaaaacacucuguacuugcagaugaauaguuuacgugcuguugauacggccguguauuacugugcaaaggaccugggagagggcgaaaacgaggaaugggccaccgauuauuacgacuuuuccauaggcuacccagggcaagauccgagaggagucgugggugcuuucgacaucuggggccaggggacaaugguaacuguuucuagc

SEQ ID NO: 25243 - RNA, 432 nt, Artificial Sequence
  derived and/or modified sequence opt3 from anti-HIV_cap256-038-080873_VR-Chain
cuggugcagcucgucgagagcggcgggggaguugugcaacccgguggcucccuuagacugucuugcgccgcuucaggguucagguuuaguagcuacggaaugcacuggguacggcaggcaccuggcaaggguuuggaauggguggccuucauccgcuaugacggguccuuuaaagauuacgcggacucuguccgaggacguuucaccauuucgagagauaacucaaagaauacaguguauuuacagaugaacagccugagggcugaggacacugccguuuacuauugugugaaagaucuaggcgaaagugagaaggaagaguggccauccgacuacuaugauuuuggccgggacuacccggggcaggauucucgcggagucguggguguauucgacauauggggccaagggacgaugguuaccgugagcucc

SEQ ID NO: 25244 - RNA, 432 nt, Artificial Sequence
  derived and/or modified sequence opt3 from anti-HIV_cap256-038-074413_VR-Chain
caggugcaacuggucgagagcggcgggggaguugugcagcccgguggcucccucagacuuucuugcgccgcuucaggguucaccuuuaguacauacggaaugcacuggguaaggcagccuccaggcaagggucuggaauggguggcauucauccgguaugacgggagcaacacuuacuaugccgauuccgucaaaggacgcuuuacgauuucucgagacaauucgaagaacaccuuguacuuacagaugaacucacugcgugcggaggauacagcuguguauuacugugccaaagaccuaggcgaaagcgagaaugaagagugggcaagugauuauuacgacuucggcagagauuacccggggcaagaccccaggggaguugugggugucuuugauauauggggccaggggacuauggugaccguauccucu

SEQ ID NO: 25245 - RNA, 432 nt, Artificial Sequence
  derived and/or modified sequence opt3 from anti-HIV_cap256-038-073153_VR-Chain
caggugcaacuggucgagagcggcgggggaguugugcagcccgguaggucccucaggcuuucuugcgccgcuucaggcuucaccuuuaguagcuacgggaugcacuggguacggcaggcaccuggaaagggccuggaauggguggccuugaucuccuaugacgguacaaacaaauacuaugcggauucugucaaggggcgcuucacuauuucgcgagacaauucaaagaacacguuauuucugcagaugaauagccuacgugcugaggauaccgcccucuacuauugugcaaaagaccugggagaaagugagaacgaagagugggccuccgauuacuaugacuucggcagagauuacccaggccaagacccgagaggggugguuggaacauuugauauauggggucagggcacuauggugaccgucucuagc

SEQ ID NO: 25246 - RNA, 432 nt, Artificial Sequence
  derived and/or modified sequence opt3 from anti-HIV_cap256-038-064227_VR-Chain
gaggugcaggucguugaaagcggcgggggacuggugcaacccgguggcucccucagacuuucuugcgccgcuucaggguucaccuuuaguaacuacuggaugagcuggguaaggcaggcaccuggaaagggccuggaguggguggccgucauguccuucucugguucggggucauauuacgcggacagcgugaaaggacgguuuacaaucaguuccgaugacucuaugaauacuguuuauuugcagaugaacagcuuacgcgcugaagauacggccguguacuauugugcaaaggaccugggcgagcgagaaaaugaggagugggccuccgauuacuaugacuucggccgugauuacccagggcaggacccgagaggagucguggguucaauugauaccuggggccacgggacaaugguaacuguuaguagc

SEQ ID NO: 25247 - RNA, 432 nt, Artificial Sequence
  derived and/or modified sequence opt3 from anti-HIV_cap256-038-061640_VR-Chain
caggugcaacuggucgagagcggcgggggaguugugcagcccgguagaucccucaggcuuucuugcaccgccucacgguucaguuuuaacaauuacgcuaugcacuggguacgccaggcaccuggcaaggggcuggaauggguggccaucauuagcaaagacggauccgauaacucuuaugucgacucggugaagggccgauucacaauaucacgugauaauagcaaaaacacuuuguacuuacagaugaauagucugagagcggaggacacggcuguuuauuacugugccagggaucuaggugaauccgagaacgaagaguggccaucugacuauuacgauuuugggcgggacuauccgggacaagauccccgcggcgugaucggcaccuucgacgucugggggcagggaacaauggugacuguaagcucc

SEQ ID NO: 25248 - RNA, 414 nt, Artificial Sequence
  derived and/or modified sequence opt3 from anti-HIV_cap256-038-059482_VR-Chain
agaggcgugcagugccaaguccagcugguugagagcgggggaggugugguacagcccggcuucaccuuuuccucuuacgugaugcacugggucaggcaggccccugggaagggacucgaauggguggcugacaucucauaugauggcaguaauaaauacuaugcagacagcguuaagggucggcuuacaauuucccgcgauaauucuaaaaacacucuguacuugcaaaugaacucguuacgagccgaggacacggcgguguauuacugugucaaggaucugggggaaucagagaaagaagaguggccaagcgacuauuacgauuucgcuaccggauacccggugcaggacccccgugccguaguuggcgcauuugauauauggggccaggggacaauggugacugucaguccu

SEQ ID NO: 25249 - RNA, 432 nt, Artificial Sequence
  derived and/or modified sequence opt3 from anti-HIV_cap256-038-054000_VR-Chain
gaggugcagcuggucgaaagcggcggguccguugugagacccggagguucucucaggcuuucaugcgccgcuaguggcuucaccuuugacgauagcgggauguccuggguacggcaaggaccuggcaagggucuggaguggguggcagucaucucuuacgacgggggaaacaaauauuacgccgauucggugaagggccgcuucacaauuucacgagacaauagcaaaaacacuuuguauuuacagaugaauagucugcgugcggaagauacggcucuauacuauugugccaaggaccucggcgaguccgaaaacgaggagugggcaucugauuacuaugacuuugggagagauuacccaggacaggacagcagggguguugugggcaccuucgaugucugggggcagggaacaauggugacuguauccuca

SEQ ID NO: 25250 - RNA, 432 nt, Artificial Sequence
  derived and/or modified sequence opt3 from anti-HIV_cap256-038-050554_VR-Chain
gaggugcagcugcucgaaagcggcggggaccuuguccaauccggagguucucugagauugucaugcguugccaguggcuucaccuuuagcacacacgcuaugacuugggugaggcaggcacccgggaagggauuagaguggguagccgugaucuccucugauggcucgaacaaaaauuucgcggacucagucaagggucgguuuacgauuagccgcgauaacaguaaaaauacccuguaccuacagaugaacucccuccgaccugaagacacagcuguguauuacugugccaaggaucugggggagucugaaaaugaggagugggcaacugacuauuacgauuucagcaccggauauccaguucaggacccgcgugccguggucggcgcuuuugauauauggggccaagggacaauggugaccguauccuca

SEQ ID NO: 25251 - RNA, 432 nt, Artificial Sequence
  derived and/or modified sequence opt3 from anti-HIV_cap256-038-044256_VR-Chain
caggugcaacuggucgagagcggcgggggaguugugcagcccgguaggucccucaggcuuucuugcgccgcuucaggcuucaccuuuaguagcuacgcaaugcacuggguacggcaggccccugggaagggacuggaauggguggcggucaucuccuaugacggcucuaacaaauaccaugcugguucggugaaggggcgcuucauuauaucacgagauaauagcaaaaacacauuguauuuacagaugaauagucugcgugccgaggacacugcacuauacuauugugccaaggaucucggagaauccgagaacgaagagugggcuucugacuacuaugauuuuggcagagacuacccaggccaagauccgagagggguugugggaacguucgacaucuggggucagggcaccauggucacagugagcucc

SEQ ID NO: 25252 - RNA, 432 nt, Artificial Sequence
  derived and/or modified sequence opt3 from anti-HIV_cap256-038-040944_VR-Chain
caggugcaacuggucgagagcggcgggggaguugugcagcccgguagaucccucaggcuuucuugcgccgcuucaggcuucaccuuuaguaacuacgcaauggacuggguacggcaggccccugggaagggacuggaauggguggcggucaucagcuaugauggcuccaauaaauacuaugcugacucugugaagggucgcuucacaauuucgcgagauaacagcaaaaauacuuuguacuuacagaugaacucacugcgugccgaggacacggcaguuuauuacugugccaaggaucuaggggaaagugagaaugaagagugggcuaccgacuauuacgauuuuuccacaggauacccaggccaagacccgagagcaguggucggcgccuucgauauaugggggcagggaacuauggugaccguaucuagc

SEQ ID NO: 25253 - RNA, 432 nt, Artificial Sequence
  derived and/or modified sequence opt3 from anti-HIV_cap256-038-040090_VR-Chain
caggugcaacuggucgagagcggcgggggaguugugcagcccgguagaucccucaggcuuucuugcgccgcuucaggcuucaguuuuagcaacuacgcaauggacuggguacggcaggccccugggaagggacuggaauggguggcggucaucuccucugauggcucgaauaaaaacuaugcugacucagugaagggucgcuucaccauuagccgagauaauaguaaaaacacauuguacuuacagauggacucccugcgugccgaugacacugcaguuuauuacugugccaaggaucuaggggagucugaaaaugaggaaugggcuacggacuauuacgauuuuagcauaggauauccagugcaagacccgagaggcgucgugggcaucuucgauauuugggggcagggaaccaugguaacaguuuccuca

SEQ ID NO: 25254 - RNA, 432 nt, Artificial Sequence
  derived and/or modified sequence opt3 from anti-HIV_cap256-038-032874_VR-Chain
caggugcaacuggucgagagcggcgggggaguugugcagcccgguggcucccucagacuuucuugcgccgcuucaggguucaccuuuaguagcuacggaaugcacuggguaaggcaggcaccuggcaagggucuggaauggguggccuucauccgguaugacgggaacaauaaauacuaugcggauuccgucaagggacgcuuuacaauuucucgagagaacucgaaaaauacuuuguacuuacagaugaacucacugcgugcugaagacacggccguguaucauugugcaaaggaucuaggcgagagcgaaaaagaggagugggccagugacuacuaugauuucggcagagacuacccagggcaagauccgaggggaguuguggguaccuuugacauauggggccacgggacaauggucacuguguccucu

SEQ ID NO: 25255 - RNA, 432 nt, Artificial Sequence
  derived and/or modified sequence opt3 from anti-HIV_cap256-038-025899_VR-Chain
caggugcaacuggucgagagcggcgggggaguugugcagcccgguagaucccucaggcuuucuugcguagccucaggcuucaccuuuaguaacuacgcuauguauugggugcggcaggcaccugggaagggacuggaaugggucacaaucauuagcuucgacggcuccaaucaguacuaugccgauucugugaaaggucgcuuuacuauaucgcgagagaacucaaagaauacguuguacuuacaaaugaacagccugcgugcggaagacaccgcuguuuauuacugugccaaagaucuaggggagagagaaaaugaggagugggcaagugacuauuacgauuucggaagggacuacccaggccaggauccgcggggcguggucggguccaucgacacauggggacacgguacuauggugaccguaucuagc

SEQ ID NO: 25256 - RNA, 432 nt, Artificial Sequence
  derived and/or modified sequence opt3 from anti-HIV_cap256-038-024581_VR-Chain
cacauccagcugguggagagcggcgggggagucguucaacccgguggcucccucagacuuucuugcgccgcuucaggguucccuuuuaguagcuucggaaugcauugggugaggcagaccccaggccggggucuggaauggguagcaauuauaugguccgacgggucucacaaggaguacacagauucggugaaaggacgcuuuacuaucucacgagacaacagccguaguacgauggauuugcagaugaauaacuuaagaccggaagacaccgccgucuauuacugugcgaaggaucugggcgagagggaaaaugaggagugggcuuccgacuauuacgauuucggccgggacuaucccgggcaggauccucgcggagugguugguucuauugacacauggggccaugggacuauggugaccgucagcucc

SEQ ID NO: 25257 - RNA, 432 nt, Artificial Sequence
  derived and/or modified sequence opt3 from anti-HIV_cap256-038-013345_VR-Chain
caggugcaacuggucgagagcggcgggggaguugugcagcccggucggucccucaggcuuucuugcgccguaucaggcuucaccuuuaguagcuacgggaugcacugggugcggcaggcuccuggaaagggccuggaaugggucgcagccaucuccuaugacgguucuaacaaauacuauguggauucgguuaaggggcgcuucacaauuucacgagacaauagcaaaaacacuuuguacuuacagaugaauagucugcgugcggaggauacggcuguguauuacugugccagagaccuaggagaaagggagauagaagagugggcaaccgauuauuacgacuuuuccaucggcuacccaggccaagauccgagaggggucgugggaguauucgacauuuggggucagggcacaaugguuacugugucuagc

SEQ ID NO: 25258 - RNA, 438 nt, Artificial Sequence
  derived and/or modified sequence opt3 from anti-HIV_cap256-038-011559_VR-Chain
caggugcaacuggucgagagcggcgggggaguugugcagcccggucggucccucaggcuuucuugcgaagccucaggcuucaccuuuaguagcuacgggauggacuggguacggcaggcuccuggaaagggccuggaguggguggcauugaucucccacgaugguucuaacaaacauuaugccgacucggucaaggggcgcuucacaauuucacgagauaauagccguaacacuuuauaccugcagaugaauagucuaagagcggaagacacggcucucuauuacugugccaaagaucugggagaguccgaaaacgaggacgaggaaugggcaucugauuauuacgacuuuggcagggauuauccaggccaagacagcagaggggugguuggaaccuucgauauguggggucagggcacaauggugacugucuccuca

SEQ ID NO: 25259 - RNA, 432 nt, Artificial Sequence
  derived and/or modified sequence opt3 from anti-HIV_cap256-038-009634_VR-Chain
caggugcaacuggucgagagcggcgggggaguugugcagcccgguaggucccucaggcuuucuugcgccgcuucaggcuucaccuuuacaaguuucgggaugcacuggguacggcaggcaccuggaaagggccuggaauggguggccgucaucagcuacgacgguaacaauaaauauuacgcggauuccgugaaggggcgcuuuacuauuucucgagagaacucgaaaaauacguuguauuuacagaugaacucacugcgugcugaagacaccgccguuuaccauugugcaaaggaucuaggagagagcgaaauagaggaguggacaagugacuauuacgauuucggcagagacuauccaggccaagauccgagagggguguuuggaacuuucgacaucuggggucacggcaccauggucacaguguccucu

SEQ ID NO: 25260 - RNA, 432 nt, Artificial Sequence
  derived and/or modified sequence opt3 from anti-HIV_cap256-038-006730_VR-Chain
caggugcaacuggucgagagcggcgggggaguugugcagcccggucggucccucaggcuuucuugcgccgcuucaggcuucaccuuuaguagcuucgggaugcacuggguacggcaggcaccuggaaagggccuggaauggguggccgucaucuccaaagacgguucugauaacucguacguggacucaguuaaggggcgcuuuacaauuagccgagauaauaguaaaaacacuuuguauuuacagaugaacucccugcgugcggaggacacggcuguguacuauugugccagagaucuaggagaaucugagaaugaagaguggccaagcgacuacuaugauuucggcagggacuacccgggccaagaucccagaggggucauaggaaccuuugacguguggggucagggcacaaugguaacuguuuccuca

SEQ ID NO: 25261 - RNA, 432 nt, Artificial Sequence
  derived and/or modified sequence opt3 from anti-HIV_cap256-038-004887_VR-Chain
caggugcaacuggucgagagcggcgggggaguugugcagcccgguagaucccucaggcuuucuugcgccgcuucaggcuucaguuuuagcaccuccgggaugcacuggguacggcaggcaccuggaaagggcauggaauggguggccgucaucucuuacgacgguucgaacaaauauuacgcggauucagugaaggggcgcuucacaauuagccgagacaauaguaaaaacacucuguauuugcagaugaacuccuuacgugcuguugauacggccguguacuauugugcaaaggaccugggagagggcgaaaaugaggaaugggccaccgauuacuaugacuuuucuauaggcuacccaguccaaaauccgagagggcuagugggagcuuucgauaucuggggucagggcacaaugguaacuguuagcucc

SEQ ID NO: 25262 - RNA, 432 nt, Artificial Sequence
  derived and/or modified sequence opt3 from anti-HIV_cap256-038-004840_VR-Chain
caggugcaacuggucgagagcggcgggggaguugugcagcccgguaggucccucaggcuuucuugcgccgcuucaggcuucaccuuuaguagcuucgggaugcacuggguacggcaguccccuggaaagggccuggaauggguggcagucaucucuuacgacgguaacaauaaauauuacgccgauucggugaaggggcgcuuuacaauuucacgagagaacagcaaaaauacuuuguauuuacagaugaacagucugcguacggacgauaccgcgguuuacuauugugcuaaggaccuaggagaauccgagacagaagaguggccaucugauuacuaugacuucggcagagauuacccgggccaagaccccagagggguggucggaacuuuugauauauggggucauggcaccauggugacaguaagcucc

SEQ ID NO: 25263 - RNA, 432 nt, Artificial Sequence
  derived and/or modified sequence opt3 from anti-HIV_cap256-038-002181_VR-Chain
gaggugcagcuggucgaaagcggcgggggacucguucaacccgguagaucccuuaggcugucuugcgccgcuucaggcuucaccuuugaggacuacgcaaugcacugggugcggcaggccccugggaagggauuggaauggguagcggugaucaguuaugauggcagcaacaaauacuaugucgacuccgugaagggucgcuucacaauuucucgagauaauucgaaaaacacuuuauaccugcagaugaacucacuacgugcugaggacacggccguuuauuacugugcaaaggaucucggggaaagcgagaaugaggaaugggccaccgacuauuacgauuuuaguauaggauacccaggccaggacccgagaggcguggucgggaucuucgauauuuggggacaagguacaauggugacuguauccucu

SEQ ID NO: 25264 - RNA, 432 nt, Artificial Sequence
  derived and/or modified sequence opt3 from anti-HIV_cap256-038-001902_VR-Chain
caggugcaacuggucgagagcggcgggggaguugugcagcccgguaggucccucaggcuuucuugcgccgcuucaggcuucaccuuuaguagcuucgggaugcacuggguacggcaggcaccuggaaagggccuggaauggguggccgucaucuccuacgacgguaacaauaaauauuacgcggauucugugaaggggcgcuuuacaauuucgcgagagaacucagaaaauacuuuguauuuacagaugaacagccugcgugcugacgauacggccguuuacuauugugcaaaagaccuaggagagagugaaaaugaggagugggccuccgauuacuaugacuucggcagagauuacccaggccaagacaccagagggguggucggaacauuugauauauggggucauggcacuauggugaccguaucuagc

SEQ ID NO: 25265 - RNA, 432 nt, Artificial Sequence
  derived and/or modified sequence opt3 from anti-HIV_cap256-038-000976_VR-Chain
caggugcaacuggucgagagcggcgggggaguugugcagcccgguagaucccucaggcuuucuugcgccgcuucaggcuucaccuuuaguagcuucgggaugcacuggguacggcaggcaccuggaaagggccuggaauggguggccgucaucuccgacgaugguaacaauaaauacuaugcggacucugugaaggggcgcuuuacaauuucgcgagauaacagcaaaaauacuuuguacuuacagaugaacucacugcguguugaggacacggcuguguauuacugugucaaggaugugggagaaagugagaaugaagagugggccuccgacuauuacgauuucggcagagacuauccaggccaagauaccagggcaguaguuggggccuuugacauauggggacaggguacaauggugacugucucuagc

SEQ ID NO: 25266 - RNA, 432 nt, Artificial Sequence
  derived and/or modified sequence opt3 from anti-HIV_cap256-038-000384_VR-Chain
caggugcaacuggucgagagcggcgggggaguugugcagcccgguaagucccucagacuuucuugcgccgcuucaggcuucaccuuuaguagcuacguaaugcacugggugaggcaggcaccugggaaaggacuggaaugggucgccgacaucuccuaugauggcucuaacaaguacuaugcggacucggugaaaggucgguugacaauuucacgcgauaauagcaagaacacuuuauaccugcagaugaauagucuacgagcugaggacacggccguuuauuacugugugaaagaucucggggaauccgagaaggaagaguggccaucugacuauuacgauuucggacgugacuacccgggccaagauagcagaggcgucguggggguauuugacauauggggacaggguaccaugguuacaguguccuca

SEQ ID NO: 25267 - RNA, 321 nt, Artificial Sequence
  derived and/or modified sequence opt3 from anti-HIV_206-314431_VR-Chain
caguucgugcugacccaacccccuagcgucuccgccgcuccaggccagaacguuacaaucucuugcucagggccgcccagucacauugagaagaaugacgugagcugguaccagagacucccuggaauggcaccaaaaaugguaauauaugaauccaggcggcgcccccuugguaucccugugcgauuuacugccucucguucgggcucaagcgcgacgcuggucauuaccggguugcagacagcugaugaggccgacuacuauuguggaacuugggauggcagaaugaacuucgguaccgggacaaccgugacuguuuua

SEQ ID NO: 25268 - RNA, 321 nt, Artificial Sequence
  derived and/or modified sequence opt3 from anti-HIV_206-247594_VR-Chain
cagagcauccugacccaacccccuuccgugucugccgcuccaggccagaacgucacaauuucaugcagugggccgcccagccacauagagaagaaugacguuuccugguaccagagauucccuggaauggcaccaaaaaugaucauuuaugaaucuaagaggcggcccuuuggugugccuggccgcuucucggccucacgaagcgggaaaagugcgacucucgcuaucacgggacuucagaccggcgaugaggccgacuacuauugugguacaugggaugggcguaugaacuuuggaacuggcaccacaguaaccgugcug

SEQ ID NO: 25269 - RNA, 321 nt, Artificial Sequence
  derived and/or modified sequence opt3 from anti-HIV_206-116890_VR-Chain
cagagcgugcugacccaacccccuuccgucucugccgcuccaggccagaacguuacaaucucaugcagugggccgcccagccacauugagaagaaugacguguccugguaccagcaucucccuggagaagcaccaaaaaugauaaucuaugagucuuggagaaggcccgccgguauuccugcgcgguucucggcuucacgcagcggcaagagugggacucuugccaucacgggacugcagaccggcgaugaagcagacuacuauugugguacauggaacgggcgaaugaauuuuggaacuggcaccacaguaaccguguug

SEQ ID NO: 25270 - RNA, 333 nt, Artificial Sequence
  derived and/or modified sequence opt3 from anti-HIV_206-072383_VR-Chain
cagagcgugcugacccaacccccuuccgucucugccgcuccaggccagagaguuaucauuucaugcagugggaacaauagcacaauaggaaacaauuucguguccugguaccagcagguaccggguacugcacccaagcuccuuaucuaugagacgaacaggcggccuucuggcauuccagaccgcuuuucggggucaaaaagcggaaccagugccacacuggcgaucuccggcuugcaaacuggugaugaagcugacuucuacuguaccguguggggaguccgaaaggggguggccgcaguuuuuggcacaggcacccguuuaacugugcug

SEQ ID NO: 25271 - RNA, 333 nt, Artificial Sequence
  derived and/or modified sequence opt3 from anti-HIV_206-037527_VR-Chain
cagagcgugcugacccaacccccuuccgucucugccgcuccaggccagaagguuaucauuucaugcagugggaacaauagcacaauaggaaaaauccucguguccugguaccagcagguaccggguacugcacccaaacuugugauuuaugagacgaacagaaggccuucuggcaucccagaccgguucucggggucaaagagcggaaccagugccacacuggcgauuacuggcuugcaaaccggugaugaagcugacuacuuuuguaaggucuggggagugcgcaaagggguugccgcaguguucggcacaggcaccaaggucacuguguua

SEQ ID NO: 25272 - RNA, 333 nt, Artificial Sequence
  derived and/or modified sequence opt3 from anti-HIV_206-009095_VR-Chain
cagagcgugcugacccaacccccuuccgucucugccgcuccagcacagagaguuaucauuucaugcaguggcgacaacagcacaauagggaauaacuucguguccugguaccagcagguaccgggagccgcgcccaagcuccuuaucuaugagacuaauaggcggccuucugguauuccagaucgcuuuucgggcucaaaaagcgggacgaccgcuacacuggccaucaguggauugcaaacuggcgacgaagcagauuaccacuguaccgugugggguguccgaaaggggguggccgcuguuuucggaacaggcaccaaagugacugucuua

SEQ ID NO: 25273 - RNA, 321 nt, Artificial Sequence
  derived and/or modified sequence opt3 from anti-HIV_176-503620_VR-Chain
cagagcgugcugacccaacccccuuccgucucuacagccccaggccagacuguuacggugucaugcagugggggaaccagcaacacagguaauaacuucguauccugguaccagcaccucccgggcacugcucccaaacuucugaucuaugagaauaacaagagaccuuugggggugccagacagguuuucuggagcaaagucgggcaccucagccacauuagcgcugaccggucuacagacuggggaugaaggagacuacuauugugcuacauggagcggcagucucaauauuggcaccgggacgaaagucuccgugcug

SEQ ID NO: 25274 - RNA, 321 nt, Artificial Sequence
  derived and/or modified sequence opt3 from anti-HIV_176-478726_VR-Chain
cagagcgugcugacccaacccccuuccgucucugccgcuccaggccagaacguuaauaucucaugcagugggccgcccagccacauugagagaaacgacguguccugguaccagcaucucccuggagcagccccaaagaugauaaucuaugaaucuuggaggcggcccgcggguauuccugaucgcuucucggcuucacgaagcggcgccagugcaacacuugccaucacugggcugcagacgggagacgaggcugauuacuauuguggcaccuggaauggucguaugaacuuugggacaggaacuaccguaacaguguug

SEQ ID NO: 25275 - RNA, 321 nt, Artificial Sequence
  derived and/or modified sequence opt3 from anti-HIV_176-245056_VR-Chain
cagagcgugcugacccaacccccuuccgucucugccgcuccaggccagaacguuacaaucucaugcagugggccgcccagccacauugagaagaauggaguguccugguaccagcaguucccugguauggcaccaaaaaugguaauauaugaaucuaagagaaggcccuuuggcgugccugcccgguucucggcgucacgcagcgggaaaagugcuacucucgccaucacgggacuucaaaccggcgacgaggcagauuacuauugugguacaugggacgggcgaaugaacuuuggaacuggcaccacagucaccgugcug

SEQ ID NO: 25276 - RNA, 321 nt, Artificial Sequence
  derived and/or modified sequence opt3 from anti-HIV_176-164413_VR-Chain
cagagcgugcugacccaacccccuuccgucucugccgcuccaggccagaagguuacaaucucaugcagugggggaacuagcaacauugguaauaacuacguguccugguaucagagacucccgggcacggcacccaaacuucugauauacgagaauaacaagaggccuucugggaucccagaccgguucucgggacccaaaucaggcaccagcgccacauuggcgauuacugguuuacagccuggggaugaagcugacuauuacugugccaccuggaguggaucccugaauuuuggcacaggcaccaagguaacugugcua

SEQ ID NO: 25277 - RNA, 333 nt, Artificial Sequence
  derived and/or modified sequence opt3 from anti-HIV_176-094308_VR-Chain
cagagcgugcugacccaacccccuuccgucucugccgcuccaggccagaagguuaucauuucaugcagugggaacaauagcacaauaggaaacaauuucguguccugguaccagcagguaccggguacugcacccaaacuccuuguguaugagacguacagaaggccuucuggcaucccagaccggucgucagggagcaagaguggaaccacagccacucaagcgauuuccggccugcagaccggugaugaagcugacuaucacuguacagucuggggagugcgcaaagggguugccgcaguguuuggcaccggcacuaaggucacaguguug

SEQ ID NO: 25278 - RNA, 333 nt, Artificial Sequence
  derived and/or modified sequence opt3 from anti-HIV_176-065321_VR-Chain
cagagcgugcugacccaacccccuuccgucucugccgcuccaggcagaaggguuaucauuucaugcagugggaacaauagcacaauaggaaacaauuucguguccugguaccagcagguaccggguacugcacccaagcuccuuguguaugagacgaaccggcgcccuucuggcaucccagaccgauuuucggggucaaaaagcggaaccagugccacacuggcgauuuccggcuugcagacuggugaugaagcugacuacuauuguaccgucuggggagugcguaaggggguugccgcaguguucggcacaggcaccaaagucacuguguua

SEQ ID NO: 25279 - RNA, 324 nt, Artificial Sequence
  derived and/or modified sequence opt3 from anti-HIV_119-099719_VR-Chain
cagagcgugcugacccaacccccuuccgucucugccgcuccaggccagaagguuacaaucucaugcagugggagcaacuccuacauuggaaauaaauauauaucuugguaccagcaguucccggguacugcacccaagcuccuuaucuaugagaacaauaaaagaccuucgggcgugccagacagguuuucagccagcaagagugcgacguccgcuacccuggccauuacaggguugcacacuggagaugaagcagacuacuauugugagaccugcgauggcucuggugggguauucggaacaggcaccaaagugacugucuua

SEQ ID NO: 25280 - RNA, 327 nt, Artificial Sequence
  derived and/or modified sequence opt3 from anti-HIV_119-099536_VR-Chain
gagcugacccagcccccuagcguguccgccgcuucuggccaaaacgucaauaucucaugcagugggggaagcuccaacauugguucuaauuacguuucgugguaucagcaguucccaggcacagcaccgaagcuccuuauauacgaaacuaacaaaagacccucagggaucccugacagguuuagcggaaguaaguccggcgccucugcgacgcuggcuauuaccgguuugcagacaggggaugaggccgacuauuacugugcaacuugggccgauagcuuaaauuccgcucggguguucggaaccggcacaaaaguaaccgugcug

SEQ ID NO: 25281 - RNA, 333 nt, Artificial Sequence
  derived and/or modified sequence opt3 from anti-HIV_119-098907_VR-Chain
cagagcgugcugacccaacccccuuccgucucugccacaccaggccagaagguuacuaucucaugcagugggagcaacuccaauauuggagacaaauacgugucuugguaucagcacuucccggguacggcucccaagcuccuuguauacgagaccuauagaaggccuucgggcauaccagaucgguuuucagggagcaaaaguggaacauccgcaacucuggccaucaccggcuugcagacaggugacgaagcggauuacuauuguaccauuuggggagugcgcaagggggucggcgcuguguucggcacugggacaaaaguuaucguguua

SEQ ID NO: 25282 - RNA, 324 nt, Artificial Sequence
  derived and/or modified sequence opt3 from anti-HIV_119-098555_VR-Chain
cagagcgugcugacccaacccccuuccgucucugccgcuccaggccagaacguuacaaucucaugcagugggagcgcauccaauauuggaaagaacuucgugucuugguaccagcagcucccggguacugcccccaaacuucugauauauggcucgaauaacagaccuucagggguaccagacagguuuagcggaaguaaguccggcacgucugcgagcuuggcuaucaccgguuuacaaacaggggaugaggccgacuacuauugugaaacuugggauggauccggcgcaguguucggcaccgggacaaaagucaccgugcug

SEQ ID NO: 25283 - RNA, 324 nt, Artificial Sequence
  derived and/or modified sequence opt3 from anti-HIV_119-097828_VR-Chain
cagagcgugcugacccaacccccuuccgucucugccgcuccaggccagaagguuacaaucucaugcagugggagcuccucuaacauugguaaaaauuacgugucgugguaucagcuccuuccgggaacugcacccagacugguaauauacgagaacgacgaaaggccuucaggcacgccagaucgguucagcgggaguaaguccggaaccucugccacauuggcgaucacuggcuuacacaccggugacgaggcugauuauuacugugaaacaugggacgggagcggaggcguguuuggcaccgggacuaaagucacagugcug

SEQ ID NO: 25284 - RNA, 324 nt, Artificial Sequence
  derived and/or modified sequence opt3 from anti-HIV_119-096480_VR-Chain
cagagcgugcugacccaacccccuuccgucucuggcgccccagggcagagaaucacaauuucaugcaguggaagcacuuccaacauaggucagaauuacguuucuugguaucagcaacucccgggcacggcucccaaacuucugaucucggacaacaauaggcggccuucauggaccccagaucgcuucagcgggaguaaguccggaacaucugcaacuuuggccauuaccggcuuacagacaggugacgaggcggauuacuauugugaaaccugggacgggagcggaggcguguuuggccccgggacucgaguaacagugcug

SEQ ID NO: 25285 - RNA, 324 nt, Artificial Sequence
  derived and/or modified sequence opt3 from anti-HIV_119-095664_VR-Chain
cagagcgugcugacccaacccccuuccgucucugccgcuccaggccagaagguuacaaucucaugcagugggggagcagccaacauugguaaaaauagcguguccugguaccagcagcucccgggcacugcgcccaaacuucugauauaugacaacaauagaaggccuucugggacgccagaucgguucucgggaucaaagagcggcaccagugcuacauuggccaucuccgguuuacaaacuggggacgaggcagauuacuauugugaaaccuggcacggaucuggcggcguauuugggacaggaaccaaggugacuguccug

SEQ ID NO: 25286 - RNA, 321 nt, Artificial Sequence
  derived and/or modified sequence opt3 from anti-HIV_119-095212_VR-Chain
cagagcgugcugacccaacccccuuccgucucugccgcuccaggccagaagguuacaaucucaugcagugggagcacuuccaacauuggaaaaucugacguguucugguaccagcagcucccggguacggcacccaaacuucugauaucggagaccucaagaaggccuagcggcaucccagaucgguuuaguggggccaaguccggaacaucugcgacuuuggcuauuaccggcuuacaaacaggugacgaagccgauuauuucuguagcaccugguccgggucacugaauuuuggaacuggcacacgcguaaccgugcua

SEQ ID NO: 25287 - RNA, 333 nt, Artificial Sequence
  derived and/or modified sequence opt3 from anti-HIV_119-094773_VR-Chain
cagagcgugcugacccaaucccccacagucucugccgcuccuggccagacuguuacgaucucaugcagugggggaaccagcaacguggguaagaauuucguauccugguaccagcaguuuccaagaacagcaccgaaacuccuuauuuaugagaacaauaagaggcccucuggcauaccugaccgguucucggggucaaaaagcggaaccagugccacucuggugaucacaggcuugcaaaccggugaugaagcggacuuuuacugugggacuugggauggauccuuacgcacaggcggcgucauugggaccggaacgcgagugacuguucug

SEQ ID NO: 25288 - RNA, 324 nt, Artificial Sequence
  derived and/or modified sequence opt3 from anti-HIV_119-094508_VR-Chain
cagagcgugcugacccaacccccuuccgucucugccacaccaggccagagaguuacugugucaugcagugggagcuccucuaacaucggaaaucacuacguaucgugguaucaacaggugccggguacggcucccaagcuccuuauuucagagaacagcaggcggccuaguggcaccccagaccgcuucuccgggucuaaaagcggaacauccgcaacucuggccauaaccggcuugcagacaggugaugaagcggacuacuauugugagaccugggaugggucaggaggcgucuuuggcacugggacaaaggugaccguuuua

SEQ ID NO: 25289 - RNA, 324 nt, Artificial Sequence
  derived and/or modified sequence opt3 from anti-HIV_119-093795_VR-Chain
cagagcgugcugacccaacccccuuccgucucugccgcuccaggccagaagguuacaaucucaugcagugggagcuccucuaacauuggaaauaacuacgugucgugguaucaguaccucccggguacugcacccaaacuucugauaucagagaauaacagaaggccuagcggcacgccagaccgguucaguggguccaagucuggaaccagcgccacauuggcgaucacuggcuuacagaccggugaugaagcugacuauuacugugagacaugggauggguccggaggcguauuuggcaccgggacuaaagugacaguccug

SEQ ID NO: 25290 - RNA, 321 nt, Artificial Sequence
  derived and/or modified sequence opt3 from anti-HIV_119-093732_VR-Chain
cagagcgugcugacccaacccccuuccgucucugccgcugcaggccagaacguuaauaucucaugcagugggagaaagagcaacgugggagguaauuacguauccugguaucagcaguucccaggcacagccccgaaacuccuuauuuacgaggacaacaagaggcccucuuggauaccugaucgguuuacugcgucgcgcucagggacgagcgcuacccugggaaucacaggcuugcaaacuggugacgaagccgauuauuucuguaguaccugguccgggucuuuaaauuuuggaacaggcacccgagugacuguccug

SEQ ID NO: 25291 - RNA, 333 nt, Artificial Sequence
  derived and/or modified sequence opt3 from anti-HIV_119-092903_VR-Chain
cagagcgugcugacccaacccccuuccgucucugccgcuccaagacagaagguuacaaucucaugcaguggcagcuccucuaacauugggaaucacuacgugucgugguaucagcagcucccgggaacugcacccaaacuucugauauacgagaacaauaagaggccuucagguaucccagaccgguucagcggcaguaaauccgggacgucugccaccuuggcgauuacaggauuacaaacuggcgaugaagcugacuauuacugugccaccugggcaccccgccugaacagcgcccgaguauuugguaaugggacaauggugaccguccua

SEQ ID NO: 25292 - RNA, 333 nt, Artificial Sequence
  derived and/or modified sequence opt3 from anti-HIV_119-092284_VR-Chain
cagagcgugcugacccaacccccuuccgucucuggcgccccagggcagagaguuacaaucucaugcacuggaaguagcuccaacauugguggcuacgacgugcacugguaucagcagguaccggggacggcucccaagcuccuucuguacgagaaugauaggcggccuucuggaauaccagaccgcuucucgggcucaaaaagcgguaccagugcaacauuggugaucacuggguuacaaaccggagaugaagccgacuuuuauuguggcacaugggauggcucccugcgaaccgggggagucauugguacuggcacacgugugaccguucua

SEQ ID NO: 25293 - RNA, 333 nt, Artificial Sequence
  derived and/or modified sequence opt3 from anti-HIV_119-091586_VR-Chain
cagagcgugcugacccaacccccuuccaugucugccgcuccaggccagagagucacaaucucaugcagugggacuagcuccgacauuggaaggaacuacguuucuugguaucagcaguucccgggugcagcccccaaggugcucauauacgaaaauucgaaccggccuucaggcaucccagaucgcuuuagcgggaguaaauccggaacgucugcgacccuugcuauuagcggccugcaaacaggugacgaggccgauuauuguugcgcaguauggggagugcgacguggggccggcgcugucuucggcgcagggacuaaggugaccguuuug

SEQ ID NO: 25294 - RNA, 333 nt, Artificial Sequence
  derived and/or modified sequence opt3 from anti-HIV_119-091023_VR-Chain
cagagcgugcugacccaacccccuuccgucucugccgcuccaggccagagaguuacaaucucaugcagugggagcacuuccaacauuggaaauaacuucgugucuugguaccaccauguaccggguacggcacccaagcuccuuauauaugacaaugugaaaaggccuaccaacgucccagaucgguuuucgggcucaaagagcgggacaagugccacucuggcgaucuccggauugcagaccggcgacgaggcugauuacuggugugccgugugggguguucgccgaggggcaggagccguguucggcgcuggcacaaaagucaccguguua

SEQ ID NO: 25295 - RNA, 333 nt, Artificial Sequence
  derived and/or modified sequence opt3 from anti-HIV_119-090334_VR-Chain
cagagcgugcugacccaacccccuuccgucucuggcgccccagggcagagaguuacaaucucaugcacuggaagugcuagcaacauuggugacuccgaugugcacugguaccagcagcucccgggcacggcacccaaacuucugauauucgacaaugauaagaggccuucugggaucccagaccgguuuucgggaucaaagagcggcaccagugccacauuggcgauuacugguuuacaauccggggaugaggcugacuauuacugugccguauggggagugcgccagggcgcaggcgccgucuucgggaccggaacaaaagugaccguucug

SEQ ID NO: 25296 - RNA, 333 nt, Artificial Sequence
  derived and/or modified sequence opt3 from anti-HIV_119-088694_VR-Chain
cagagcgugcugacccaacccccuuccgucucugccgcuccaggccagaagguuacaaucucaugcagugggagcuccucuaacauuccgauaaauggagugucgugguaccagcaguuccccgguacugcaccuaaacuccuuguauaugagacguacagaaggccaucaggcauccccgaccgguuuagcgggaguaaguccggaaccucugccacacuggcgauuacuggcuugcaaaccggugaugaagcugacuauuacuguacaguguggggaguccgcaaaggggugggcgccguuuucggcaccgggacuaaggugacagucuua

SEQ ID NO: 25297 - RNA, 333 nt, Artificial Sequence
  derived and/or modified sequence opt3 from anti-HIV_119-088499_VR-Chain
cagagcgugcugacccaacccccuuccgucucugccgcuccaggccagaagguuacaaucucaugcagugggagcaacuccuacauuggaaauaaauaugugucuugguaccagcaguucccggguacugcacccaagcuccuuauauaugagacgaacaaaagaccuucgggcaucccagacagguuuucagggagcaagaguggaaccuccgccacacuggcgauuacuggcuugcaaaccggugaugaagcugacuacuauugugccacaugggcaccccgguuaaauucugcccgcguauucgggaacggaaccauggugacuguccug

SEQ ID NO: 25298 - RNA, 333 nt, Artificial Sequence
  derived and/or modified sequence opt3 from anti-HIV_119-088298_VR-Chain
cagagcgugcugacccaacccccuuccgucucugccgcuccaaaggagaaaguuacaaucucaugcaguggcgggacuagcaacauuggaagaaauuacguguccugguaucagcagguaccggguacggcacccaagcuccuuauauacgaaaacaauaaaaggccuucuggcaucccagaccgguucucggggucaaagagcggaaccagugccacacuggugauuacuggcuugcagaccggugaugaggcggacuuuuauugugggacauggggaggcuccuuacgcaccggcgggguccugggaacugguacacgagugaccguucua

SEQ ID NO: 25299 - RNA, 324 nt, Artificial Sequence
  derived and/or modified sequence opt3 from anti-HIV_119-087488_VR-Chain
cagagcgugcugacccaacccccuuccgucucugccgcuccaggccagaagguuacaaucuucugcucagggagauacaguaacauugagagcaauuauguguccugguaccagcagcucccgggaacugcacccaaacuucugauacacgaaaacaauaggcggccuucugguacgccagaccgcuuuucgggcucaaagagcgggaccagugccacauuggcgaucacuggauuacauaccggcgaugaggcugacuauuacugugaaacaugggaugguuccgggggaguauucggcaccggcacuaaagugacaguccug

SEQ ID NO: 25300 - RNA, 333 nt, Artificial Sequence
  derived and/or modified sequence opt3 from anti-HIV_119-087423_VR-Chain
cagagcgugcugacccaacccccuuccgucucugccgcuccaggccagaagguuacaaucucaugcagugcaagcuccucuaacauugggaauaacuacgugucgugguaucagcagcucccggccacugcgcccaaacuucugauauacgacacggauaagagaccuucaggaaucccagacagguucagcgguaguaaauccggcaccucugcuacauuggccauuacuggguuacaaaccggagaugaggcagacuauuacuguacaguauggggcgugcggaagggugucggggccguguuuggaaccggcacuaaaguuacagugcug

SEQ ID NO: 25301 - RNA, 324 nt, Artificial Sequence
  derived and/or modified sequence opt3 from anti-HIV_119-087371_VR-Chain
cagagcgugcugacccaacccccuucccucucugccgcuccaggccagagagucacaaucucaugcagugggggagcaagcaacauugguaagaacuccguuucuugguacgugcagguaccgggcacugcccccaaacuucugauauaugagaauaaucagaggccuucggggaucucagaccgguucagcggaaguaaguccggcucuagcgcgacguuggguauuaccggguuacaaacagcugaugaagccgacuacuauugugagacuugggauggauccggcggcguguuugggaccggaacaaaagucaccgugcug

SEQ ID NO: 25302 - RNA, 321 nt, Artificial Sequence
  derived and/or modified sequence opt3 from anti-HIV_119-087279_VR-Chain
cagagcgugcugacccaacccccuuccgucucugccgcuccaggccagaagguuacaaucucaugcagugggagcuccucuaacauugguaaaaauuacgugucgugguaucagcaguucccgggaacugcacccaagcuccuuauguacgagaacaauaaaagaccuucaggcguaccagacagguuuagcgggaguaaguccggaacgucugccacccuggauauaagcggcuugcaaacaggugacgaagcggauuauuacuguuccacuuggucagggaguuuaaacuucggaaccggcacacgggugaccguccug

SEQ ID NO: 25303 - RNA, 324 nt, Artificial Sequence
  derived and/or modified sequence opt3 from anti-HIV_119-087146_VR-Chain
cagagcgugcugacccaacccccuuccgucucugccgcuccaggccagaagguuacaaucucaugcagugggagcuccucuaacauugguaaaaauucggugucaugguaccagcaguucccgggaacugcacccaagcuccuuauauaugagaacaauaaaagaccuagcggcaucccagacagguuuaguggguccaagucuggaacgagcgccacccuggcgauuacaggcuugcacacuggugaugaagcugacuacuauugugagaccugggauggguccggaggcguauucggcacagggaccaaagugacugucuua

SEQ ID NO: 25304 - RNA, 324 nt, Artificial Sequence
  derived and/or modified sequence opt3 from anti-HIV_119-087048_VR-Chain
caguucgugcugacccaacccccuagcgucuccgccgcuccaagacagaagguuaucauuucuugcucaggcaguagcuccaacauagggaaaaauuacgugucuugguaucagcagcucccgggaacagcacccaaacuucugaucuacgacaacgauaagaggccuucggguauuucagaccgguuuagcgccaguaaguccggcacuucugcgacguuggcuaucaccggguuacacacaggagaugaggccgacuauuacugugaaacuugggauggcagcggugggguauucggaaccggcacaaaagugaccguccug

SEQ ID NO: 25305 - RNA, 321 nt, Artificial Sequence
  derived and/or modified sequence opt3 from anti-HIV_119-085802_VR-Chain
cagagcauccugacccaacccccuuccgugucugccgcuccaggccagagagucacaauuccgugcuucgggggacacucaaacauagguaguaauuacguuagcugguaucagcaucuccccggcacugcaccuaaacuucugaucuuugagaacaauaagaggccauccgggauucccgaccgguucucuggagccaagucgggcacgucagcgaccuuggcuaucacagguuuacagacuggggaugaagccgacuacuuuugugcaaccuggagcggaggccugaacuucggcacagggaccaaagugacuguacua

SEQ ID NO: 25306 - RNA, 324 nt, Artificial Sequence
  derived and/or modified sequence opt3 from anti-HIV_119-085784_VR-Chain
cagagcuuccugacccaacccccuuccgugucugccgcuccaggccagaaggucacaaucucaugcagugggagcaacuccaauauuggaaacaauuacguuucuugguaucaguaccucccggguacugcacccaaacuucugauauaugagaacgacagaaggccuucgggcacgccagaucgguuuucagggagcaagaguggaaccuccgccacauuggcgaucacuggcuuacagaccggugacgaagcugauuacuauugugagacaugggacgggucuggaggcguguucggcaccgggacuaaaguaacagugcug

SEQ ID NO: 25307 - RNA, 333 nt, Artificial Sequence
  derived and/or modified sequence opt3 from anti-HIV_119-085370_VR-Chain
cagagcgugcugacccaacccccuuccgucucugccgcuccaggccagacaguuacuaucucaugcagugggagcuccucuaacauuggaaauacguacgugucgugguaucagcaccucccggguaccgcacccaaacuucugauauacgacaacaauaucagaccuucaggcauuccagauagguucagcgccaguaaguccgggacaucugcgacuuuggcuaucaccggauuacagacaggcgacgaggccgauuauuacugugcaaccugggcccccagccugaacuccgcucggguauuugguucagggacucgcguggcaguccua

SEQ ID NO: 25308 - RNA, 321 nt, Artificial Sequence
  derived and/or modified sequence opt3 from anti-HIV_119-085276_VR-Chain
cagagcauccugacccaacccccuuccgugucugccgcuccaggccagagagucacaauuucaugcagugggagcuccucuaacauaggaaauaacuacguuucgugguaucagcacgugccggguacugcacccaagcuccuuaucuacgagaauaacaggcggccuucaggcacgccagaccgcuucagcggggccaaaaguggaaccuccgcgacacuggcuauuacuggcuugcagaccggugaugaagccgacuauuuuuguucuacauggagcggguccuuaaauuucggaaccggcacuaagguaacagugcug

SEQ ID NO: 25309 - RNA, 333 nt, Artificial Sequence
  derived and/or modified sequence opt3 from anti-HIV_119-084885_VR-Chain
cagagcgugcugacccaacccccuuccgucucugccgcuccaggcgagaagguuacaaucucaugcagugggagcuccucuaaaauuggaaacaauuucgugucgugguaccagcagguaccggguacugcacccaagcuccuuguguaugaaucauacagaaggccuagcggcauaccagaccgguuuaguggguccaaaucuggaacgagcgccacccuggcgaucacaggcuugcagacuggugaugaggcugacuauuacuguaccgucuggggagugcgcaaggggguuggcgccguguucggcacagggaccaaagucacuguguua

SEQ ID NO: 25310 - RNA, 333 nt, Artificial Sequence
  derived and/or modified sequence opt3 from anti-HIV_119-084874_VR-Chain
cagagcgugcugacccaacccccuuccgucucuggcgccccaagacagaggguuacaaucucaugcagugggagcgcuuccaacauuggaaagaauagcgugucgugguaccagcagguaccggguacugcacccaaacuccuuauauaugagaacaauaagcggccuucaggcaucccagaccgcuucagcgggaguaaauccggaacgucugccacccuggugauuacaggcuugcaaacuggugaugaagcggacuuuuacugugggaccugggauggaucuuuacgaacaggcggcgucaucgggaccggaacucgugugacaguucug

SEQ ID NO: 25311 - RNA, 333 nt, Artificial Sequence
  derived and/or modified sequence opt3 from anti-HIV_119-084691_VR-Chain
cagagcgugcugacccaacccccuuccgucucugccgcuccaggccagaagguugugaucucaugcagugggagcuccucuauuauagagaaaaacucgaucucaugguaccagcagggaccgggugcagcccccaagcuccuuauuuaugaaaaugacaaaagaccuagcggcaucccagauagguucaguggguccaagucugcgacaagcgcuacucuggccauuguaggauugcaaacgggcgacgaggcagauuacuguugcgccgugugggguguccggcgcggggcuggagcaguguuuggcgccggcaccaaaguuacaguguua

SEQ ID NO: 25312 - RNA, 324 nt, Artificial Sequence
  derived and/or modified sequence opt3 from anti-HIV_119-083793_VR-Chain
cagagcgugcugacccaacccccuuccgucucugccgcuccaggccagaagguuacaaucucaugcagugggagcuccucuaacauugguaaaaauucggugucaugguaccagcagcucccggcaacugcccccaaacuucugauauaugagagcaacaagagaccuaguggaaucccagacagguucuccggcucuaagagcgggacguccgcgaccuuggcuauuacaggauuacaaacuggcgaugaagccgacuacuauugugcaaccugggauggucggguaucagugaucgggacaggaaccaaagucacugugcug

SEQ ID NO: 25313 - RNA, 324 nt, Artificial Sequence
  derived and/or modified sequence opt3 from anti-HIV_119-083163_VR-Chain
cagagcgugcugacccaacccccuuccgucucuggcgccccagggcagagaguuaucauuucaugcacaggaaguagcuccaacauaugggguuacgacgugcagugguaucagcaacucccgggcacugcucccaaacuucuguuguacgagaaugauaggcggccuucugggacgccagaccgcuucucgggaucaaagagcggcaccagugcaacauuagccaucacuggucugcacaccggggaugaagcggacuauuacugugagacaugggauggauccggcggcguauuugggaccggaacuaaggugacaguccua

SEQ ID NO: 25314 - RNA, 333 nt, Artificial Sequence
  derived and/or modified sequence opt3 from anti-HIV_119-082331_VR-Chain
cagagcgugcugacccaacccccuuccaucucugccgcuccaggccagaaggucacaauuucaugcagugggggaagcuccaacauaggugcaaauuacguuucuugguaucagcaccucccgggcacugcccccaaacuucugaucuacgagacgaacaagagaccuucggggauuccagacagguucucaggaagccagaguggcaccuccgcgacauuggugaucacugguuuacaaaccggggaugaagcugacuuuuauuguggaacauggggcggcucucugcgggccgggggaguaauugguaccggcacucgcgugacaguccua

SEQ ID NO: 25315 - RNA, 324 nt, Artificial Sequence
  derived and/or modified sequence opt3 from anti-HIV_119-082070_VR-Chain
cagagcgugcugacccaacccccuuccgucucugccgcuccaggccagaagguugugaucucaugcagugggagcuccucuauuauagagaaaaacucgaucucaugguaccagcagggaccgggugcagcccccaagcuccuuauuuaugaaaaugacagaaggccuagcggcacaccagaucgguucaguggguccaaaucuggaacuagcgcgacgcuggcuaucaccggcuugcaaacaggugacgaggccgauuacuauugugaaacuugggacggguccggaggcguauuuggcaccgggacaaaggugaccgucuua

SEQ ID NO: 25316 - RNA, 333 nt, Artificial Sequence
  derived and/or modified sequence opt3 from anti-HIV_119-081512_VR-Chain
cagagcgugcugacccaacccccuuccgucucugccgcuccaggccagaacguuacauucucaugcagugggagcaauuccaacaucggagacaauuacgugucuugguaucagcagauuccggguacugcacccaagcucguaauauacgauaacaauaaaagaccuucgggcaucccagacagguuuucagggagcaagaguggaacguccgccacccuugugauuacaggccugcaaacuggugaugaggcggacuucuauugugggaccugggauggaucuuugcggacaggcggcgucaucgggaccggaacucgcgugacaguuuua

SEQ ID NO: 25317 - RNA, 333 nt, Artificial Sequence
  derived and/or modified sequence opt3 from anti-HIV_119-080816_VR-Chain
cagcuggugcucacccaacccccuagcgccuccggcacaccagggcagagagucacuaucucuugcucaggaaguagcuccaacauugguucuaauuucguuucgugguaccagcagaggccgggcacggcucccaaacuucugauauaugagaccaacaagcggccuucagggaucccagaccgcuuuagcggaaguaaguccggcacaucugcaacuuuggccauuaccgguuuacaaacaggggaugaagcggacuacuauugugcuaccugggcaccccgacugaauagcgcccguguguucggaaacggcacuaugguaacagugcua

SEQ ID NO: 25318 - RNA, 333 nt, Artificial Sequence
  derived and/or modified sequence opt3 from anti-HIV_119-079302_VR-Chain
cagagcgugcugacccaacccccuuccgucucugccgcuccaggccagaagguuacaaucucaugcagugggagcuccucuuacauuggaaacaaauaugugucgugguaccagcaguucccggguacugcacccaagcuccuuauauaugagaauaacaaaagacugucaggcaucccugacagguuuagcgccaguaaguccgcgacgucugcuaccuuggccauuagcggguuacaaacaggagaugaagcagacuucuacuguggcacuugggaugguucccugcggaccgggggaguaaucggcacaggcacccgcgugacuguccua

SEQ ID NO: 25319 - RNA, 327 nt, Artificial Sequence
  derived and/or modified sequence opt3 from anti-HIV_119-079292_VR-Chain
cagagcgugcugacccaacccccuuccgucucugccgcuccaggccagaagguuacaaucucaugcagugggagcaacuccaauauuggaaacaauuacgugucuugguaucagcagcucccggguacugcacccaaacuucugauauacgacaacaauaagagaccuucgggcaucccagauagguucucagggagcaaaaguggaacguccgccaccuugggcauuacagguuuacaaacuggggacgaggcgaacuauuacuguggaaccugggauacaucucugagcggcguauuuggcaccgggacugaagugaucguccua

SEQ ID NO: 25320 - RNA, 321 nt, Artificial Sequence
  derived and/or modified sequence opt3 from anti-HIV_119-079289_VR-Chain
cagagcgcccugacccaacccccuuccgugucugcugcaccaggccagagagucacaaucucaugcagugggaacaauagcaacauuggaaauaacuucguuuccugguaccagcuccuuccggguacugcccccaagcuguugauauaugagaauaacaaaaggucuucgggcaucccugaccgguuuucagggagcaagaguggaacguccgcgaccuuaggcauuacaggucugcagacuggggaugaagcugacuacuucuguucuaccuggagcggaucccuaaauuuuggcacaggcacccgcgugacuguacuc

SEQ ID NO: 25321 - RNA, 324 nt, Artificial Sequence
  derived and/or modified sequence opt3 from anti-HIV_119-078935_VR-Chain
cagagcgugcugacccaacccccuuccgucucugccgcuccaggccagagaguuacaaucucaugcagugggacuagcgcaaacauugagaauuacuauguguccugguaccagcagcucccgggaacggcccccaaacuuauaaucuaugacgauaacaagaggccuucugguauuccacaacgguucucgggcucaaagagcgggaccagugcgacacugggaaucacuggcuugcagaccggugacgaagcugaguacuauugugaaacaugggauggguccggaggcguauuuggcaccgggacuaaagugacagucuua

SEQ ID NO: 25322 - RNA, 324 nt, Artificial Sequence
  derived and/or modified sequence opt3 from anti-HIV_119-078702_VR-Chain
cagagcgugcugacccaacccccuuccgucucugccgcuccaggccagaagguuacaaucucaugcagugggagcuccucuguguucggaaagaacuacguaucgugguaucagcaccucccggguacugcacccaaacuucugauuuacgagaauacgaaaagaccuucaggcauaccagacagguuuagcgggaguaaguccggaaccucugccacauuggcgaucacuggcuuacagaccggugaugaagcugacuauuacugugagacaugggaugggagcggaggcguguucggcuccgggaccaaagucacugugcug

SEQ ID NO: 25323 - RNA, 324 nt, Artificial Sequence
  derived and/or modified sequence opt3 from anti-HIV_119-078593_VR-Chain
cagagcuuccugacccagcccccuuccgugucugccgcuccaggccagaaggucacaaucucaugcagugggagcaacuccaauauuggaaacaauuacguuucuugguaucaacaggugccggguacugcacccaaacuccuuauauacgagaacaauaagagaccuucgggcaucccagacagguuuucagggagcaaaaguggaacguccgccacccugguaauuacaggcuugcacacuggugaugaagcggacuauuacugugagaccugggaugggucuggaggcguguucggcacagggagcaacgucaccuuacug

SEQ ID NO: 25324 - RNA, 333 nt, Artificial Sequence
  derived and/or modified sequence opt3 from anti-HIV_119-077708_VR-Chain
cagagcgugcugacccaacccccuucccucucugccgcuccaggccagaaggucacaaucucaugcagugggacuacgagcaacauuggaaauaacuacguuuccugguaucagcaccuuccggguaccgcacccaaacuguugauauacgagaauacaaagagaccuucuggcaucccagacagguucucggggucaaaaagcggaaccagugccacuuuaggcauuacaggucugcagaccggggaugaagcggacuauuacuguacuguguggggaguacggaagggcgugggcgcugucuuugggacaggaaccaaagugacgguucua

SEQ ID NO: 25325 - RNA, 321 nt, Artificial Sequence
  derived and/or modified sequence opt3 from anti-HIV_119-076904_VR-Chain
cagagcgugcugacccaacccccuuccgucucugccgcuccaggccagaagguuacaaucucaugcaguagaagcuccucucacauugagaacucguacgugucaugguaucagcaucucccggggacugcacccaaacuucugauauacgaaaauaacaagaggccuagcggaaucccagaccgguucagugguuccaaaucuggcacgagcgccaccuuggggauuuccggauuacagacaggcgaugaggcggacuauuuuuguucaacuuggagugguagccugaauuucgggaccggaacacgcguaaccgugcua

SEQ ID NO: 25326 - RNA, 324 nt, Artificial Sequence
  derived and/or modified sequence opt3 from anti-HIV_119-075862_VR-Chain
cagagcgugcugacccaacccccuuccaucucugccgcuccaggccagaaggucacaauuucaugcagugggagcgcauccaacauagguaaaaauucuguuucgugguaccagcaguucccgggaacugcccccaagcuccuuaucuaugagaacaauagaaggccuucaggcacgccagaccgguuuagcgggaguaaauccggaaccucugcgacacuggcuauuacuggcuugcaaaccggugaugaagccgacuacuauugugagacaugggaugggagcggaggcguguucggcaccgggacuaagguaacaguguua

SEQ ID NO: 25327 - RNA, 333 nt, Artificial Sequence
  derived and/or modified sequence opt3 from anti-HIV_119-075465_VR-Chain
cagagcgugcugacccaacccccuuccgucucugccgcuccaggccagaagguugugaucucaugcagugggagcuccucuauuauaggaaacaauuacguaucgugguaucagcagcucccggguacagcacccaaacuucugaucuacgagaacaauagaaggccuucaggcauuccagaccgguucagcgggaguaaguccggaacuucugccacguuggcgaucagcggcuuacaaaccggugaugaagcugacuauuguugcgccguguggggaguccgccgaggggcaggcgccguguuuggcgcugggacaaaaguuacugugcug

SEQ ID NO: 25328 - RNA, 330 nt, Artificial Sequence
  derived and/or modified sequence opt3 from anti-HIV_119-074822_VR-Chain
agcgugcugacccagcccccuuccgucucugccgcuccaggccaaaacaucacaauuucaugcagugggggaagcuccaauauagcaaagaacuacaucucuugguaucagcaccucccggguacugcccccaaaauuguuaucuacgacaaugauaagagaccucuuggcauuccagacagguucucggcgucaaaaagcgggacgagugcuacccugggaaucacaggcuugcagacuggugaugaggccgacuauuacugugcaguguggggaguacggcgcggggugggcgccgucuuuggcgcugggaccaaggugauaguuuua

SEQ ID NO: 25329 - RNA, 333 nt, Artificial Sequence
  derived and/or modified sequence opt3 from anti-HIV_119-074629_VR-Chain
cagagcgugcugacccaacccccuuccgagucugccgcuccaggccagaaggucacaaucucaugcagugggggaacuagcaacauugguaauaacuacguuuccugguauagaaggcucccgggcacggcacccaaacuucugauauacgaaaauaaccggcgcccuucugggaucccagaccgauucucgggaucaaagagcggcaccagugccacauuggcgauuuccgguuuacagacuggggaugaggcugacuauuguugcgccguguggggaguacguagaggcgcaggcgccguguuuggggcuggaaccaaagucacagugcug

SEQ ID NO: 25330 - RNA, 324 nt, Artificial Sequence
  derived and/or modified sequence opt3 from anti-HIV_119-074500_VR-Chain
cagagcgugcugacccaacccccuuccgucucugccgcuccaggccagaagguuacaaugucaugcagugggagcuccucuaacaucggaaauaacuacgugucgugguaucaguaccucccggguacugcacccaaacuucugauuuaugagaaugacagaaggccuucaggcauaccagaucgguucagcgccaguaaguccgggacgucugcgaccuuggcuaucacaggauuacagacuggcgacgaagccgauuacuauugugagaccugggacgguagcgggggaguauuuggcacaggcaccaaagugacuguccug

SEQ ID NO: 25331 - RNA, 333 nt, Artificial Sequence
  derived and/or modified sequence opt3 from anti-HIV_119-073911_VR-Chain
cagagcgugcugacccaacccccuuccgucucugccgcuccaggccagagaguuacaaucucaugcagugggagcuccucuaacauugagaauaacuacgugucgugguaucagcaccucccgggaacugcacccaaacuucugguauacgacgauaauaagaggccuucagguauaccacaucgguucagcgccaguaaguccggcacgucugcgaccuuggcuaucacaggguuacagacuggagacgaagccgauuauuacuguacccuguggggcgugcgcaaaggugucggggcaguguuuggaacaggcaccaagguuacugugcua

SEQ ID NO: 25332 - RNA, 324 nt, Artificial Sequence
  derived and/or modified sequence opt3 from anti-HIV_119-072765_VR-Chain
cagagcgugcugacccaacccccuuccgucucugccgcuccaggccagaagguuacaaucucaugcagugggaacagcuccaauauuggaaacaauuucgugucuugguaccagcagguaccggguacugcacccaaacuccuuguguaugagacguacagaaggccuucgggcaccccagaccgguuuucagggagcaagaguggaacauccgccacucuggcgauaucuggcuugcaaaccggugaugaagcugacuauuacugugggacaugggauggaagcggcggcgucuucgggaccggaacuaaagugacaguuuua

SEQ ID NO: 25333 - RNA, 333 nt, Artificial Sequence
  derived and/or modified sequence opt3 from anti-HIV_119-072313_VR-Chain
caguucgugcugacccaacccccuagcgucuccgccgcuccaggccagaagguuacaaucucuugcucagcaaguagcuccauuauagggaaaaacuacgugucuugguaucagcaguuuccgggaacugcccccaagcuccuuaucuacgaggacaauaaaagaccuucggguauuccagauagguucucaggcagcaagagugggacguccgcgacccuggcuaucacaggauugcaaacuggcgacgaagccgauuauuacuguaccguauggggugugcggaaaggggucggagcaguguuuggcacaggcaccaagguuacuguguua

SEQ ID NO: 25334 - RNA, 333 nt, Artificial Sequence
  derived and/or modified sequence opt3 from anti-HIV_119-072280_VR-Chain
cagagcgugcugacccaacccccuuccgucucugccgcuccaggccagaagguuucaaucaguugcagcggguccgacucuaaccucggagauaauuacgugucgugguaucagcaguucccggguacagcacccaaacuucugauucacgacaacaauaagagaccuucaggcacuccagauagguuuagcgggaguaaauccggaacgucugccaccuuggcgauaacaggcuuacaaacuggugacgaggcugauuacuauugugccaccugggcaccccggcugaacagcgcccgcguauucgggaauggaacaauggugaccguccua

SEQ ID NO: 25335 - RNA, 333 nt, Artificial Sequence
  derived and/or modified sequence opt3 from anti-HIV_119-071693_VR-Chain
cagagcgugcugacccaacccccuuccgucucugccgcuccaggccagaagguugugaucucaugcagugggagcuccucuauuauagagaaaaacucgaucucaugguaccagcagggaccgggugcagcccccaagcuccuuauuuaugaaaaugacaaaagaccuagcggcaucccagauagguucaguggguccaagucuggaacaagcgcgacucuggcuauuacgggcuugcaaaccggugacgaggccgauuacuauuguacaaucuggggaguacggaaaggggugggcgcagucuuuggcacugggaccaaggugacaguuuua

SEQ ID NO: 25336 - RNA, 321 nt, Artificial Sequence
  derived and/or modified sequence opt3 from anti-HIV_119-071353_VR-Chain
cagagcgugcugacccaacccccuuccgccucugcugcaccaggccagaaggucacaaucucaugcagugggagcaacuccaauauuggaaacaauuucguuucuugguaccagcucuuuccggguacugcccccaaacuucugauauucgagaacaauaagagaccuucgggcaucccagacagguuuucaggggcgaaaagcggaacgagugcuaccuuggccauuacaggcuuacagacuggugaugaagcagacuauuucuguuccaccuggucugggagccugaacuuuggaacaggcacccgggugacuguacua

SEQ ID NO: 25337 - RNA, 324 nt, Artificial Sequence
  derived and/or modified sequence opt3 from anti-HIV_119-069711_VR-Chain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacgacaauaacaauagaccuucaggcguaccagauagguucagcgggaguaaguccggaacgucugccaccuuggcgaucacaggcuuacaaacuggugacgaggcugauuauuacugugaaaccugggacgauagcgggggaguguuuggcacaggcaccaaagucacugugcug

SEQ ID NO: 25338 - RNA, 333 nt, Artificial Sequence
  derived and/or modified sequence opt3 from anti-HIV_119-069061_VR-Chain
cagagcgugcugacccaacccccuuccgucucugccgcuccaggccagaagguuacaaucucaugcagugggagcuccucuaacauuggaucgaauuacgugucaugguaucagcagcucccggguacugcacccaaacuucugguauacgacaacaaugagagaccuagcggcauaccagauagguucaguggguccaagucuggaacgagcgccaccuuggcgaucacaggcuuacaaacuggugacgaagcugauuauuacugugccaccugggcaccccggcugaacuccgcccgcguguuugggaauggaacaauggucaccgugcua

SEQ ID NO: 25339 - RNA, 324 nt, Artificial Sequence
  derived and/or modified sequence opt3 from anti-HIV_119-068202_VR-Chain
cagagcgugcugacccaagagcccuccgucucuggcgccccugggcagagaguuacaaucucaugcacuggaaguaacagcaauauugguggccacgacgugcauugguaccagcagcucccagggacggcuccgaaacuucugauauaugauaacgacaagaggcccuccggaaucccugaucgguucucuggcucgaagucagacaccagcgcaaguuuggguauuacaggguuacaaacuggagaugaagccgacuacuauugugagaccugggauggcuccggcgggguauuuggaacagguaccaaagugacuguccug

SEQ ID NO: 25340 - RNA, 324 nt, Artificial Sequence
  derived and/or modified sequence opt3 from anti-HIV_119-068063_VR-Chain
cagagcgcccugacccaacccccuuccgcuucuggcucacucgggcagagugugacaaucagcugcacuggaacgagauccgacgucgguaacuacuauguuucuugguaccagcagcuuccaggcaccgcaccgaagcuguugauuucggagaauaacaggcggcccucagggacaccugaucgcuucagcggaaguaaauccggcacuucugccaccuuagcgauaagcggucugcaaacaggggacgaagcugauuauuacuguggaaccugggacggcuccggcgggguguuuggaacugguacaaagguaaccgugcua

SEQ ID NO: 25341 - RNA, 333 nt, Artificial Sequence
  derived and/or modified sequence opt3 from anti-HIV_119-067980_VR-Chain
cagagcgugcugacccaacccccuuccgucucugccgcuccaggccagaagguuacaaucucaugcagugggaacagcuccaauauuggaaacaauuucgugucuugguaccagcagguaccggguacugcacccaaacuccuuguguaugagacguacagaaggccuucgggcauaccagaccgguuuucagggagcaagaguggaaccuccgccacacuggcgaucacuggcuugcaaaccggugaugaagcugacuaucacugugccauuuggggaguccgcaaaggggugggcgcaguuuucggcacagggaccaaggugacugucgug

SEQ ID NO: 25342 - RNA, 324 nt, Artificial Sequence
  derived and/or modified sequence opt3 from anti-HIV_119-067866_VR-Chain
cagagcgugcugacccaacccccuuccgucucugccgcuccaggccagaagguuacaaucucaugcagugggagcacuuccacgauuggaaacaauuacgugucuugguaucagcaccucccggguaccgcacccaaacuucugauauacgacaacaauaagagaccugccggcaucccagauagguucacagcgucgaaaucagggacuagcgcuaccuuggccauuacaggauuacauaccggcgacgaggcagauuauuacugugaaacuugggacgguagugggggaguauuuggcacaggcaccaaggugacgguccug

SEQ ID NO: 25343 - RNA, 321 nt, Artificial Sequence
  derived and/or modified sequence opt3 from anti-HIV_119-067756_VR-Chain
cagagcgugcugacccaacccccuuccgucucugccgcuccaggccagaagguugugaucucaugcagugggagcacauccaacauuggaaagaauuucguaucuugguaccagcagcucccggguacugcacccaaacuucugauauaugagaacucgagaaggccuucaggcaucccagaccgguuuagcggggccaaaaguggaacguccgcgaccuuggcuauuacaggcuuacaaacuggugaugaagccgacuacuucuguucuaccuggagcgggucccugaauuuuggaacaggcacccgcgugacuguccua

SEQ ID NO: 25344 - RNA, 321 nt, Artificial Sequence
  derived and/or modified sequence opt3 from anti-HIV_119-066859_VR-Chain
cagagcgugcugacccaacccccuuccgucucugccgcuccaggccagaagguuacaaucacuugcucagggagugcaagcaacauugagaauaacuacguguccugguaucagcaguucccgggacccgccccuaaacuccuuauauacgaaaaugacaagagaccaucugguauccccgauagguuuucgggcucagcgagcgggacgagugcuacccuggccauuacaggauugcaaacuggcgacgaggcagauuauuucuguuccaccuggucugguagcuuaaacuuugggacaggaacccggguaacugugcug

SEQ ID NO: 25345 - RNA, 333 nt, Artificial Sequence
  derived and/or modified sequence opt3 from anti-HIV_119-065821_VR-Chain
cagagcgugcugacccaacccccuuccgucucugccacaccaggccagagaguuacugugucaugcagugggagcuccucuaacaucggaaaucacuacguaucgugguaucaacaggugccggguacggcucccaagcuccuuauuuacgacaacucaaauaggccuagcggcauaccagaucgguucaguggguccaaaucuggaaccagcgcaacacugggcaucacugguuugcagaccggggacgaggccgauuauuacuguacagucuggggagugcgcaagggcguuggcgcgguguuugggaccggaacuaaagucacaguguua

SEQ ID NO: 25346 - RNA, 333 nt, Artificial Sequence
  derived and/or modified sequence opt3 from anti-HIV_119-065191_VR-Chain
cagagcgugcugacccaacccccuuccgucucugccgcuccaggccagaagguuacaaucucaugcagugggaacaauagcaacauuggaaauaacuacguguccugguaucagcagcucccggguacugcacccaaacuucugauauucgagaaucacaagagaccuucuggcaucccagacagguuuucggggucaaaaagcggaacgagugccaccuugggcauuacagguuuacaauccggggaugaagcggacuacuauugugcuacuugggcaccccggcugaacucugcccgcguauucggaaccggcacaaaggugaccguccua

SEQ ID NO: 25347 - RNA, 333 nt, Artificial Sequence
  derived and/or modified sequence opt3 from anti-HIV_119-064667_VR-Chain
cagagcgugcugacccaacccccuuccgucucugccgcuccaggccagaagguuacaaucucaugcagugggagcaacuccuacauuggaaauaaauaugugucuugguaccagcagguaccggguacugcacccaagcuccuuauauaugagaacaauaaaagaccuucgggcaucccagacagguucucagggagcaagaguggaacguccgccacccuggugauuacaggcuugcaaacuggugaugaagcggacuuuuacugugggaccugggauggaucuuuacggacaggcggcgucaucgggaccggaacucgcgugacaguucug

SEQ ID NO: 25348 - RNA, 324 nt, Artificial Sequence
  derived and/or modified sequence opt3 from anti-HIV_119-063791_VR-Chain
cagagcgugcugacccaacccccuuccgucucugccgcuccaggccagaagguuccgaucucaugcagugggaacagcuccaauauuggaaacaauuacgugucuugguaucagcagcuccccgguacagcaccuaaacuucugauauacgagaacaauaagagaccaucgggcauccccgacagguucucagggagcaaaaguggaacuuccgccacguuggcgauuaccggcuuacacacaggugaugaagcugacuauuacugugagacuugggaugggucuggaggcguauuuggcaccgggacaaaggugaccguccug

SEQ ID NO: 25349 - RNA, 333 nt, Artificial Sequence
  derived and/or modified sequence opt3 from anti-HIV_119-062989_VR-Chain
cagagcgugcugacccaacccccuuccgucucugccgcuccaggccagagaguuacaaucucaugcagugggagcuccucuaacauuggaaauaacuucgugucgugguaccagcaguuuccggguacuguacccaagcuccuuauauaugagaauaacaggcggccuucaggcaucccagaccgcuucagcgggaguaaauccggaacgucugcaacccuggccauuacaggcuugcaaacuggugaugaagcggacuacuauugugcuguguggggaguccgacguggggugggcgccguuuuuggcgcagggaccaaggugaucgucuua

SEQ ID NO: 25350 - RNA, 321 nt, Artificial Sequence
  derived and/or modified sequence opt3 from anti-HIV_119-062286_VR-Chain
cagagcgugcugacccaacccccuuccgucucugccgcuccaggccagaagguuacaaucucaugcagugggagcgcauccaacauuggaaagaauuucgugucuugguaccagcagcucccggguacugcccccaaacuucugauaucggagaacaauagaaggccuucaggcacgccagaccgguuuagcgggaguaaauccggagcgucugcuaccuugguaaucagcggcuuacaaacaggugaugaagccgacuauuacugugcaacuugguccgggucacugaguauuggaaccggcacaaaggugaccguccua

SEQ ID NO: 25351 - RNA, 321 nt, Artificial Sequence
  derived and/or modified sequence opt3 from anti-HIV_119-061416_VR-Chain
cagagcgugcugacccaacccccuuccgucucugccgcuccaggccagaagguugugaucucaugcagugggagcuccucuauuuucgagaaaaacucgauaucaugguaccagcagggaccgggugcagcccccaagcuccuuaucuaugaaaaugacaaaagaaggagcggcauuccugaucgguuuaguggguccaagucugcgacaagcacuacgcuggcuaucguaggauugcaaaccggcgacgaggccgauuacuucuguuccacauggucagguaguuuaaacuuugggacuggaacccgcgugacaguccug

SEQ ID NO: 25352 - RNA, 321 nt, Artificial Sequence
  derived and/or modified sequence opt3 from anti-HIV_119-061344_VR-Chain
cagagcgugcugacccaacccccuuccgucucugccgcuccaggccagaagguuacaaucucaugcagugggagcuccucuguguucggaaagaacuacguaucgugguaucagcaccucccggguacugcacccaaacuucugauuuacgagaauaacaaaagaccuucaggcauaccagacagguuuagcggggccaagaguggaacggcggcuaccuuggccaucacaggcuuacagacuggugaugaagcagacuauuacugugccaccugguccgggucucugaauuucggaacaggcaccaaagugacuguccua

SEQ ID NO: 25353 - RNA, 324 nt, Artificial Sequence
  derived and/or modified sequence opt3 from anti-HIV_119-060240_VR-Chain
cagagcgugcugacccaacccccuuccgaguacggcgccccagggcacaacgucacaguuucuugcucaggaacuacgaguaauaucgaaaacaauuucgugagcugguaucucauuguaccggguaccgcucccaaacuucugauauuugacaacgauaagagaccuuccggcaucccagacagguucucugggucgaagucaggaacaagcgcaacuuuggccauuaccggcuuacagacaggugaugaggcggacuacuauugugcuaccugggaugggcgggugagugucaucggaacuggcacaaaagugaccguucug

SEQ ID NO: 25354 - RNA, 333 nt, Artificial Sequence
  derived and/or modified sequence opt3 from anti-HIV_119-060184_VR-Chain
cagagcgugcugacccaacccccuuccgucucuggcgccccagggcagagaguuacaaucucaugcaguggaagcuccucuaacauugguucgaauacugugaacugguaccagcagcucccgggcacggcucccaaacuucugauauaugacaauaacaagaggccuucagggaucccagaucgguucagcggaaguaaguccggcaccucugcaacauugguaauuacugguuuacaaaccggggacgaggccgauuuuuacuguggaacaugggacggcagccugcgcaccggcggggugaucggaacugguacacgagucaccgugcua

SEQ ID NO: 25355 - RNA, 321 nt, Artificial Sequence
  derived and/or modified sequence opt3 from anti-HIV_119-058035_VR-Chain
cagagcgugcugacccaacccccuuccgucucugccgcuccaggccagaagguuacaaucucaugcagugggagcgcauccaacauuggaaagaauuucgugucuugguaccagcagcucccggguacugcccccaaacuucugauauaugagaacaauagaaggccuucgggcacgccagaccgguuuucaggggcgaaaagcggaaccagugcuacauuggccaucacuggcuuacaaaccggugaugaagcagacuacuucuguuccacauggucugggagccugaacuuuggaaccggcacucgcguaacagugcua

SEQ ID NO: 25356 - RNA, 321 nt, Artificial Sequence
  derived and/or modified sequence opt3 from anti-HIV_119-057858_VR-Chain
cagagcgugcugacccaacccccuuccgucucugccgcuccaggccagaacguuaauaucucaugcagugggggaagcuccaacauugguucuaauuacgugucgugguaucagcaguucccgggcacagcacccaagcuccuuauauacgagaacaauaaaagaccuucagggaucccagacagguuuagcggagccaagaguggcacuuccgcgacgcuggcuauuaccgguuugcaaacaggggaugaagccgacuauuucuguucuacuuggagcggauccuuaaacuuuggcaccggcacacggguaaccgugcug

SEQ ID NO: 25357 - RNA, 324 nt, Artificial Sequence
  derived and/or modified sequence opt3 from anti-HIV_119-057473_VR-Chain
cagagcgugcugacccaacccccuuccgucucugccgcuccaggccagaagguuacaaucucaugcagugggagcuccucuaacauuggaaauaacuacgugucgugguaucagcaccucccggguacugcacccaaacuucugauauacgacacguauucaagaccuagcggcaucccagauagguucaguggguccaagucuggaaccagcgccacauuggcgauuacuggcuuacagaccggugacgaggcugauuacuauugugggacaugggacggauccggcggcguauuugggaccggaacuaaagugacaguccug

SEQ ID NO: 25358 - RNA, 321 nt, Artificial Sequence
  derived and/or modified sequence opt3 from anti-HIV_119-057090_VR-Chain
cagagcgugcugacccaacccccuuccgucucugccgcuccaggccagacaguuacuaucucaugcagugggagcacguccaacauuggaaagaaugacgugucuugguaccagcagcucccggguaccgcacccaaacuucugauaucggagaacaauagaaggccuucaggcacaccagaucgguucagcgccaguaaguccgggacuucugcgaccuuggcuaucacaggauuacaaaccggcgacgaagccgauuauuuuuguagcacuugguccgguucacugaacuucgggacaggaacccgcguaacggugcua

SEQ ID NO: 25359 - RNA, 333 nt, Artificial Sequence
  derived and/or modified sequence opt3 from anti-HIV_119-055754_VR-Chain
cagagcgugcugacccaacccccuuccgucucugccgcuccaggccagaagguuacaaucucaugcagugggaacagcuccucuauuggaaauaacuucgugucgugguaccagcagcucccggguacugcacccaaacuucugguauaugagaauuacagaaggccuucaggcauaccagaccgguuuagcgggaguaaguccggaacgucugccaccuuggcgaucgauggcuuacaaacaugggacgaagcugauuaucacugugccauuuggggugugcgcaaaggggucggagcaguguucggcacuggcaccaagguuacagugguc

SEQ ID NO: 25360 - RNA, 324 nt, Artificial Sequence
  derived and/or modified sequence opt3 from anti-HIV_119-054899_VR-Chain
cagagcgugcugacccaacccccuuccgucucugccgcuccaggccagaagguuacaaucucaugcagugggagcaacuccuacauuggaaauaaauaugugucuugguaccagcaguucccggguacugcacccaagcuccuuauacacgagaacaauagaaggccuucgggcacgccagaccgguuuucagggagcaaaaguggaaccuccgccacacuggcgaucucuggcuugcaaacuggugaugaagcugacuauuacugugagaccugggaugggagcggaggcguauucggcacagggaccaaggugacugucuua

SEQ ID NO: 25361 - RNA, 324 nt, Artificial Sequence
  derived and/or modified sequence opt3 from anti-HIV_119-054501_VR-Chain
cagagcgugcugacccaacccccuuccgucucugccgcuccaggccagaagguuacaaucucaugcagugggacuagcuccaacauuggaaauaacuacgugucuugguaucagcaccucccggguacggcacccaaacuucugauauucgagaccaauaagagaccuucgggcaucccagacagguuuucagccagcaaaagugggacauccgcgacuuuggcuauuaccggauuacagacaggcgaugaagccgacuacuauugugagaccugggaugguucugggggaguauucggccccggcacucgggugacaguccug

SEQ ID NO: 25362 - RNA, 324 nt, Artificial Sequence
  derived and/or modified sequence opt3 from anti-HIV_119-051867_VR-Chain
cagagcgugcugacccaacccccuuccgucucugccgcuccaggccagaagguuacaaucucaugcagugggaacagcuccaauauuggaaacaauuucauaucuugguaccagcagcucccggguacugcacccaaacuucugaucuaugagaacgacagaaggccuucgggcacgccagaucgguuuucagggagcaagaguggaaccuccgccacauuggcgauuacuggcuuacaaaccggugacgaagcugauuacuauugugagacaugggacgggucuggaggcguguucggcaccgggacuaaaguaacagugcug

SEQ ID NO: 25363 - RNA, 324 nt, Artificial Sequence
  derived and/or modified sequence opt3 from anti-HIV_119-051814_VR-Chain
cagagcgugcugacccaacccccuuccgucucugccgcuccaggccagaagguuacaaucucaugcagugggagcaacuccaauauuggaaacaaagacgugucuugguaccagcagauaccggcaacugcccccaagcuccuuaucuaugagaauaacaaaagaccuucggguauuccagauagguucucaggcagcaagagugggacguccgcgacccuggcuaucacaggauugcaaacuggcgacgaagccgauuacuauugugcaaccugggacggucggguaucugugauugggacaggaaccaaugucaucguguua

SEQ ID NO: 25364 - RNA, 321 nt, Artificial Sequence
  derived and/or modified sequence opt3 from anti-HIV_119-051567_VR-Chain
cagagcgugcugacccaacccccuuccgucucugccgcuccaggccagaagguuacaaucuacugcucagggaguagaagcaacauuggaaggaauuaugcauccugguaccagcagcucccggguacugcccccaaacuucugauauucgacaacaaucggcgcccuucuggcaucccagaucgauuuucgggggcgaagucaggaacgagcgcuaccuuggccauuacaggcuuacaaacuggugacgaggcagauuauuucuguaguaccugguccgggucucugaacuuuggaacaggcacccgugugacuguacua

SEQ ID NO: 25365 - RNA, 324 nt, Artificial Sequence
  derived and/or modified sequence opt3 from anti-HIV_119-051483_VR-Chain
cagagcgugcugacccaacccccuuccgucucugccgcuccaggccagaagcucacaaucucaugcagugggacuagcuccaacauuggaaauaacuacguuucuugguaucagcaccuuccggguacggcacccaaacuguugauauacgagaauaacagaaggccuucgggcaucccagaacgguucucagccagcaagagugggaccuccgcgacauuaggaauuacuggccugcagaccggugacgaggcugauuauuacugugaaacaugggacgauucugggggaguguuuggcaccggcacuaaaguaacagugcua

SEQ ID NO: 25366 - RNA, 333 nt, Artificial Sequence
  derived and/or modified sequence opt3 from anti-HIV_119-050913_VR-Chain
cagagcgugcugacccaacccccuuccgucucugccgcuccaggccagaagguuacaaucucaugcagugggggaacuagcaacauugguaauaacuacguguccugguaucagcagcucccgggcacggcacccagacuucugauauacgagaccaauaaaaggccuucugggaucccagaccgguucuuuggaucgaagucaggcacaagcgccacuuuggcgauuagugguuuacaaaccggggaugaagcugacuauuacuguacaguauggggagugcgcaaaggcgucggcgccguguucgggaccggaacuaagguuacagugcug

SEQ ID NO: 25367 - RNA, 333 nt, Artificial Sequence
  derived and/or modified sequence opt3 from anti-HIV_119-050187_VR-Chain
cagagcgugcugacccaacccccuuccgucucugccgcuccaggccagaagguuacaaucucaugcagugggagcuccucuaacauugguaaaaauucggugucaugguaccagcaguucccgggaacugcacccaagcuccuuauauaugagaacaauaaaagaccuagcggcaucccagacagguuuagugauucccaaucugggacgagcgccacccuggcgauuacaggauugcagacuggcgacgaagcugauuacuccugugccaccugggcagccucauuaaacagugcucggguauucgguacagggacccgcgugacuguccug

SEQ ID NO: 25368 - RNA, 324 nt, Artificial Sequence
  derived and/or modified sequence opt3 from anti-HIV_119-049069_VR-Chain
cagagcgugcugacccaacccccuuccgucucugccgcuccaggccagaagguuacaaucucaugcagugggagcacuuccaacauuggaaaaucugacguguucugguaccagcagcucccggguacggcacccaaacuucugauaucggagaccucaagaaggccuagcggcacaccagaucgguuuaguggguccaagucuggaacuagcgccaccuugacaaucaccggcuuacaaacuggugacgaagcggauuauuacugugaggcuugggacggguccggaggcguauucggcacagggaccaaggugacgguccug

SEQ ID NO: 25369 - RNA, 333 nt, Artificial Sequence
  derived and/or modified sequence opt3 from anti-HIV_119-048517_VR-Chain
cagagcgugcugacccaacccccuuccgucucugccgcuccaggccagaagguuacaaucucaugcagugggagcaaauucaacauuggaaauaaggacguguccugguaccagcacucuccggguacugcacccaaacuccuuauauaugagaacaauaagagaccuucgggcaucccagauagguuuucagggagcaaaaguggaacguccgccacccugggcauuucugguuugcagacaggggacgaagcggauuacuguugcgcuguauggggagugcggcgcggcgccggcgcagucuucggggccggaacuaaggugaccguuuua

SEQ ID NO: 25370 - RNA, 333 nt, Artificial Sequence
  derived and/or modified sequence opt3 from anti-HIV_119-048470_VR-Chain
cagagcgugcugacccaacccccuuccgucucugccgcuccaggccagaagguuacaaucucaugcagugggagcacuuccaacauuggaaagaaucucgugucuugguaccagcaguucccggguacggcacccaaacuucugauauaugagaacaauagaaggccuucgggcaucccagaccgguuuucagggagcaaaaguggaaccuccgccacauugguaauuacuggcuuacaaaccggugaugaagcggacuucuacugugggacauggggaggcucucugcgcgcuggcggggugaucggaaccgguacucgagucacagugcua

SEQ ID NO: 25371 - RNA, 282 nt, Artificial Sequence
  derived and/or modified sequence opt3 from anti-HIV_119-048303_VR-Chain
agcgugcugacccagcccccuuccgucucugccgcuccaggccaaaacaucacaauuucaugcagugggagcauauccaauaucgcaucuaacuucauuucgugguaccagcagcucccgggaacugcccccaagaucauuaucuaugacaaugaucagagaccucuugguauaccagcgagguuuucaggcagcaaaaguggggcuuccgccacgcugguuaucaccggauugcaaacaggcgacgaggcagauuacuauugugguacuugggacgggucu

SEQ ID NO: 25372 - RNA, 333 nt, Artificial Sequence
  derived and/or modified sequence opt3 from anti-HIV_119-048021_VR-Chain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacgacaauaacaagagaccuucaggcaucccagauagguucagcgggaguaaauccggaacgucugccaccuugguaauuacaggcuuacaaacuggugacgaggcggauuuuuauugugggaccugggacggaagccuguccggcggcggggugaucggaacagguacccgggucacugugcua

SEQ ID NO: 25373 - RNA, 324 nt, Artificial Sequence
  derived and/or modified sequence opt3 from anti-HIV_119-047928_VR-Chain
cagagcgugcugacccaacccccuuccgucucugccgcuccaggccagaagguuacaaucucaugcagugggagcaacuccaauauuggaaacaauugugugucuugguaccagcagguaccggguacugcacccaaacuccuuauauaugagaacaauagaaggccuucgggcaucccagaccgguucucagggagcaagaguggaacguccgccacccuggcgauuucuggcuugcaaacaggugaugaagcugacuacuauugcgggacuugggauggaagcggcggcguguuugggaccgccacaaaagucaccguguua

SEQ ID NO: 25374 - RNA, 324 nt, Artificial Sequence
  derived and/or modified sequence opt3 from anti-HIV_119-047384_VR-Chain
cagagcgugcugacccaacccccuuccgucucugccgcuccaggccagaagguuacaaucucaugcagugggagcaacuccaauauuggaaacaaagacgugucuugguacagacagguaccgcccacugcaccuaagcuccuuauauaugagaauaacaaaaggccaucggguauccccgaucgguucucaggcagcaagagugggacguccgccacccuggcgauuacaggauugcagacuggcgacgaagcugauuacuauugugccaccugggacggucgcgugucugucuuugggacaggaaccaaaguggcaguuuua

SEQ ID NO: 25375 - RNA, 333 nt, Artificial Sequence
  derived and/or modified sequence opt3 from anti-HIV_119-047145_VR-Chain
cagagcgugcugacccaacccccuuccgucucugccgcuccaggccagacaguuaacaucucaugcagugggagcaauuccaacauuggaucuaaguacgugucgugguaucagcacuucccggguacugcacccaaacuccuuauauacgagaauaacaagagaucaagcggcaucccugacagguuuaguggguccaaaucugccacgagcgcgacccuggcuauuacaggauugcagacuggcgaugaagccgacuauuacugugcaaccugggccccauccuuaaauucagcucggguauucgguacagggaccaaggugacuguccug

SEQ ID NO: 25376 - RNA, 333 nt, Artificial Sequence
  derived and/or modified sequence opt3 from anti-HIV_119-046752_VR-Chain
cagagcgugcugacccaacccccuuccgucucugccgcuccaggccagaagguuacaaucucaugcagugggaacagcuccucuauuggaaauaacuucgugucgugguaccagcagcucccggguacugcacccaaacuucugguauaugagaauuacagaaggccuucaggcauaagcgaccgguuuaguggguccaagucuggaacgagcgccaccuuggcgaucacaggcuuacaaacuggugaugaagcugacuauuacuguaccguguggggaguccgcaaaggggugggcgccguuuucggcacagggaccaaggugacuguccug

SEQ ID NO: 25377 - RNA, 324 nt, Artificial Sequence
  derived and/or modified sequence opt3 from anti-HIV_119-046660_VR-Chain
cagagcgugcugacccaacccccuuccgucucugccgcuccaggccagaagguuacaaucucaugcagugggagcuccucuaacauuggaaaucacuacgugucgugguaucagcagcucccggguacugcacccaaacuucugauauacgacaacaauaagagaccuucaggcaucccagauagguucagcgccaguaaauccgggacgucugcgaccuugggaauuacaggcuuacaaacuggugacgaggcugauuauuacugugccaccugggacgggcggguaagcgugaucggaacaggcaccaaggucacugugguu

SEQ ID NO: 25378 - RNA, 333 nt, Artificial Sequence
  derived and/or modified sequence opt3 from anti-HIV_119-046202_VR-Chain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugguauacgagaauuauagaaggccuucaggcauaccagaccgguucagcgggaguaaguccggaacgucugccaccuuggcgaucacaggcuuacaaacuggugaugaagcugacuaccacugugccauuuggggagugcgcaaaggggucggcgcaguguuuggcaccgggacaaagguuaccgugguc

SEQ ID NO: 25379 - RNA, 333 nt, Artificial Sequence
  derived and/or modified sequence opt3 from anti-HIV_119-045790_VR-Chain
cagagcgugcugacccaacccccuuccgucucugccgcuccaggccagaagguuacaaucucaugcagugggagcuccucuaacauuggaaauaacuacgugucgugguaucaguaccucccggguacugcacccaaacuucuguucuaugaggacaauagaaggccuucaggcacgccagaucgguuuagcgggaguaaguccggaaccucugccacauuggcgauaagcggcuuacagacuggugacgaagcugauuacuauuguaccaucuggggaguacgcaaaggggugggcgccgucuucggcacagggaccaaggugacuguucug

SEQ ID NO: 25380 - RNA, 333 nt, Artificial Sequence
  derived and/or modified sequence opt3 from anti-HIV_119-044670_VR-Chain
cagagcgugcugacccaacccccuuccgucucuggcgccccaggggagagaguuacaaucucaugcacuggaaacacgaguaauauugguaccuacgacgugcagugguaucagcaccucccgggcacagcucccaggcuucugauauaccauaacguaaauuugccuagcggggugccagaucgguucuccgcaucuaagucgggaacuucagccaccuuagcgaucacaggccugcagaccggugacgaagcugauuauuacuguacuauuuggggaguccgcaaaggggugggcgccguuuuuggcacagggaccaaggugacgguccua

SEQ ID NO: 25381 - RNA, 321 nt, Artificial Sequence
  derived and/or modified sequence opt3 from anti-HIV_119-044140_VR-Chain
cagagcgugcugacccaacccccuuccgucucugccgcuccaggccagaagguuacaaucucaugcagugggggaacuagcaacauugguaaucacuucguguccugguacagacaucucccgggcacggcacccaaacuucugauauaugagaacaauaacaggccuucugggaucccagaccgguuuucgggagccaagucaggcaccagcgcgacauuggcuauuacugguuuacagaccggggaugaaggagacuacuauugugccacauggaguggcucccugaauaucggcaccgggacuaaaguaacagugcua

SEQ ID NO: 25382 - RNA, 333 nt, Artificial Sequence
  derived and/or modified sequence opt3 from anti-HIV_119-042776_VR-Chain
cagagcgugcugacccaacccccuuccgucucugccgcuccaggccagaagguuacaaucucaugcagugggagcuccucuaacauuggaaauaacuacgugucgugguaucagcaccucccggguacugcacccaaacuucugauauacgagucagccagaaggccuagcggcacgccagaccgguucaguggguccaagucuggaaccagcgcgacauuggcuaucacuggcuuacagaccggugaugaagccgacuauuacuguacacuguggggaguacgcaaaggggugggcgcagucuuuggcaccgggacucgagugacaguucua

SEQ ID NO: 25383 - RNA, 333 nt, Artificial Sequence
  derived and/or modified sequence opt3 from anti-HIV_119-042581_VR-Chain
cagagcgugcugacccaacccccuuccgucucugccgcuccaggccagaagguuacaaucucaugcagugggagcuccucuaacauuggaaauaacuucgugucgugguaccagcagcucccggguacugcacccaaacuucugauauuugagacgcacagaaggccuucaggcaucccagaccgguucagcgggaguaaguccggaaccucugccacauuggcgauuacuggcuuacaaagcggugaugaagcugacuauuacugugccguauggggagugcgccagggggcaggcgccgucuuuggcaccgggacaaaagugaccguucug

SEQ ID NO: 25384 - RNA, 333 nt, Artificial Sequence
  derived and/or modified sequence opt3 from anti-HIV_119-040905_VR-Chain
cagagcgugcugacccaacccccuuccgucucugccgcuccaggccagaagguuacaaucucaugcagugggaacagcuccaauauuggagacaacuucgugucuugguaccagcagcucccggguauagcacccaaacuucugguauaugagacuaauaagagaccuucgggcaucccagauagguuugccgggucaaaaagcggaacgagugcgaccuuggugauuacaggcuuacaaacuggugacgaagcugauuucuacugugggaccugggacggaucccugcggacaggcggcgucaucgggaccggaacucgcgugacaguucua

SEQ ID NO: 25385 - RNA, 321 nt, Artificial Sequence
  derived and/or modified sequence opt3 from anti-HIV_119-040322_VR-Chain
cagagcgugcugacccaacccccuuccgucucugccgcuccaggccagaagguugugaucucaugcagugggagcuccucuauuauagagaaaaacucgaucucaugguaccagcagggaccgggugcagcccccaagcuccuuauuuaugaaaaugacaaaagaccuagcggcaucccagauagguucaguggguccaagucuggaacaacuggcacgcuggcgauuaccgguuugcaaacaggggacgaggcugauuacuuuugugccacuuggagcggacgguuaaacaucggcaccggcacaaaaguaaccgugcug

SEQ ID NO: 25386 - RNA, 324 nt, Artificial Sequence
  derived and/or modified sequence opt3 from anti-HIV_119-039892_VR-Chain
cagagcgugcugacccaacccccuuccgucucugccgcuccaggccagaagguuacaaucucaugcagugggagcaacgcaaauauuggaaacaaagacguguccugguaccagcagcucccggccacugcgcccaaacuucugauauaugagucuaauaagagaccuucggguaucccagauagguucucaggcagcaagagugggacguccgcuaccuuggccauuacaggauuacaaacuggcgacgaagcagauuacuauugugccaccugggacggucggguaucugggaucggaacaggcaccaaagugacuguccug

SEQ ID NO: 25387 - RNA, 324 nt, Artificial Sequence
  derived and/or modified sequence opt3 from anti-HIV_119-039764_VR-Chain
cagagcgugcugacccaacccccuuccgucucugccgcuccaggccagaagguuacaaucucaugcagugggagcgcauccaacauugguaaaaauuucgugucuugguaccagcagguaccgggaacugcccccaagcuccuuauauaugagaacaauagaaggccuucgggcacgccagaccgguuuucagggagcaaaaguggaaccuccggcacacuggcgaucucugguuugcaaacuggggaugaagcugacuacuauugugagaccugggauggaagcggcggcguguucgggacaggaaccaaggucacuguguua

SEQ ID NO: 25388 - RNA, 333 nt, Artificial Sequence
  derived and/or modified sequence opt3 from anti-HIV_119-039188_VR-Chain
cagagcgugcugacccaacccccuucccucucuggcgccccagggcagacagucacuaucucaugcaguggaagcuccucuaacauugguaauaacuacguuucgugguaucagcagcuuccgggcacggcucccaagcuguugauauacgacucaaauagaaggccuagcgggaucccagaucgguucaguggauccaaaucuggcaccagcgcaacauuagccauuuccggucugcaaacuggggacgaggcggauuauuguugcgcuguguggggaguacgccgaggcgccggcgcaguguuuggggccggaaccaaggucacagugcua

SEQ ID NO: 25389 - RNA, 321 nt, Artificial Sequence
  derived and/or modified sequence opt3 from anti-HIV_119-039058_VR-Chain
cagagcgugcugacccaacccccuuccgucucuggcgccccagggcagagaguuacaaucucaugcacuggaaguagcuccaacauugguaauaacuacgugucuugguauaggcggcucccgggcacggcucccaaacuucugauauacgagaauaacaagcgcccuucggggaucccagaccgauucucaggagcaaagagcggcaccagugccacauuggcgauuacugguuuacagaccggggaugaagcugacuauuuuuguuccacauggucuggaagccugaauuucggcaccggcacucguguaacagugcua

SEQ ID NO: 25390 - RNA, 321 nt, Artificial Sequence
  derived and/or modified sequence opt3 from anti-HIV_119-038837_VR-Chain
cagagcgugcugacccaacccccuuccgucucugccgcuccaggccagaagguuacaaucucaugcagugggggaacuagcaacauugguaauaacuucguguccugguaccagcaccucccgggcacggcacccaaacuucugauauuugagaauaacaagagaccuucugggguaccagacagguucucgggagccaaaucaggcaccagcgcgacauuggcuaucacugguuuacagaccggggaugaaggagacuauuacugugccacauggaguggcucccugaauauuggcaccgggacuaaggugacaguccua

SEQ ID NO: 25391 - RNA, 321 nt, Artificial Sequence
  derived and/or modified sequence opt3 from anti-HIV_119-038396_VR-Chain
cagagcgugcugacccaacccccuuccgucucugccacaccaggccagaagguuacuaucucaugcagugggagcaacuccaauauuggaaacaaauacgugucuugguaucagcuuuucccggguacggcucccaagcuccugauaucggagaauaacagaaggccuucaggcaccccagaccgguuuagcgggaguaaauccggaacaucugcaacuuuggccaucaccggcuuacagacaggugaugaagcggacuacuauugugcuaccuggagcgggucccugaauauuggaacuggcacaaagguaaccgugcua

SEQ ID NO: 25392 - RNA, 321 nt, Artificial Sequence
  derived and/or modified sequence opt3 from anti-HIV_119-036918_VR-Chain
cagagcgugcugacccaacccccuuccgucucugccgcuccaggccagaagguuacaaucucaugcaguggggcaacuagcaacauuugggaccacuacguguccugguaucuccagguaccgggaacggcccccagacuucugauauacgauaaugacaaaaggccuucugguaucccagaucgguucucgggcucaaagagcgggaccagugcgacauuggcuauuacuggauuacagaccggcgacgagggugauuauuacugugccacaugguccgggucucugaacaucggaaccggcacuaaagugacaguccua

SEQ ID NO: 25393 - RNA, 324 nt, Artificial Sequence
  derived and/or modified sequence opt3 from anti-HIV_119-036592_VR-Chain
cagagcgugcugacccaacccccuuccgucucugccgcuccaggccagaagguuacaaucucaugcagugggagcaacuccaauacuggaaacaaagacgugucuugguaccagcagguaccggcaacggcccccaagcuccuuauuuaugagucgaauaaaagaccuucagguauaccagauagguucagcggcaguaaguccgggaccucugcgacacuggcuaucacuggauugcaaaccggcgacgaagccgauuacuauugugcaauuugggacggucgggugagcgucaucgggacaggaaccaaagugacuguuuua

SEQ ID NO: 25394 - RNA, 324 nt, Artificial Sequence
  derived and/or modified sequence opt3 from anti-HIV_119-036310_VR-Chain
cagagcgugcugacccaacccccuuccgucucugccgcuccaggccagaagguuacaaucucaugcagugggagcacuuccaacauuggacagaauuacgugucuugguaucagcaacucccggguacggcacccaaacuucugauauacgagaacaauagaaggccuucgggcucaccagaccgguucagcgggaguaaguccggaaccucugccacauuggcgaucacuggcuuacagaccggugaugaagcugacuauuacugugagacaugggaugggagcggaggcguauuuggcaccgggacuaaagugacaguccug

SEQ ID NO: 25395 - RNA, 333 nt, Artificial Sequence
  derived and/or modified sequence opt3 from anti-HIV_119-035618_VR-Chain
cagagcgugcugacccaacccccuuccgucucugccgcuccaggccagaagguuacaaucucaugcagugggagcuccuucacuauuggaaacaaucacgugucuugguaccagcagcucccggguacggcacccaaacuucugauauuugagucgcauaagagaccuucaggcguaccagacagguucagcgggaguaaauccggaaccucugccacauuggcgaucacuggcuuacaaaccggugaugaagcugacuauuacuguacaguguggggaguccggaagggggugggcgccguuuuuggcaccgggacuaaagugacaguccug

SEQ ID NO: 25396 - RNA, 321 nt, Artificial Sequence
  derived and/or modified sequence opt3 from anti-HIV_119-035569_VR-Chain
cagagcgugcugacccaacccccuuccgucucuggcgccccagggcagacaguuacuaucucaugcacgggaaguagcuccaacauugguggcuacgacgugcacugguaucagcagcucccggggaccgcucccaaacuucugauauacgagaauaacagaaggccuucuggaacaccagaucgguucucgggcgcaaagucagguacuagcgccaccuuggcgaucacaggguuacaaaccggagacgaaggcgauuauuacugugcuacuuggaguggcucccugaauauugggacaggaaccaagguaacggugcua

SEQ ID NO: 25397 - RNA, 324 nt, Artificial Sequence
  derived and/or modified sequence opt3 from anti-HIV_119-035466_VR-Chain
cagagcgugcugacccaacccccuuccgucucugccgcugcaggccagaacguuaauaucucaugcagugggaagaaaagcaacauuggaaauaacuacguguccugguaucagcaguucccagguacagccccgaagcuccuuauauacggcaauacuaacagacccucugggaucccugacagguuuucgggaucaaaaagcggcacgagugcgacccuggcuauuacagguuugcaaacuggggaugacgccgauuauuacugugagaccugggacggauccggcggcguauucgggacaggaaccaaggugacugucuua

SEQ ID NO: 25398 - RNA, 333 nt, Artificial Sequence
  derived and/or modified sequence opt3 from anti-HIV_119-035157_VR-Chain
cagagcgugcugacccaacccccuuccgucucugccgcuccaggccagaagguuacaaucucaugcagugggagcuccucuaacauuggaaauaacuucgugucgugguaccagcagagaccggguacugcacccaaacuccuuauauaugagacgaauaagaggccuucaggcaucccagaccgguuuagcgggaguaaauccggaaccucugccacacuggcgauuacuggcuugcaaaccggugaugaagcugacuacuauugugccacaugggcaccccgcuuaaacagcgcccgaguauucgggaauggaaccauggugacuguccug

SEQ ID NO: 25399 - RNA, 333 nt, Artificial Sequence
  derived and/or modified sequence opt3 from anti-HIV_119-035121_VR-Chain
cagagcgugcugacccaacccccuuccgucucugccgcuccaggccagaagguuacaaucucaugcagugggagcacuuccuacauuggaaacaaauaugugucuugguaccagcaguucccgggugcagcccccaagcuccuuauauaugagaauaacaaaagaccuucgggcaucccagacagguuuucagcgagcaagagugcuacguccgccacccuggcaauuacaggguugcaaacuggagaugaagccgacuacuguugcgcuguauggggcgugcggcgcggugcaggggccgucuucggagcuggcaccaaagugacaguuuua

SEQ ID NO: 25400 - RNA, 324 nt, Artificial Sequence
  derived and/or modified sequence opt3 from anti-HIV_119-035046_VR-Chain
cagagcgcccugacccaacccgcuuccgugucuggcucaccugggcagaguaucacaauuagcugcacuggaacguccucugacgucgguuacgauuauguuucgugguacagacaggugccagcaaccacaccgaagcuccuuauauaugagaacaauaaaaggcccucaggcaucccugaccgguucagcgggaguaaguccggaacuucugccacccuggcgauuacaggcuugcagaccggugaugaagcugacuacuauugugccacuugggaugggcgcguaagcgugaucggaacaggcaccaaagucacggugguu

SEQ ID NO: 25401 - RNA, 324 nt, Artificial Sequence
  derived and/or modified sequence opt3 from anti-HIV_119-034754_VR-Chain
cagagcgugcugacccaacccccuuccgucucugccgcuccaggcgagaagguuacaaucucaugcagugggagcuccucuaacauuggaaauaacuacgugucgugguaucagcagcucccggguacuguacccaaacuucugauauacgacaauaacaagagaccuucaggcacgccagauagguucagcgggaguaaauccggaaccucugcaacauuggccaucacuggcuuacagaccggugacgaagcggauuauuacugugagacaugggacgggagcggaggcguguuuggcaccgggacuaaggucacagugcug

SEQ ID NO: 25402 - RNA, 324 nt, Artificial Sequence
  derived and/or modified sequence opt3 from anti-HIV_119-034318_VR-Chain
cagagcgugcugacccaacccccuuccgucucugccgcuccaggccagaagaucacaauuucaugcagugggagcuccucuaacauaggaaauaacgacguuucgugguaccagcagcucccggguacugcacccaaacuucugaucuaugagaaugauagaaggccuucaggcacgccagaccgguucagcgggaguaaguccggaaccucugccacauuggcgauuacuggcuuacaaaccggugaugaagcugacuacuauugugagacaugggaugggagcggaggcguguuuggcaccgggacuaaaguaacagugcug

SEQ ID NO: 25403 - RNA, 333 nt, Artificial Sequence
  derived and/or modified sequence opt3 from anti-HIV_119-033780_VR-Chain
cagagcgugcugacccaacccccuuccgucucugccgcuccaggccagagaguuacaaucucaugcagugggacuagcuccaacauuggagagaauuacgugucuugguaucagcagauaccggguacggcacccaagcuccuuaucuacgaaaacaauaaaaggccuucgggcauuccagaccgguucucagggagcaagaguggaaccuccgccacacugguaaucacuggcuugcaaaccggugaugaggcggacuuuuauugugggacauggggaggcucuuuacgcaccggcggggugcugggaacugguacacgagucaccgugcua

SEQ ID NO: 25404 - RNA, 333 nt, Artificial Sequence
  derived and/or modified sequence opt3 from anti-HIV_119-033632_VR-Chain
cagagcgugcugacccaacccccuuccgucucugccgcuccaggccagagaguuacaaucucaugcagugggggaagcuccaacauugguucuaauuacgugucgugguaucagcagcucccgggcacugcacccaaacuucugauauaccaaaacaauaagaggccuucagggaucccagaccgguucagcggaaguaaguccggcacgucugccaccuuggguauuacaggguuacagacuggagaugaggcggacuauuacuguaccguauggggcgugcgcaaaggcgucggggcuguguuuggaacagguaccaagguuacugugcug

SEQ ID NO: 25405 - RNA, 333 nt, Artificial Sequence
  derived and/or modified sequence opt3 from anti-HIV_119-033183_VR-Chain
cagagcgugcugacccaacccccuuccgucucugccgcuccaggccagaugguuacaaucucaugcagugggggagcaagcaaccucgguaaaaauuccgugucuugguaccagcagcuuccgggcacugcccccaagcuguugauuuaugaggacaacagaaggccuucggggacgccagaucgguucucaggaagccgcaguggcaccuccgcgacauuagcuauaacuggucugcaaaccggggacgaagccgauuacuauuguacaaucuggggaguacgaaagggcgugggcgcagucuuugggaccggaacuaaagugacaguucua

SEQ ID NO: 25406 - RNA, 333 nt, Artificial Sequence
  derived and/or modified sequence opt3 from anti-HIV_119-030696_VR-Chain
cagagcgugcugacccaacccccuuccgucucuggcgccccagggcagaucguuacacucucaugcacuggagcuaugacgaacauugguaauaacgacgugcacugguaccagcaucuuccgggcaccgggcccaagcuguugauauaugagaauaacaaaagaccuaguggaaucccagauagguucagcggcuccaagucugguacaucggcaacuuuaguaauuaccgggcugcagacaggagacgaagccgauuuuuacuguggcaccugggacggcucacuacggacugggggagugaucgguacaggcacccgcgucacggugcuc

SEQ ID NO: 25407 - RNA, 324 nt, Artificial Sequence
  derived and/or modified sequence opt3 from anti-HIV_119-030059_VR-Chain
cagagcgugcugacccaacccccuuccgucucugccgcuccaggccagaagguugugaucucaugcagugggagcuccucuauuauagagaaaaacucgaucucaugguaccagcagggaccgggugcagcccccaagcuccuuauuuaugaaaaugacaaaagaccuagcggcaucagugauagguucuccgggucuaagagcgcgacauccgcuacucuggccauuacgggauugcacaccggcgacgaggcagauuacuauugugaaacaugggacgguucagggggaguauuuggcacuggcaccaaagugacagucuua

SEQ ID NO: 25408 - RNA, 333 nt, Artificial Sequence
  derived and/or modified sequence opt3 from anti-HIV_119-029589_VR-Chain
cagagcgugcugacccaacccccuuccgucucugccgcuccaggccagaagguuacaaucucaugcagugggacuagcuccaacauuggaaauaacuucgugucuugguaccagcuccuuccggguacggcacccagacuguugauauaugacaauaacaaaaggccuucgggcaccccagaucgguuuucagggagcaagaguggaacauccgccacuuuaggcaucaccggucugcagacaggggacgaggcggauuucuacuguggaaccugggacggcucucuacgcacuggcgggguaauuggaacagguacccgagugacgguccuc

SEQ ID NO: 25409 - RNA, 324 nt, Artificial Sequence
  derived and/or modified sequence opt3 from anti-HIV_119-029448_VR-Chain
cagagcgugcugacccaacccccuuccgucucugccgcuccaggccagaagguuacaaucucaugcagugggaacagcuccaauauuggaaagaacucugugucgugguaccaccagcucccggguacugcacccaaacuucugauauaugagaaugacagaaggccuucaggcacgccagaucgguucagcgggaguaaauccggaaccucugccacauuggcgaucacuggcuuacagaccggugacgaagcugauuacuauugugagacaugggacgggagcggaggcguauuuggcaccgggacuaaggugacaguccug

SEQ ID NO: 25410 - RNA, 333 nt, Artificial Sequence
  derived and/or modified sequence opt3 from anti-HIV_119-029220_VR-Chain
cagagcgugcugacccaacccccuuccgucucugccgcuccaggccagaagguuacaaucucaugcagugggagcacuuccaacauuggacagaauuacgugucuugguaucagcaacucccggguacggcacccaaacuucugauauacgagaacgacagaaggccuucgggcaucccagaucgguucucagggagcaagaguggaaccuccgccacauuggcgauuucuggcuuacagacuggugacgaagcugauuauuguugcgccguauggggagugcgccgaggggcaggcgccgucuuuggccccgggaccaaagugacaguucug

SEQ ID NO: 25411 - RNA, 333 nt, Artificial Sequence
  derived and/or modified sequence opt3 from anti-HIV_119-028317_VR-Chain
cagagcgugcugacccaacccccuuccgucucugccgcuccaggccagaagguuacaaucucaugcagugggagcuccucuaacauuggaaaugacuacgugucgugguaucagcagcucccggguacugcacccaaacuucugauauacgagaacaauaagagaccuucaggcaucccagauagguucagcgggaguaaauccggaacgucugccaccuuggcgauuacaggcuuacaaacuggugacgaagcugauuauuacuguaccaucuggggaguacggaagggggugggcgccgucuuuggcacagggaccaaagugacuguucug

SEQ ID NO: 25412 - RNA, 324 nt, Artificial Sequence
  derived and/or modified sequence opt3 from anti-HIV_119-028165_VR-Chain
cagagcgugcugacccaacccccuuccgucucugccgcuccaggccagacaguuacuaucucaugcagugggauuacgagcaacauaggaaagaaugacguguccugguaccagcagcucccggguaccgcacccaaacuucugaucucugagaacaauagaaggccuucgggcauuccagaucgguucucagggagcaagaguggaacauccgccacuuuggcgaucaccggcuuacaaacaggugacgaagcugauuauuacugugccauuugggacgggcgcguaucugugaucggaaccggcacuaaagucacagugcug

SEQ ID NO: 25413 - RNA, 324 nt, Artificial Sequence
  derived and/or modified sequence opt3 from anti-HIV_119-027147_VR-Chain
cagagcgugcugacccaacccccuuccgucucugccgcuccaggccagacaguuacuaucucaugcagugggagcacguccgacauuggaaagaacgaugugucuugguaccagcagcucccggguauagcacccaaacuucugaucucggagaauaacagaaggccuucaggcaccccagaccgguucagcgggaguaaguccggaacaucugccacuuuggcgauuaccggcuuacaaacaggugaugaagcugacuauuacugugagaccugggaugggagcggagccguauuuggcacuggcacaaaagugaccguccug

SEQ ID NO: 25414 - RNA, 333 nt, Artificial Sequence
  derived and/or modified sequence opt3 from anti-HIV_119-026743_VR-Chain
cagagcgugcugacccaacccccuuccgucucugccgcuccaggccagaacguuacaaucucaugcagugggagcuccucuaauauuggaaacaauuucgugucgugguaccagcagagaccggguacuggccccaagcuccuuauauaugagacgaacaggcggccuucagggaucccagaccgcuuuagcggaaguaaauccggcaccucugcaacacuggccauuacugguuugcaaaccggggaugaagcggacuacuauugugcuacaugggcccccagcuuaaauuccgcacgaguauucggaaccggcacuaaggugacaguccug

SEQ ID NO: 25415 - RNA, 333 nt, Artificial Sequence
  derived and/or modified sequence opt3 from anti-HIV_119-026508_VR-Chain
cagagcgugcugacccaacccccuuccgucucugccgcuccaggccagaagguuacaaucucaugcagugggagcuccucuacuauuggaaacaauuacauaucgugguaucaggugcucccggguacggcacccaaacuuguaaucuucaagaacaaugagagaccuucaagggugccagaccgguuuagcggcaguaaauccgggaccucugccacacugggaauuacuggcuugcaguuaggugaugaaggggacuacuauuguggaaccugggagacaagccuguccggcggcggggucuucggaaccgguacuaaggugacaguucua

SEQ ID NO: 25416 - RNA, 324 nt, Artificial Sequence
  derived and/or modified sequence opt3 from anti-HIV_119-025683_VR-Chain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacgagaauaacaagagaccuucaggcaucccagacagguucagcgauagucaauccgggacgucugccaccuuggcgauuacaggauuacagacuggcgacgaagcugauuauuacugugagaccugggacgguagcgggggaguauuuggcacaggcaccaaagugacuguccug

SEQ ID NO: 25417 - RNA, 333 nt, Artificial Sequence
  derived and/or modified sequence opt3 from anti-HIV_119-025614_VR-Chain
cagagccugcucacccaacccccuuccgugucugccgcuccaggccagaacgucaucauuucaugcagugggagcuccucuaauauaggaaagaacuacguugcaugguaucaacaggugccggguacagcccccaaaaucguaguguucgagacuacgaauagaccuucgggcauuccagacagguuuucagggagcaagaguggaaccuccgcgacacuugcuaucacuggccugcagaccggugaugaagccgacuacuauuguacagucuggggagugcggaaagggguuggcgcaguguucggcaccgggacuaaggucacaguguug

SEQ ID NO: 25418 - RNA, 324 nt, Artificial Sequence
  derived and/or modified sequence opt3 from anti-HIV_119-025548_VR-Chain
cagagcauccugacccaacccccuuccgugucugccgcuccaggccagaaggucacaauuucaugcagugggagcuccucuaacauaggaaauaacuacguuucgugguaucagcacgugccggguacugcacccaaacuccuuaucuacgagaauaacagaaggccuucaggcacgccagaccgguucagcgggaguaaguccggaaccucugccacacuggcgauuacuggcuugcagagcggugaugaagcugacuauuacugugggaccugggauggauccggcggcguauuugggacaggaaccaaagugacugucuua

SEQ ID NO: 25419 - RNA, 333 nt, Artificial Sequence
  derived and/or modified sequence opt3 from anti-HIV_119-025526_VR-Chain
cagagcgugcugacccaacccccuuccgucucugccgcuccaggccagaagguuacaaucucaugcagugggagcgcauccaacauugggaaaaauuucgugucuugguaccagcagcucccggguacugcccccaaacuucugauauaugagaacaauagaaggccuucgggcacgccagaccgguuuucagggagcaagaguggaaccuccgcgacauuggcuaucacuggcuuacaaaccggugaugaagccgacuacuauuguacaguauggggagugcgcaagggagucggcgcaguguucggcaccgggacuaaaguuacagugcug

SEQ ID NO: 25420 - RNA, 324 nt, Artificial Sequence
  derived and/or modified sequence opt3 from anti-HIV_119-023552_VR-Chain
cagagcgugcugacccaacccccuuccgucucugccgcuccaggccagacaguuacuaucucaugcagugggagcacguccaacauuggaaagaaugacgugucuugguaccagcagcucccggguaccgcacccaaacuucugauaucggagaacaauagaaggccuucaggcacaccagaucgguucagcgccaguaaguccgggacuucugcgaccuuggcuaucacaggauuacaaaccggcgacgaagccgauuauuacugugagacuuggcacgguagcgggggaguauuuggcacaggcaccaaagugacgguccug

SEQ ID NO: 25421 - RNA, 321 nt, Artificial Sequence
  derived and/or modified sequence opt3 from anti-HIV_119-023092_VR-Chain
cagagcgugcugacccaacccccuuccgucucugccgcuccaggccagaagguuacaaucucaugcagugggagcacuuccgaccucggacagacgagagugucuugguaccagcaacuuccgaggucggcacccgagcuguugauuuucgaaaacaaucggcgcccuucagguauaccagaucgauuuagcggcgccaaaagugggaccuccgcgacauuagcuaucacuggacugcagaccggcgacgaggccgauuauuucuguucuacauggagcgguucccuaaacuuugggaccggaacucguguaacagugcuc

SEQ ID NO: 25422 - RNA, 324 nt, Artificial Sequence
  derived and/or modified sequence opt3 from anti-HIV_119-022793_VR-Chain
cagagcgugcugacccaacccccuuccgucucugccgcuccaggccagaagguuacaaucucaugcagugggggaacuagcaacauugguaauaacuacguguccugguauagaaggcucccgggcacggcacccaaacuucugauauacgagaauaacaagcggccuucugggaucccagaccgcuucucgggagccaaaucaggcaccagcgcgacauuggguauuacuggguuacagaccggagaugaagcugacuauuacugugagacaugggaugacaguggcggcguauuugggaccggaacuaaggugacaguccug

SEQ ID NO: 25423 - RNA, 324 nt, Artificial Sequence
  derived and/or modified sequence opt3 from anti-HIV_119-022395_VR-Chain
cagagcgugcugacccaacccccuuccgucucugccgcuccaggccagacaguuacuaucucaugcagugggagcacguccaacauuggaaagaaugacgugucuugguaccagcagcucccggguaccgcacccaaacuucugauaucggauaacaauagaaggccuucauggacaccagaccgguucagcggcaguaaguccgggacuucugccaccuuggcgaucacaggauuacaaaccggcgaugaggcugacuauuacugugaaacuugggaugguagcgggggaguauuuggccccggcacacgcgugaccguccug

SEQ ID NO: 25424 - RNA, 333 nt, Artificial Sequence
  derived and/or modified sequence opt3 from anti-HIV_119-022334_VR-Chain
cagagcgugcugacccaacccccuuccgucucugccgcuccaggccagaacguuaauaucucaugcagugggggaagcuccaacauugguucuaauuacgugucgugguaucagcaguucccgggcacagcacccaagcaccucauauacgagaacaauaaaagaccuucagggaucccagacagguuuagcgauagucaauccggaacuucugccacgcuuggcauuaccggucugcagacaggggacgaagcggauuauuacuguggaacuugggacggcagcuugcggaccggcgggguaaucggaacagguacccgcgugacugucuua

SEQ ID NO: 25425 - RNA, 321 nt, Artificial Sequence
  derived and/or modified sequence opt3 from anti-HIV_119-021866_VR-Chain
cagagcgugcugacccaacccccuuccgucucugccgcuccaggccagagaguuacaaucucaugcagugggagcgcauccaacauuggaaagaauuucgugucuugguaccagcagcucccggguaaagcccccaaacuuauaaucuaugagguaacuaagaggccuucgggcgugccagcgcgguuuucagggagcaagaguggaacguccgcuacccuggccauuacaggcuugcaaacuggugacgaagcagauuacuucuguucuaccuggagcggguccuuaaacuuuggaacaggcacccgcgucacugugcug

SEQ ID NO: 25426 - RNA, 324 nt, Artificial Sequence
  derived and/or modified sequence opt3 from anti-HIV_119-021278_VR-Chain
cagagcgugcugacccaacccccuuccgucucugccgcuccaggccagaagguuacaaucucaugcagugggagcgcauccaacauuggaaagaauuucgugucuugguaccagcagcucccggguacugcccccaaacuucugauauaugagaacaauagaaggccuucgggcacgccagaccgguuuucagggagccgcaguggaaccuccgcgacauugggcaucacugguuuacaaaccggggaugaagcucacuacuauugugagacaugggacgauucuggaggcguauucggcaccgggacuaaagugacaguccug

SEQ ID NO: 25427 - RNA, 333 nt, Artificial Sequence
  derived and/or modified sequence opt3 from anti-HIV_119-021183_VR-Chain
cagagcgugcugacccaacccccuuccgucucugccgcuccaggccagaagguuacaaucucaugcagugggaacagcuccaauauuggaaacaauuucgugucuugguaccagcaguuuccggguacugcacccaaacuccuuguauucgagacgcacagaaggccuucgggcauaccagaccgguuuucagggagcaagaguggaaccuccgccacacuggcgaucacuggcuugcaaaccggugaugaagcugacuauuacugugccguguggggaguccgccgaggggugggcgcaguuuucggcgccgggacaaaagugaccgucuua

SEQ ID NO: 25428 - RNA, 333 nt, Artificial Sequence
  derived and/or modified sequence opt3 from anti-HIV_119-019376_VR-Chain
cagagcgugcugacccaacccccuuccgucucugccgcuccaggccagaagguuacaaucucaugcagugggagcuccucuaacauuggaaauaacuacgugucgugguaucagcagguaccggguacugcacccaaacuccuuguguacgagacguauagaaggccuucaggcauaccagaccgguucagcgggaguaaguccggaaccucugccacacuggcgaucacuggcuugcaaaccggugaugaagcugacuacuauuguacaauuuggggaguccgcaaaggggugggcgccguuuuuggcaccgggacuaaggugacagucuua

SEQ ID NO: 25429 - RNA, 321 nt, Artificial Sequence
  derived and/or modified sequence opt3 from anti-HIV_119-019238_VR-Chain
cagagcgugcugacccaacccccuuccgucucugccgcuccaggccagaagguuacaaucucaugcagugggacuagcuccaacauuggaaauaaccacgugucuugguaccagcagguaccggguacggcacccaaacuccuuauauaugagaauaacaagagaccuucgggcaucccagccagguucucagcggcuaaaagcgggaccagugccacacuggcaauuacuggauugcaaaccggcgacgaagccgauuacuuuugugcuacaugguccggucgguuaaauaucgggaccggaacuaaggugacaguccug

SEQ ID NO: 25430 - RNA, 333 nt, Artificial Sequence
  derived and/or modified sequence opt3 from anti-HIV_119-018500_VR-Chain
cagagcgugcugacccaacccccuuccgucucugccgcuccaggccagaagguuaacaucucaugcagugggagcuccucuaauauuggaaacaauuucgugucgugguaccagcagagaccggguacagcacccaaacuccuuauauaugagacuaacaggcggccuucaggcaucccagaccgcuuuagcgggaguaaguccggaacgucugccacccuggcgauuacaggcuugcaaacuggugaugaagcugacuacuauugugccaccugggcagccagcuuaacauccgcucgaguauucgggaucggaaccaaagugacuguccug

SEQ ID NO: 25431 - RNA, 324 nt, Artificial Sequence
  derived and/or modified sequence opt3 from anti-HIV_119-018318_VR-Chain
cagagcgugcugacccaacccccuuccgucucugccgcuccaggccagacaguuaucauuucaugcagugggagcacuuccaacauaggaaagaaugacgugucuugguaccagcagcucccggguacggcacccaaacuucugaucucggagaacaauagaaggccuucaggcaccccagaucgguucagcgggaguaaguccggaacaucugccacuuuggcgauuaccggcuuacaaacaggugacgaugcugacuauuacugugaaaccugggaugggagcggaggcguauuuggcacugggacaaaagugacccugguc

SEQ ID NO: 25432 - RNA, 333 nt, Artificial Sequence
  derived and/or modified sequence opt3 from anti-HIV_119-018218_VR-Chain
cagagcgugcugacccaacccccuuccgucucugccgcuccaggccagaagguuacaaucucaugcagugggaacagcuccaauauuggaaacaauuucgugucuugguaccagcagcucccggguacugcacccaaacuucugauauaugagaacaauagaaggccuucgggcaucccagaccgguuuucagggagcaagaguggaacguccgccaccuuggcgauuucuggcuuacaaacaggugaugaagcugacuacuggugugccguauggggagugcgccgaggggcaggcgccgucuucggcgcugggacuaaagugaccguucug

SEQ ID NO: 25433 - RNA, 324 nt, Artificial Sequence
  derived and/or modified sequence opt3 from anti-HIV_119-017876_VR-Chain
cagagcgugcugacccaacccccuuccgucucugccgcuccaggccagaagguuacaaucucaugcagugggagcacuuccaaaauuggacagaacucugugucgugguaccagcaacucccggguacggcacccaaacuucugauauaugagaaugacagaaggccuucaggcaccccagaucgguucagcgccaguaaguccgggacaucugcgacuuuggcuaucaccggauuacagacaggcgacgaagccgauuacuauugugagaccugggacgauagcggugggguauuuggaacuggcacaaaggugaccguccug

SEQ ID NO: 25434 - RNA, 324 nt, Artificial Sequence
  derived and/or modified sequence opt3 from anti-HIV_119-017740_VR-Chain
cagagcgugcugacccaacccccuuccgucucugccgcuccaggccagaagguuacaaucucaugcagugggagcaacuccaauauuggaaacaaagacgugucuugguacagacagguaccggcaacugcccccaagcucccuauauaugagaauaaaaacgaaccaucgggugugcccgauagguucucaggcagcaagagugggacguccgcgacccuugcuaucacaggacugcagacuggcgacgaggccgauuacuauugugcaaccugggacggucgggucucugugauugggacaggaaccaaaguuacugugguc

SEQ ID NO: 25435 - RNA, 321 nt, Artificial Sequence
  derived and/or modified sequence opt3 from anti-HIV_119-017128_VR-Chain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacgagaauaacaagagaccuucaggcaucccagacagguucagcggggccaaaaguggaacguccgcgaccuuggcuauuacaggcuuacaaacuggugaugaagccgacuauuuuuguucuaccuggagcgggucccugaauuucggaacaggcacccggguaacugugcua

SEQ ID NO: 25436 - RNA, 324 nt, Artificial Sequence
  derived and/or modified sequence opt3 from anti-HIV_119-017044_VR-Chain
cagagcgugcugacccaacccccuuccgucucugccgcuccaggccagaagguuacaaucucaugcagugggagcaacuccaauauuggaaacaauuacgugucuugguaucaccaucucccggguacugcacccagacuucugauauacgacaacaauaaaaggccuucgggcaucccagaucgguucucagggagcaagaguggaacguccgccaccuuggcgauuacaggcuuacagacuggugacgaggcugauuauuacugugccaccugggacgggcgcguaucugugaucggaacaggcacccaggucacugugcug

SEQ ID NO: 25437 - RNA, 321 nt, Artificial Sequence
  derived and/or modified sequence opt3 from anti-HIV_119-016644_VR-Chain
cagagcgugcugacccaacccccuuccgucucugccgcuccaggccagaagguuacaaucucaugcagugggggaacuagcaacauugguaauaacuacguguccugguaucagcagcucccgggcacggcacccaaacuucugauauacgagaauaacaagagaccuucugggaucccagccagguucucggcggcuaaaucaggaaccagcgccacauuggcaauuacuggcuuacaaaccgaagacgaggccgauuauuacugugcuacauggagugguucccugaauaucgggaccggaacuaagguaacagugcua

SEQ ID NO: 25438 - RNA, 333 nt, Artificial Sequence
  derived and/or modified sequence opt3 from anti-HIV_119-015878_VR-Chain
cagagcgcccugacccaacccccuuccgcuucuggcucaccagggcagagugugacaaucagcugcuccggaucuucgucaaacauugguaauaacuucgucagcugguaccagcagagaccgggcacugcacccaagcuccuuauauaugagacgaauaaaaggccuagugggaucccagaccgguuuuccggaucuaagagcggcaccuccgccacacuggcgauuacugguuugcaaaccggggaugaagcugacuacuauugugccacaugggcaccccgcuuaaacucagcccgaguuuucggaaauggcaccauggugacuguacug

SEQ ID NO: 25439 - RNA, 321 nt, Artificial Sequence
  derived and/or modified sequence opt3 from anti-HIV_119-015538_VR-Chain
cagagcgugcugacccaacccccuuccgucucugccacaccaggccagaagguuacuaucucaugcagugggagcuccucuaacauuggaaauaacuacgugucgugguauagaaggcucccggguacggcucccaaacaccuuauauacgagaccaauaaccggccuucaggcguaccagcacgccugagcgccgcgaagagugggacauccgcuacuuuggccaucaccggauuacagacagaagacgaggcagauuauuacugugccaccuggucuggcagccugaauauugguacugggacaaaagugaccguccua

SEQ ID NO: 25440 - RNA, 321 nt, Artificial Sequence
  derived and/or modified sequence opt3 from anti-HIV_119-015455_VR-Chain
cagagcgugcugacccaacccccuuccgucucugccacaccaggccagaagguuacuaucucaugcagugggagcaacuccaauauuggaaacaaagacgugucuugguaccagcacuucccggguacggcucccaagcuccuuauauaugagaauaacaaaagaccuucgggcaucccagauagguuuucagggagcaagagugcaaccuccgccacacugacuauuaccggauugcagacagaagacgaggcggauuacuauugugcuaccuggucuggcagcuuaaauaucgguacugggacaaaaguaaccgugcug

SEQ ID NO: 25441 - RNA, 321 nt, Artificial Sequence
  derived and/or modified sequence opt3 from anti-HIV_119-014425_VR-Chain
cagagcgugcugacccaacccccuuccgucucugccgcuccaggccagaagguuacaaucucaugcagugggggaacuagcaacauugguaauaacuacguguccugguaucagcaccucccgggcacggcacccaaacuucugauauacgagaauaacaagagaccuucugggaucccagacagguucucgggagccaaaucaggcaccagcgcgacauuggcuauuacugguuuacagaccggggaugaaggagacuauuacugugccacauggaguggcucccugaauaucggcaccgggacuaagguaacagugcua

SEQ ID NO: 25442 - RNA, 324 nt, Artificial Sequence
  derived and/or modified sequence opt3 from anti-HIV_119-013582_VR-Chain
cagagcauggugacccaaucccccucugucucagccgcuccuggccagaagguuacaaucaguugcagcgggacuuccucuaacauuggacagaauuacgugucgugguaucagcaacugccagguacggcaccgaaacuccuuauaucagagaacaauagaaggcccagcggcaccccugaccgguucaguggguccaagucuggaacaagcgccacucuggcgaucaccggcuugcagacaggugaugaagcugacuacuauugugagaccugggauggguccggaggcguauuuggcacugggacaaaagugaccgucuua

SEQ ID NO: 25443 - RNA, 333 nt, Artificial Sequence
  derived and/or modified sequence opt3 from anti-HIV_119-013364_VR-Chain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacgacaauaacaagagaccuucaggcaucccagauagguucagcgggaguaaauccggaacgucugccaccuuggcgauuacaggcuuacacacuggugacgaggcugauuauuacuguaccguauggggagugcggaagggggucggcgccguguuuggcacagggaccaaaguuacugugcug

SEQ ID NO: 25444 - RNA, 333 nt, Artificial Sequence
  derived and/or modified sequence opt3 from anti-HIV_119-012886_VR-Chain
cagagcauccugacccaacccccuuccgugucugccgcuccaggccagaaggucacaauuucaugcagugggagcuccucuacuauaggaacgaacuacguuucgugguaucagcaguucccggguaccgcacccaaacuccuuguguuugagacacacagaaggccuucaggcaucccagaccgguucagcgggaguaaguccggaacuucugccacccuggcgauuacaggcuugcaaaccggugaugaagcugacuacuauugugccguauggggagugcgccgaggggucggcgcaguguuuggcgccgggacuaaaguuacaguguua

SEQ ID NO: 25445 - RNA, 333 nt, Artificial Sequence
  derived and/or modified sequence opt3 from anti-HIV_119-012249_VR-Chain
cagagcgugcugacccaacccccuuccgucucuggcgccccagggcagaagguuacaaucucaugcaguggaagcuccucuaacauugguagaaauuacgugucgugguaucagcagcucccgggcacugcucccaaacuucugauauacgagaacaauaagaggccuucagggaucccagaccgguucagcggaaguaaauccggcacgucugcaaccuugguaauuacagguuuacaaacuggggaugaagccgacuuuuauuguggaaccugggauggcagccuguccggcgggggagugaucgguacaggcacccgcgucacugugcua

SEQ ID NO: 25446 - RNA, 324 nt, Artificial Sequence
  derived and/or modified sequence opt3 from anti-HIV_119-012161_VR-Chain
cagagcuuccugacccaacccccuuccgugucugccgcuccaggccagaaggucacaaucucaugcagugggagcaacuccaauauuggaaagaacuacguuucuugguaucaguaccucccggguacugugcccaaacuucugauauaugagaaugacaaaagaccuucgggcaucccagggagguuuucagcaagcaagaguggaacguccgccaccuuggcgauuacaggcuuacagacuggugaugaagcugacuacuauugugggaccugggauggaucuggcggcguauucgggacaggaaccaaagugacuguccug

SEQ ID NO: 25447 - RNA, 324 nt, Artificial Sequence
  derived and/or modified sequence opt3 from anti-HIV_119-012110_VR-Chain
cagagcgugcugacccaacccccuuccgucucugccgcuccaggccagacaguuacuaucucaugcagugggagcacguccaacauuggaaagaaugacgugucuugguaccagcagcucccggguaccgcacccaaacuucugauaucggagaacaauagaaggccuucaggcacaccagaucgguucagcgggaguaaguccggaacuucugccaccuuggcgaucagcggcuuacaaacaggugacgaagcugauuauuacugugggaccugggacggauccggcggcguauuugggacuggaacaaaagugaccguccug

SEQ ID NO: 25448 - RNA, 333 nt, Artificial Sequence
  derived and/or modified sequence opt3 from anti-HIV_119-012100_VR-Chain
caggccgugcugacccaacccccuagcgucuccgcugcaccaggccagaagguugccaucucuugcucagggaguagcuccaacauuggaaauaacuacgugucuugguaucagcagcucccggguacaguacccaaacuucugauauacgacacugauaagagaccuucgggcaucccagacagguucucagggagcaaaaguggaacguccgcgaccuugggcauuacacgguuacaaacuggugaugaggcugacuauuacugugccaccugggcaccccgccuaaauucugcccgaguguuugggaacggaacaauggucaccgugcug

SEQ ID NO: 25449 - RNA, 324 nt, Artificial Sequence
  derived and/or modified sequence opt3 from anti-HIV_119-011651_VR-Chain
cagagcgugcugacccaacccccuuccgucucugccgcuccaggccagaagguuacaaucucaugcagugggaacagcuccaauauuggaaacaauuacgugucuugguaucagcagcucccggguacugcacccaaacuucugauauacgagaacaauaagagaccuucgggcaucccagacagguucucagggagcaaaaguggaacguccgccaccuuggcgauuacaggcuuacaaacuggugaugaagcugacuauuacugugccaccugggaugggcggguaucuguguuuggaacaggcaccaaggucgcagugcug

SEQ ID NO: 25450 - RNA, 333 nt, Artificial Sequence
  derived and/or modified sequence opt3 from anti-HIV_119-011479_VR-Chain
cagagcgugcugacccaacccccuuccgucucugccacaccaggccagaagguuacuaucucaugcagugggagcaacuccaauauuggaaacaaauacgugucuugguaucagcacuucccggguacggcucccaagcuccuuauauacgagaauaacagaaggccuucgggcaucccagaccgguuuucagggagcaaaaguggaaccuccgcaacacuggccauuacuggcuugcagaccggugaugaagcggacuauuacuguacaaucuggggaguacgcaagggggugggcgcugucuucggcaccgggacuaaagugacaguuuua

SEQ ID NO: 25451 - RNA, 333 nt, Artificial Sequence
  derived and/or modified sequence opt3 from anti-HIV_119-011232_VR-Chain
cagagcgugcugacccaacccccuuccgucucugccgcuccaggccagaacguuaauaucucaugcagugggggaagcuccaacauugguucuaauuacgugucgugguaucagcaguucccgggcacagcacccaagcuccuuauauacgacgaugacaaaagaccuucagggaucccacacagguuuagcgccaguaaguccggaacuucugcgacgcuggcuauuagcggcuugcaaaccggugaugaggccgacuauuguugcgcaguauggggagugcggcgcggggccggcgcugucuucggcgcagggacaaaagugacuguuuua

SEQ ID NO: 25452 - RNA, 333 nt, Artificial Sequence
  derived and/or modified sequence opt3 from anti-HIV_119-011175_VR-Chain
cagagcgugcugacccaacccccuuccgucucugccgcuccaggccagaagguuacaaucucaugcagugggagcaacuccuacauuggaaauaaauaugugucuugguaccagcaguucccggguacugcacccaagcuccuuauauaugagaacaauagaaggccuucgggcaucccagaccgguuuucagggagcaaaaguggaacguccgccacccuggcgauuucuggcuugcaaacaggugaugaagcugacuacuguugcgccguauggggagugcgccgaggggcaggcgccgucuucggccccgggacuaaggugaccguuuua

SEQ ID NO: 25453 - RNA, 321 nt, Artificial Sequence
  derived and/or modified sequence opt3 from anti-HIV_119-008396_VR-Chain
cagagcgugcugacccaacccccuuccgucucugccgcuccaggccagaagguuacaaucucaugcagugggagcuccucuaacauuggaaauaacuacgugucgugguaucagcagguaccggguacugcacccaaacuccuuguguacgagaauacgagaaggccuucaggcgucccagaccgguucagcggggccaagaguggaaccuccgcgacacuggcuauaacuggcuugcaaaccggugaugaaggggacuauuacugugccacauggucuggcagcuuaaacaucggaaccggcacuaaagugacaguucug

SEQ ID NO: 25454 - RNA, 324 nt, Artificial Sequence
  derived and/or modified sequence opt3 from anti-HIV_119-007148_VR-Chain
cagagcgugcugacccaacccccuuccgucucugccgcuccaggccagaagguuacaaucucaugcagugggagcacuuccaacauuggaaagaauuacgugucuugguaucagcaccucccggguacggcacccaaacuucuguuguacgagaacgacagaaggccuucgggcaccccagaucgguucucagggagcaaaaguggaacauccgccacuuuagcgauaaccggccugcauacaggugacgaagcugauuauuacugugagaccugggacgggucuggaggcguauuuggcacugggacaaaggugaccguccua

SEQ ID NO: 25455 - RNA, 333 nt, Artificial Sequence
  derived and/or modified sequence opt3 from anti-HIV_119-007029_VR-Chain
cagagcgugcugacccaacccccuuccgucucugccgcuccaggccagaagguuacaaucucaugcagugggaacagcuccaauauuggaaacaauuucgugucuugguaccagcagguaccggguacugcacccaaacuccuucuguaugagacguacagaaggccuucgggcauaucagaccgguuuagcgggaguaaguccggaaccucugccacauuggcgaucacuggcuuacaaaccggugaugaagcugacuauuacuguacaguguggggaguccgcaaaggggugggcgccguuuucggcaccgggacuaaggugacaguccug

SEQ ID NO: 25456 - RNA, 324 nt, Artificial Sequence
  derived and/or modified sequence opt3 from anti-HIV_119-004707_VR-Chain
cagagcgugcugacccaacccccuuccgucucugccgcuccaggccagaagguuacaaucucaugcagugggagcacuuccaacauuggaaagaaugacgugucuugguaccagcagcucccggguacggcacccaaacuucugauaucggagaacaauagaaggccuucaggcaccccagaucgguucagcgggaguaaauccggaacaucugccacuuuggcgaucaccggcuuacaaacaggugacgaagcugauuauuacugugagaccugggacgggagcggaggcguauuuggcacugggacaaaggugaccguccug

SEQ ID NO: 25457 - RNA, 333 nt, Artificial Sequence
  derived and/or modified sequence opt3 from anti-HIV_119-003910_VR-Chain
cagagcgugcugacccaacccccuuccgucucugccgcuccaggccagaagguugcaaucucaugcagugggaacacaagcuccauuggaaauaacuucgugucuugguaccagcagguaccggguacugcccccaaacuccuuguguaugagacguacagaaggccuucgggcauaccagaccgguuuucagggagcaagaguggaaccuccgcgacacuggcuaucacuggcuugcaaaccggugaugaagccgacuauuacuguacagucuggggagugcgcaaagggguuggcgcaguguucggcaccgggacuaaggucacaguguua

SEQ ID NO: 25458 - RNA, 321 nt, Artificial Sequence
  derived and/or modified sequence opt3 from anti-HIV_119-002450_VR-Chain
cagagcgugcugacccaacccccuuccgucucuggcgccccagggcagagaguuacaaucucaugcacuggaaguagcuccaacauugguaauaacuacgugucuugguaucagggccucccggggacggcucccaaacuucugauauacgagaauaacaagaggccuucgggaaucccagaccgguucucaggcgcaaagagcgguaccgccgcgacauuggcuauuacuggguuacagaccggagaugaagccgacuauuacugugcaacauggaguggcucccugaauuuuggcaccgggacuaaaguaacagugcua

SEQ ID NO: 25459 - RNA, 321 nt, Artificial Sequence
  derived and/or modified sequence opt3 from anti-HIV_119-001552_VR-Chain
cagagcgugcugacccaacccccuuccgucucugccgcuccaggccagaagguuacaaucucaugcagugggagcaacuccuaccucggaaauaaauaugugucuugguaccagcaguucccggguacugcacccaaacuucugauuuaugagaacaauaagagaccuucgggcauaccagacagguuuucagccagcaagagugcggcuuccgccacguuggcaaucaccggguuacaaacaggagaugaaggcgacuacuauugugccacuuggaccgguucucugaacauugggacaggaaccaaaguaacugugcua

SEQ ID NO: 25460 - RNA, 333 nt, Artificial Sequence
  derived and/or modified sequence opt3 from anti-HIV_059-188169_VR-Chain
cagagcgugcugacccaacccccuuccgucucugccgcuccaggccagaagguuacaaucucaugcagugggagcacuuccaacauuggagacaauuacgugucuugguaucagcagguaccggguacggcacccaaacuccuuauauacgagaacaauagaaggccuucgggcaccccagaucgguucucagggagcaagaguggaacauccgccacucuggcgaucaccggcuugcaaacaggugacgaagcugauuauuacugugggaccugggacacuucuuuaagcacaggaggcguguuuggcaccgggacgaaagucacugugcug

SEQ ID NO: 25461 - RNA, 333 nt, Artificial Sequence
  derived and/or modified sequence opt3 from anti-HIV_059-183739_VR-Chain
cagagcgugcugacccaacccccuuccgucucugccgcuccaggccagaagguuacaaucucaugcagugggagcacuuccaacauuggaaagaauuacgugucuugguaucagcagcucccggguacggcacccaaacuucugauauacgagaacaauagaaggccuucgggcaccccagaccgguucucagggagcaaaaguggaacauccgccacuuugggcaucucugguuuacaaaccggggaugaagcggacuauuacuguggaacaugggauaccagccuguccggcggcgggguauuuggaacugguacaaaggugaccguccua

SEQ ID NO: 25462 - RNA, 333 nt, Artificial Sequence
  derived and/or modified sequence opt3 from anti-HIV_059-182376_VR-Chain
cagagcgugcugucccaacccccuucugucucagccgcuccaggccagaagguuaccaucaguugcagcggguccucuucgaacauuggaaauuacuaugugucaugguaccagcaguucccggguacagcacccaaacuccuuauauauaagaacgacaauagaccuagcggcaucccagauagguuuaguggguccaaaucuggaacuagcgccacgcugggcauuuccgguuugcaaaccggggacgaggcggauuacuauuguggaacauggggcacuucauuaaguggcgggggaguauucgguaccggcacaaaggugaccguccug

SEQ ID NO: 25463 - RNA, 333 nt, Artificial Sequence
  derived and/or modified sequence opt3 from anti-HIV_059-182199_VR-Chain
cagagcgugcugacccaacccccuuccgucucugccgcuccaggccagaacaucacaauuucaugcagugggagcuccucuaauauaggaucgcacucaaucagcugguaccagcaucucccggguacugcacccaagauuguuaucuaugacaacgauaaaagaccucuuggcauuccagacagguucaguggguccaagucuggaacgagcgccacccugggcaucacagguuugcagacuggggaugaggcggacuacuauuguggaaccugggauacauccuuaucaggcggcgggguguuuggacccgguaccaaaguaacugugcug

SEQ ID NO: 25464 - RNA, 324 nt, Artificial Sequence
  derived and/or modified sequence opt3 from anti-HIV_059-169202_VR-Chain
cacagcgugcugacccagcccccuuccgucucugccgcuccaggccaaaagguuacaaucucaugcagugggagcuccucuaaaauuggaaacaauuucgugucgugguaccagcagcucccggguacugcacccaaacuucugauauaugagaacaauaagagaccuucaggcaucccagacagguuuagcgggaguaaguccggaacgucugccaccuuggcgauuacaggcuuacagacuggugaugaagcugacuacuauugugggaccugggauggacggguaagcgugaucggcuccggcacaaaacugaccguccua

SEQ ID NO: 25465 - RNA, 324 nt, Artificial Sequence
  derived and/or modified sequence opt3 from anti-HIV_059-155645_VR-Chain
cagagcgcccugacccaacccgcuuccgugucuggcucaccugggcagaguaucacaauuagcugcacuggaacguccucugacgucgguuacaacuauguuucgugguaccagcagcucccaggcaccgcaccgaaacuucugauauaugagaauaacaagagacccucagggaucccugauagguucagcggaaguaaguccggcacaucugccacuuuggcgauuaccgguuuacaaacaggggacgaagcugauuacuauuguggaaccugggacggccggcugagcgugaucggcacugggacaaaaguaaccgugcua

SEQ ID NO: 25466 - RNA, 333 nt, Artificial Sequence
  derived and/or modified sequence opt3 from anti-HIV_059-151619_VR-Chain
cagagcgugcugacccaacccccuuccgucucugccgcuccaggccagaagguuacaaucucaugcagugggagcuccucuaacauuggaaauaacuucgugucgugguaccagcuccuuccggguacucccccuaaacuguugauauuuaagaauaacgagagaccaucaggcauccccgacagguucagcgggaguaaauccggaacgucugcaaccuuaggcauuacaggucugcagacuggggaugaaggagacuauuacuguggcaccugggauacaagccuauccggcgggggaguauuugguaccggcacucgggugacaguccuc

SEQ ID NO: 25467 - RNA, 333 nt, Artificial Sequence
  derived and/or modified sequence opt3 from anti-HIV_059-146503_VR-Chain
cagagcgugcugacccaacccccuuccgucucugccacaccaggccagaagguuacuaucucaugcagugggagcgcuuccaacauuggaaauaacuacgugucuugguaucagcaguucccggguacggcacccaaacuccuuauauacgacaccaauaagagaccuucgggcaucccagauagguuuucagggagcaaaaguggaacauccgccauucugggcaucacugguuugcaaauuggggacgaggcggauuauuacuguggaaccugggacacaucuuuaagcggcggcgggguauucggaaccgguacuaaggugacaguccug

SEQ ID NO: 25468 - RNA, 324 nt, Artificial Sequence
  derived and/or modified sequence opt3 from anti-HIV_059-136098_VR-Chain
cagagcgugcugacccaacccccuuccgucucugccgcuccaggccagagaguuacaaucucaugcagugggagcuccucuaacauuggaaauaacuacgugucgugguaucagcagcucccggguacugcacccaaacuucugauauacgagaauaacaggcggccuucaggcaucccagaccgcuucagcgggaguaaguccggaacgucugccaccuuggcgauuacaggcuuacaaacuggugaugaaggggacuauuacugugcucgaugggauggacgucugagcguaaucggcuccggcaccaaggugacaguccua

SEQ ID NO: 25469 - RNA, 333 nt, Artificial Sequence
  derived and/or modified sequence opt3 from anti-HIV_059-105516_VR-Chain
cagagcgcccugacccaacccccuuccgugucugcugcaccaggccagaaggucacaaucucaugcagugggagcuccucuaacauuggaaauaacuacguuucgugguaucagcagcucccggguacugcccccaaacuucugauauacgacaauaacaagagaccuucaggcaucccagauagguucagcgggaguaaauccggaacgucugcgaccuuggcuauugccggcuuacaaacaggugacgaggcaaauuauuacugugggacuugggauggaagccugcggaccggcggcguguuugggacaggaaccaagguaacugugcua

SEQ ID NO: 25470 - RNA, 333 nt, Artificial Sequence
  derived and/or modified sequence opt3 from anti-HIV_059-095709_VR-Chain
cagagcgugcugacccaacccccuuccgucucugccgcuccaggccagaagguuacaaucucaugcagugggagaagcuccaacauuggaaauaacuucgugucuugguaccagcuccuuccggguacugcacccaaacuguugauauauaagaauaacgagaggccuucgggcaucccagaccgguuuucagccagcaaaagugggacguccgcgaccuuaggaauuacaggccugcagacuggugaugaagcugacuacuauugugggaccugggauacaucucuaagcggaggcggcguauucgggaccggaacuaaggugacaguccuc

SEQ ID NO: 25471 - RNA, 333 nt, Artificial Sequence
  derived and/or modified sequence opt3 from anti-HIV_059-069468_VR-Chain
cagagcgugcugacccaacccccuuccgucucuggcgccccaagacagucaguuaucauuaguugcacagggagcuccucuaacauaggagguuucgacgugcacugguaccagcagcucccgggcacugcucccaaacuucugaucuaugagaauaacaggcggccuucggggacgccagaucgcuuuucaggaagcaagaguggcaccuccgcaacauuggccauuacugguuuacaaaccggggacgaagcggauuacuauuguggaacaugggacggcucucugagcaccggcgggguaaucggaacugguacaaaggugaccguccua

SEQ ID NO: 25472 - RNA, 333 nt, Artificial Sequence
  derived and/or modified sequence opt3 from anti-HIV_059-060026_VR-Chain
cagagcgugcugacccaacccccuuccgucucugccgcuccaggccagaagguuacaaucucaugcagugggagcuccucuaacauuggaaauaacuacgugucgugguaucagcagcucccggguacuguacccaaacuucugauauacaagaaugacaaaagaccuucaggcaucccagauagguucagcgggaguaaguccgcaacgucugccaccuugggaauuacaggcuuacaaacuggugacgaggcggauuauuacugugggaucugggacaccagccuguccgcuggaggcguguuuggcacagggacccgggucacugugcua

SEQ ID NO: 25473 - RNA, 333 nt, Artificial Sequence
  derived and/or modified sequence opt3 from anti-HIV_059-053668_VR-Chain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacgagaauaacaagagaucaagcggcaucccugacagguucaguggguccaaaucuggaacgagcgccaccuuggcgauuacaggcuuacaaacuggugaugaagcugacuauuacugugggacccgggauuccucacugaguggaggcggcguaaucgggacaggaaccaaggugacuguccua

SEQ ID NO: 25474 - RNA, 333 nt, Artificial Sequence
  derived and/or modified sequence opt3 from anti-HIV_059-052864_VR-Chain
cagagcgugcugacccaacccccuucccucucugccgcuccaggccagagagucacaaucucaugcagugggagcuccucuaacauuggaaauaacuacguuucgugguaucagcagcuuccggguacugcacccaagcuguugauauacgagucaaauaaaaggccuagcggcacgccagaccgguucaguggguccaagucuggaaccagcgccacauuagcgaucacuggccugcaaaccggugaugaagcugacuauuacugugggacaugggaugccucccuaucaaguggaggcgugaugggcaccgggacuaaaguaacagugcuc

SEQ ID NO: 25475 - RNA, 333 nt, Artificial Sequence
  derived and/or modified sequence opt3 from anti-HIV_059-050968_VR-Chain
cagagcgugcugacccaagcccccuccgucucugcugcaccuggcgagaagguuacaaucucaugcagugggacuagcuccaacauuggauacuauuacgugucuugguaucagcaguucccagguacggccccgaaaguagugauauacgaaaauaacagaaggcccucgggcaccccugaccgguuuucagggagcaagaguggaacauccgcgacucucgcuaucaccggccuucagacaggugaugaggccgacuauuacugugggaccuggggaggcucucugagcacuggcggggucauuggaacagguaccaaagugacgguuuug

SEQ ID NO: 25476 - RNA, 333 nt, Artificial Sequence
  derived and/or modified sequence opt3 from anti-HIV_059-046422_VR-Chain
cagagcgugcugacccaacccccuuccgucucugccgcuccaggccagaagguuacaaucucaugcagugggagcuccucuacuauuggaaacaauuacauaucgugguaucagcuccuuccggguacgcccccuaacuaccugaucuucaaaauuucagagagaccaagcggcgugcccgacagguuuaguggguccaagucuggaaccagcgcaacauugcacaucacuggcuuacagaccggugaugaaggggacuauuacuguggaacaugggauaccucccugucaggcggcgggguauucggaacugguacaaaagugaccguccua

SEQ ID NO: 25477 - RNA, 333 nt, Artificial Sequence
  derived and/or modified sequence opt3 from anti-HIV_059-045120_VR-Chain
cagagcgugcugacccaacccccuuccgucucugccgcuccaggccagaagguugcaaucucaugcagugggagcuccucuacaauuggaaacaauuacgugucgugguaucagcuccuuccggguacucccccuaaacuguugauauucaagucacacgagagaccaagcggcauccccgacagguuuaguggguccaaaucuggaacgagcgccaccuuaggcauuacaggucugcagacuggggaugaaggagacuacuauuguggcaccugggauuccucacuaaguguaggcgggguguucggaacagguaccaaggucacugugcuc

SEQ ID NO: 25478 - RNA, 333 nt, Artificial Sequence
  derived and/or modified sequence opt3 from anti-HIV_059-039932_VR-Chain
cagagcgugcugacccaacccccuuccgucucugccgcuccaggccagaagguuacaaucucaugcagugggagcuccucuauuauaggaaagaacuacgugucgugguaucagcaccucccggguacugcacccaaacuucugaucuacgagaauaacaaaagaccuucaggcauuccagacagguucagcgggaguaaguccggaacgucugccaccuuggcgaucgcuggcuuacagacaggugaugaagccaauuauuacugugggacuuggggaggcagccuguccaccggcgggguauuuggaacagguaccaaagugacuguccua

SEQ ID NO: 25479 - RNA, 333 nt, Artificial Sequence
  derived and/or modified sequence opt3 from anti-HIV_059-038595_VR-Chain
cagagcgugcugacccaacccccuuccgucucugccgcuccaggccagaagguuacaaucucaugcagugggagaagcuccaacauuggaaauaacuucgugucuugguaccagcagcucccggguacugcacccaaacuucugauauaugagaauaacaagaggccuucgggcaucccagaccgguuuucagggagcaaaaguggaacguccgccaccuugggcauuacagguuuacaaacuggggaugaagcggacuacuauuguggaaccugggauacaucucugagcgcuggcggcguauucggguccggaaccaaggugaucguccua

SEQ ID NO: 25480 - RNA, 333 nt, Artificial Sequence
  derived and/or modified sequence opt3 from anti-HIV_059-035082_VR-Chain
cagagcgugcugacccaacccccuuccgucucugccgcuccaggccagaagguuacaaucucaugcagugggagcacuuccaacauuggaaaaucuuucgugucgugguaccagcagcucccggguacggcacccaaacuucugauauaugacaauaacagaaggccuucaggcaccccagaucgguuuagcgggaguaaguccggaacaucugccacuuuggcgaucaccggcuuacaaacaggugacgaggcugauuacuauugugggaccuggggaggcagccuguccacuggcgggguaauuggaacagguaccaaggugacgguccua

SEQ ID NO: 25481 - RNA, 333 nt, Artificial Sequence
  derived and/or modified sequence opt3 from anti-HIV_059-029204_VR-Chain
cagagcgugcugacccaacccccuuccgucucugccgcuccaggccagaagguuacaaucucaugcagugggagcacuuccaacauuggaaaaauacucgugucuugguaccagcagcuuccggguacggcacccaagccuucgaucuaugacaauaacagaaggccaucaggcacccccgaucgguucagcgggaguaaauccggaacaucugccacucuggcgauuaccggcuugcaaacaggugacgaggcugauuacuauugugggaccugggacggcagcuuauccacuggaggcguaaucgggacaggaaccaaggugacggucccu

SEQ ID NO: 25482 - RNA, 324 nt, Artificial Sequence
  derived and/or modified sequence opt3 from anti-HIV_059-025235_VR-Chain
cagagcgugcugacccaacccccuuccgucucuggcgccccagggcagaagaucacaauuucaugcaguggaagcacuuccaacauagguaaaucuuacguuucgugguaucagcagcucccgggcacggcucccaaacuucugaucuacgagaauaacagaaggccuucagggaccccagaccgguucagcggaaguaaguccggcacaucugcaacuuuggccauuaccgguuuacaaacaggggaugaagcggacuauuacuguggaaccugggauggcagcggcggggugaucggaacugguacaaagguaaccgugcug

SEQ ID NO: 25483 - RNA, 333 nt, Artificial Sequence
  derived and/or modified sequence opt3 from anti-HIV_059-015192_VR-Chain
cagagcgugcugacccaacccccuuccgucucugccgcuccaggccagaagguuacaaucucaugcagugggagcuccucuacuauuggagacaaauacgugucgugguaucagcuccuuccggguacggcacccaagcuguugauauacaaaaacaauaagagaccuucaggcaucccagauagguucagcgggaguaaauccggaaccucugccacauuaggcauuacuggucugcagaccggggacgaggcggauuauuacuguggaacaugggacaccagccuauccguaggcggcguguuugggacuggaacaaaggucaccgugcuc

SEQ ID NO: 25484 - RNA, 333 nt, Artificial Sequence
  derived and/or modified sequence opt3 from anti-HIV_059-007060_VR-Chain
cagagcgugcugacccaacccccuuccgucucugccgcuccaggccagaagguuacaaucucaugcagugggagcuccucuaacauuggaaauaaauacgugucgugguaucagcagcucccggguacugcacccaaacuucugauauacgagaacaagaagagaccuucaggcaucccagacagguucagcgggaguaaauccggaacgucugccaccuugggcauuacagguuuacaaacuggggaugaagcggacuauuuuuguggaaccugggauacaagccuguccggcggcgggguauucggaucagguaccaaggugacuguccua

SEQ ID NO: 25485 - RNA, 324 nt, Artificial Sequence
  derived and/or modified sequence opt3 from anti-HIV_059-006953_VR-Chain
cagagcgugcugacccaacccccuuccgucucugccgcuccaggccagaagguuacaaucucaugcagugggagcuccucuaacauuggagugucgugguaccagcagguaccggguacugcacccaaacuccuuauauaugacaaugauaagagaccuacgggcaucccagacagguucucagggagcaaaaguggaaccuccgccauucuggcgaucacaggcuugcaaacuggugaugagggggacuacuauuguggaaccugggaaacaucuuuaagcggcggcgggguguuuggaaccgguacuaaggucacagugcug

SEQ ID NO: 25486 - RNA, 333 nt, Artificial Sequence
  derived and/or modified sequence opt3 from anti-HIV_059-005953_VR-Chain
cacagcgugcugacccagcccccuuccgucucugccgcuccaggccaaaagguuacaaucucaugcagugggacuagcuccaacauuggaaagaauuacgugucuugguaucagcagcucccggguacggcacccaaacuucugauauacgagaacaauagaaggccuucgggcaccccagaccgguucucagggagcaaaaguggaacauccgccacuuuggcgaucaccggcuuacagacaggugaugaagcugacuauuacugugggaccugggauacuucucugagcacaggaggcguauuuggcaccgggacgaaggugacuguccua

SEQ ID NO: 25487 - RNA, 324 nt, Artificial Sequence
  derived and/or modified sequence opt3 from anti-HIV_059-003725_VR-Chain
cagagcgugcugacccaacccccuuccgucucugccgcuccaggccagaagcucacaaucucaugcagugggagcacuuccaaaauuggaaacaauuacguuucuugguaucagcaccuuccggguacggcacccaagcuguugguguacgagaacaauaaaagaccuucgggcauaccagacagguucucagggagcaagaguggaaccuccgccacauuagcgaucacuggccugcagaccggugaugaagcugacuauuacugugggacaugggauggacggcuaucuguaauuggcaccggcacuaaagugacaguccuc

SEQ ID NO: 25488 - RNA, 333 nt, Artificial Sequence
  derived and/or modified sequence opt3 from anti-HIV_059-002618_VR-Chain
cagcuggugcucacccaacccccuagcgucuccgccgcuccaggccagaagguuacaaucucuugcucagggaguagcuccaacauuggaaauaacuucgugucuugguaccagcagcuuccggguacugcacccaaacuguugauauaugagaauaacaagagaccuucgggcaucccagacagguuuucagggagcaaaaguggaacguccgccaccuuaggcauuacaggucugcaaacuggggaugaagcggacuacuauuguggaaccugggauacacggcuaucugcuggcggcguauucgggaccggaacuaaggugacaguccuc

SEQ ID NO: 25489 - RNA, 324 nt, Artificial Sequence
  derived and/or modified sequence opt3 from anti-HIV_059-001522_VR-Chain
cagagcgugcugacccaacccccuuccgucucugccgcuccaggccagaagguuacaaucucaugcagugggagcaacuccaauauuggaaacaauuacgugucuugguaucagcagcucccggguacugcacccaaacuucugauauacgagaacaauaagagaccuucgggcaucccagacagguucucagggagcaaaaguggaacguccgccaccuuggcgauuacaggcuuacaaacuggugaugaagcugacuauuacugugggaccugggauggacggcugucuguaaucggcgccggcacaaaggugauugucgug

SEQ ID NO: 25490 - RNA, 333 nt, Artificial Sequence
  derived and/or modified sequence opt3 from anti-HIV_059-000731_VR-Chain
cagagcgugcugacccaacccccuuccgucucugccgcuccaggccagaagguuacaaucucaugcagugggagcacuuccaacauuggaaauaaauacgugucuugguaucagcagguaccggguacggcacccaagcuccuuauauacgagaacaauagaaggccuucgggcaucccagaccgguucucagggagcaaaaguggaaccuccgccacacuggcgauuacuggcuugcaaaccggugaugaagcugacuauuacugugggacaugggaugccucuuuacgcaccggaggcgugaucggcacugggacaaaggucaccgugcug

SEQ ID NO: 25491 - RNA, 333 nt, Artificial Sequence
  derived and/or modified sequence opt3 from anti-HIV_059-000634_VR-Chain
cagagcgugcugacccaacccccuuccgucucugccgcuccaggccagaagguuacaaucucaugcagugggagcuccucuacuauuggaaacaauuacgugucgugguaucagguagugccggguacggcacccaaacuccuuauauacaagaucaacgagagaccuucaggcauuccagacagguucagcgggaguaaauccggaaccucugccacacugggcaucacugguuugcagaccggggaugaagcggacuauuacuguggaacaugggauaccagcuuauccggcggcggggucuuuggacccgguacuaaggugacaguucug

SEQ ID NO: 25492 - RNA, 333 nt, Artificial Sequence
  derived and/or modified sequence opt3 from anti-HIV_048-250757_VR-Chain
cagagcgugcugacccaacccccuuccgucucuggcgccccagggcagagaguuacaaucucaugcacuggaacgaccaguaacauugguagcaauuacguggcuugguaucagcagcucccgggcacagcacccaaacuucugauauacgacaacgauaagaggccuuccgggaucccagaccgguucucuggaucgaagucaggcacuagcgccaccuuggguauuacaggguuacaaaccggagaugaggcggacuauuacuguggcacuugggauacaagucuguccgcuggcgggguauuuggaaccgguacgaaagugacuguccua

SEQ ID NO: 25493 - RNA, 333 nt, Artificial Sequence
  derived and/or modified sequence opt3 from anti-HIV_048-250716_VR-Chain
cagagcgugcugacccaacccccuuccgucucugccgcuccaggccagaagguuacaaucucaugcagugggagcuccucuaacauuggaaauaaauacgugucgugguaucagcagcucccggguacugcacccaaacuucugauauacgagaacucaaagagaccuagcggcaucccagacagguucaguggguccaagucuggaacgagcgccaccuugggcauuacagguuuacaaacugggggacaggcggauuauuacuguggcaccugggacacaucccugucagcuggcgggguauuuggaagugguaccaaagugacuguccua

SEQ ID NO: 25494 - RNA, 333 nt, Artificial Sequence
  derived and/or modified sequence opt3 from anti-HIV_048-250463_VR-Chain
cagagcgugcugacccaacccccuuccgucucugccgcuccaggccagaagguuacaaucucaugcagugggagcagauccaacaauggaaacaauuacgugucuugguaucagcagcucccggguacugcacccaaacuucugauuuacgagaacaauaagaggccuucgggcauaccagaccgguucucagggagcaaaaguggaacguccgccaccuuggcgaucacaggcuuacaaacuggugaugaagcugacuauuacugugggaccugggauucuagccuguccggaggcggcguaauugggacaggaaccaagcuaacugugcuc

SEQ ID NO: 25495 - RNA, 333 nt, Artificial Sequence
  derived and/or modified sequence opt3 from anti-HIV_048-248153_VR-Chain
cagagcgcccugacccaacccgcuuccgugucugcaucauucggccagaguaucacaauuagcugcacuggggccgcguccgacgucggauacaacuauguuucuugguaccagcagcucccugguacgaccccaaaacuucugauauauagaaauaaccaaaggccgucgggcauccccgaucgguuuucagggagcaagaguggaacauccgcuacuuugggcauuaccgguuuacagacaggggacgaggccgauuacuauuguggaaccugggacacuucucugagcgcaggcggcguguucgggacaggaaccaagguaacggugcua

SEQ ID NO: 25496 - RNA, 333 nt, Artificial Sequence
  derived and/or modified sequence opt3 from anti-HIV_048-247532_VR-Chain
cagagcgugcugacccaacccccuuccgucucugccgcuccaggccagcagguuacaaucucaugcagugggacuacgagcaacauuggaaccaauuacguguccugguaucagcaaaugccgcccgcagccccuaagcuccuuauauacgacaacaaaaagagaccaucugauauccccgacagguucucggguucaaaaagcggcacaagugcgacucuggggauuaccggauugcagacaggcgaugaggcugacuauuacugugguaccugggauacuuccuuaucugccgggggaguauuuggcacaggcaccaaggugacgguccug

SEQ ID NO: 25497 - RNA, 333 nt, Artificial Sequence
  derived and/or modified sequence opt3 from anti-HIV_048-245846_VR-Chain
cagagcgugcugacccaacccccuuccgucucugccacaccaggccagagaguuacuaucucaugcacggggaguagcuccaacauuggagguuacgacgugucuugguaucagguacucccgggcaccgcucccaaacuucugauauacgauucggacaagaggccuucagggaucccagaucgguucagcggaagucaguccggcacaucugcaacuuuggguauuaccggguuacaaacaggagacgaggccgauuauuacuguggcaccugggacacuagccuguccggcgggggaguguuugguacaggcaccaaggucacggugcua

SEQ ID NO: 25498 - RNA, 333 nt, Artificial Sequence
  derived and/or modified sequence opt3 from anti-HIV_048-244016_VR-Chain
cagagcgugcugacccaacccccuuccgucucuggcgccccagggcagagaguuacaaucucaugcacuggaaguagcuccaacauugguggcuacgacgugcacugguaucagcagcucccggggacggcucccaaacuucugauauacaagaaugauaagaggccuucuggaaucccagaccgguucucgggcucaaaaagcgguaccagugcaauuuuggggaucacaggauuacaaacuggcgaugaggccgacuauuacuguggcgcgugggauaccucccugucugcugggggaguauuugguacaggcaccaaggugacuguccua

SEQ ID NO: 25499 - RNA, 333 nt, Artificial Sequence
  derived and/or modified sequence opt3 from anti-HIV_048-243682_VR-Chain
cagagccugcucacccaacccccuuccgugucugccgcuccaggccagaaggucacaaucucaugcacugggaguagcuccaacauuggagguuacgacguucacugguaucagcagcuuccgggcacggcacccaaacuguugauauacgagaauaacaagagaccuucugggaucccagauagguucucgggaucaaaaagcggcaccagugccacauuagguauuacugggcugcaaaccggagacgaagcggauuauuacuguggcacaugggacuccucucuaagcgcuggcgggguguuuggaaccgguacuaagguaacagugcuc

SEQ ID NO: 25500 - RNA, 333 nt, Artificial Sequence
  derived and/or modified sequence opt3 from anti-HIV_048-243588_VR-Chain
cagagccugcucacccaacccccuuccgugucugccccaccgggccagauggucucaaucaguugcagcggguccucucacaacauuggagacaauuacguuucgugguaucagcaucuucccgguacagcuccuaagcuguugauauacgauaacaauucaagaccaagcggcauccccgacagguucaguggguccaaaucuggaacuagcgcaacguuaggcauuaccggucugcagacaggggaugaggccgacuauuacuguggaacuugggauaccucccuaucaggcggcgggguguuuggaacagguaccaagguaacugugcuc

SEQ ID NO: 25501 - RNA, 333 nt, Artificial Sequence
  derived and/or modified sequence opt3 from anti-HIV_048-241775_VR-Chain
cagagcgugcuggcccaacccccuuccgucucuggcgcuccagggcagagaguuaccaucucaugcacaggaaguagcuccaacauuggugaguacgacgugcacugguaucagcagcucccgggcacugcacccaaacuucugauauacgaaaauaacaagaggccuucugggaucccagaucgguucucgggaucaaagagcggcacgagugccaccuuggguauuacaggguuacaaacuggagacgaggcggauuauuacuguggcaccugggacuccucucugagcgcuggcgggguauuuggaacagguaccaaagugacuguccua

SEQ ID NO: 25502 - RNA, 333 nt, Artificial Sequence
  derived and/or modified sequence opt3 from anti-HIV_048-237996_VR-Chain
cagagcgugcugacccaacccccuuccgucucuggcgcgccagggcagagaguuacaaucucaugcacuggaaguagcuccaacauugguggcuacgacgugcacugguauaggcagcucccggggacggcucccaaacuucugauauacgauaccguaaagcggccuucuggaaucccagaccgcuucucgggcucaaagagcgguacaagugcaacuuuggggauuaccggauuacagacaggcgaugaggccgacuauuacuguggcaccugggauacuucccugucugccgggggaguguuugguacaggcaccaaagucacggugcua

SEQ ID NO: 25503 - RNA, 330 nt, Artificial Sequence
  derived and/or modified sequence opt3 from anti-HIV_048-237730_VR-Chain
agcgugcugacccagcccccuuccgucucuggcgccccagggcagagaguuacaaucucaugcacuggaacgaacaguaauuucgguagcaacuacgcucacugguaucaacaggugccgggcaccgcacccaagcuccuuauuuacuccaauaacgccaggccuucugggauaccagaccgguuuucgggaucaaaaagcggcacaagugcgacucuggguaucaccggguugcagacaggagaugaggcugacuauuacuguggcaccugggauacuuccuuaucugccggcgggguauucggaacagguaccaaggugacgguccug

SEQ ID NO: 25504 - RNA, 333 nt, Artificial Sequence
  derived and/or modified sequence opt3 from anti-HIV_048-237253_VR-Chain
cagagcgugcugacccaacccccuuccgucucugccgcuccaggccagaagguuacagugucaugcagugggagcuccucuaacaucggaucgaaugacguaucaugguaccagcaguucccgggugcagcccccaaacuccuuauuuauaagaacaaugagagaccuagcggcauaccagauagguuuaguggguccaaaucuggaacuagcgcgacgcugggcaucaccgguuugcaaacaggggacgaagcugauuacuauuguggaacuugggacaccuccuuaucagccggcggcguguucgggacaggaaccaaggucacugugcug

SEQ ID NO: 25505 - RNA, 333 nt, Artificial Sequence
  derived and/or modified sequence opt3 from anti-HIV_048-234100_VR-Chain
cagagcaugcugacccagcccccuuccgugucugccgcuccaggcgagaaggucacaaucucaugcagugggagcuccucuaacauuggaaaaacuuucguuucgugguaccaacaggugccggguacggcacccaagcuccuuauauauaaaaaugacaacagaccuucaggcaucccagauagguuuagcgggaguaaguccggaaccucugccacacugggcauuagcgguuugcagacuggggacgaagcggauuacuauuguggaaccugggacacauccuuaucaggcggcgggguauucggaaccgguacuaaagugacaguccug

SEQ ID NO: 25506 - RNA, 333 nt, Artificial Sequence
  derived and/or modified sequence opt3 from anti-HIV_048-230882_VR-Chain
cagagcgugcugacccaacccccuuccgucucugccgcuccaggccagaagguuacaaucucaugcagugggaacagcuccaauauuggaucuaacuucgugucgugguaccagcagcucccggguacugcacccaaacuucugauauaugagaauaacaagagaccuucaggcaucccagacagguuuagcgggaguaaauccggaacgucugccaccuugggcauuacagguuuacaaacuggggaugaagcggacuacuauuguggaaccugggauacaagccugucccccggcggcguauucgggaccggaacuaaggugacaguccua

SEQ ID NO: 25507 - RNA, 333 nt, Artificial Sequence
  derived and/or modified sequence opt3 from anti-HIV_048-229473_VR-Chain
cagagcgugcugacccaacccccuuccgucucugccgcuccaggccagaagguuacaaucucaugcagugggagcuccucuaacauuggaaauaacuacgugucgugguaucagcaguucccggguacugcacccaaacuccuuauauacgagaauaacaagagaccuucaggcaucccagacagguuuagcgggaguaaauccggaacgaccgccacacuggcgauuacucgguugcaaaccggcgaugaagcugacuauuacugugguacauggggagggucuuuaagcgccggcggcguauucgggaccggaacuaaggugacaguccug

SEQ ID NO: 25508 - RNA, 333 nt, Artificial Sequence
  derived and/or modified sequence opt3 from anti-HIV_048-228238_VR-Chain
cagagcgugcugacccaacccccuuccgucucugccgcuccaggccagaagguuacaaucucaugcagugggagcuccucuaacauuggaauaaauuacgugucgugguaucagcagcucccggguacugcacccaaacuucugaucuacgacaacacgaagagaccucaaggcauuccagauagguucucagggagcaaaaguggaaccuccgccacauuggcgaucacuggcuuacagaccggugacgaggcugauuauuacugugggacaugggacggaucucugagcaccggcggcguaauugggacuggaacaaaggugaccguccua

SEQ ID NO: 25509 - RNA, 333 nt, Artificial Sequence
  derived and/or modified sequence opt3 from anti-HIV_048-228027_VR-Chain
cagagccugcucacccaaucccccucugccucaggcccuccagggcagagagugacaaucaguugcagcggauccaacucuaauauugguucgaacacugucaauugguaccaccaucuuccgggcgcugcacccaagcuguugauauaugagaacucaaaaaggccuagcgggaucccagaccgguucaguggauccaagucuggcacgagcgccaccuuagguauuacagggcugcagacuggagaugaagcggacuacuauuguggcaccugggauacaucccuaucagcuggcgggguuuuuggaagugguaccaaagugacuguacuc

SEQ ID NO: 25510 - RNA, 333 nt, Artificial Sequence
  derived and/or modified sequence opt3 from anti-HIV_048-227795_VR-Chain
cagagcgugcugacccaacccccuuccgucucugccgcuccaggccagaagguuacaaucucaugcagugggagcuccucuaacauugagucgagaucagugcacugguaccagcagaaaccgggacaagcacccguacucgugauauauuacgacagcgauaggccuagugguaucccagaccgguucuccggcucuaagagcgggacugccgcgacgcuuggaauuaccggccugcagacaggugaugaagcugacuauuacugugggacuugggauaccuccuugucagccggaggcgucuuuggcacagggaccaaagugacuguuuua

SEQ ID NO: 25511 - RNA, 333 nt, Artificial Sequence
  derived and/or modified sequence opt3 from anti-HIV_048-227770_VR-Chain
cagagcgugcugacccaacccccuuccgucucuggcgccccagggcagagaguuacaaucucaugcacuggaaguagcuccaacauugguccgagggacgugcacugguaccagcagcuccccggcacgguaccuaaacuucugauauaugauaccuacacacggccaucugggauccccgaccgcuucucgggaucaaagagcggcgcuagugcaacuuuggauauuaccgguuuacaaacaggggacgaggccgauuauuacuguggaaucugggacaccucccugucugcgggcggcguguuugggacuggaacaaaggucaccgugcua

SEQ ID NO: 25512 - RNA, 333 nt, Artificial Sequence
  derived and/or modified sequence opt3 from anti-HIV_048-225298_VR-Chain
cagagcgcccugacccaacccagauccgugucuggcucaccugggcagagugucacaaucagcugcacuggaacguccaacgacguugguuacgauuaugugucuugguaccagcagcucccaggcaccgcuccgaaacuucugauuuaugacauaaauaagaggcccucggggaucccugaucgguucucaggaagcaagaguggcacauccgcaacuuuggguauuaccggguuacaaacaggagacgaggccgauuacuauuguggcaccugggacacuucucugagcgcgggcgggguauuuggaacagguaccaaagugacgguccua

SEQ ID NO: 25513 - RNA, 327 nt, Artificial Sequence
  derived and/or modified sequence opt3 from anti-HIV_048-225090_VR-Chain
gagcugacccagcccccuagcguguccggcgccccagggcaaagagucacaaucucuugcacuggaucaaguagcaacauugguggcuacgacguucacugguaucagcagcucccggggacggcucccaaacuucugauauacgauaauaacaagaggccuuccggaaucccagaccgguucucuggcucgaagucagguaccagcgcaacauuggggauuacuggauuacagaccggcgaugaagccgacuauuacuguggcacaugggauaccagucuguccacugggggaguguuugguacaggcaccaaaguaacggugcua

SEQ ID NO: 25514 - RNA, 333 nt, Artificial Sequence
  derived and/or modified sequence opt3 from anti-HIV_048-224187_VR-Chain
cagagcgugcugacccaacccccuuccgccucuggcacaccagggcagagagucacuaucucaugcaguggaagcuccgcuaacauugguacgaauuacguuuucugguaucagcaccucccgggcaccacacccaggcuucugauauuucggaacaaugagcgcccuucugggaucccagaccgauucucgggaucaaagagcggcaccagugcaacuuuggguauuacaggguuacagaccggagaugaagccgacuacuauuguggcacuugggauacaucccugucugcgggcgggguguuuggaaccgguacgaaaguaacugugcua

SEQ ID NO: 25515 - RNA, 333 nt, Artificial Sequence
  derived and/or modified sequence opt3 from anti-HIV_048-223055_VR-Chain
cagagcgugcugacccaacccccuuccgucucugccgcuccaggccagaagguuacaaucucaugcagugggagcuccucuaacauuggaaauaacuacgugucgugguaucagcaguucccggguacugcacccaaaguacucauauacggcaauucaaagagaccuagcgggaucccagacagguuuaguggauccaaaucuggcacgagcgccacccuugguauuacagggcugcaaacuggagaugaggcggacuauuacuguggcaccugggauacauccuugucagcuggcgggguguucggaagugguaccaaggucacuguguua

SEQ ID NO: 25516 - RNA, 333 nt, Artificial Sequence
  derived and/or modified sequence opt3 from anti-HIV_048-222711_VR-Chain
cagcccgugcugacccaaccuccaagcgucuccggcgccccggggcagagaguuacaaucucuugcacuggaucaaguagcaacauugguggcuacgacgugcacugguaucagcagguacccgggacggcuccuaagcuccuuauauucgagaauaacaggcggccauccggaauccccgaucgcuuuucuggcucgaaaucagguaccagcgcaacacuggccauuacuggguugcaaaccggagacgaagcggauuacuauuguggcacaugggacggcaguuuauccaccgggggagugaucgguacuggcacaaaggucaccgugcug

SEQ ID NO: 25517 - RNA, 333 nt, Artificial Sequence
  derived and/or modified sequence opt3 from anti-HIV_048-221209_VR-Chain
cagagcgugcugacccaacccccuuccgucucuggcgccccagggcagagaguuacaaucucaugcacuggaaacaguagcaauauuggugacuacgaugugcacugguaucagcagguagcuggcacggcaccgaagcuccuuauauucaaaaacaaugagaggcccuccgggaucccugaccgguuuucuggaucgaagucaggcaccagcgccacacuggguauuacuggguugcaaaccggagaugaagcggacuacuauuguggcacaugggauaccaguuuauccgcuggcgggguguucggaucugguacuaaagucacagugcug

SEQ ID NO: 25518 - RNA, 333 nt, Artificial Sequence
  derived and/or modified sequence opt3 from anti-HIV_048-220629_VR-Chain
cagagcgcccugacccaacccgcuuccgugucuggcucacucgggcagaguaucacaauuagcugcacuggaacguccagagacgucgguuacucuuauguuucgugguaccagcaccuuccuggcaccgcaccaaagcuguugauauaugagaacaauaaaaggccgucagggauccccgaucgguucagcggaaguaaguccggcacaucugccacuuuagguauuaccgggcugcagacaggagacgaagcggauuacuauuguggcaccugggacagcucccuaucagcuggcgggguguuuggaacugguacaaaaguaaccgugcuc

SEQ ID NO: 25519 - RNA, 333 nt, Artificial Sequence
  derived and/or modified sequence opt3 from anti-HIV_048-219430_VR-Chain
cagagcgugcugacccaacccccuuccgucucugccgcuccaggccagaugguuacaaucucaugcagugggagcacuuccaacauuggaauaaauuacgugucuugguaucagcacguaccggguacggcacccaagcuccuuaucuacgacaacaauaaaagaccuucgggcauuccagauagguucucagggagcaagaguggaaccuccgccacacugggcaucacugguuugcauaccggggacgaggcggauuauuacuguggaacaugggacaccucuuuaagcgcuggcggcguguuugggacuggaacaaaagucaccgugcug

SEQ ID NO: 25520 - RNA, 333 nt, Artificial Sequence
  derived and/or modified sequence opt3 from anti-HIV_048-216250_VR-Chain
cagagcgugcugacccaacccccuuccgucucugccgcuccaggccagaagguuacaaucucaugcacugggacgaccagugacuucggauacaacugugugagcugguaucagcagcacccggguagagcacccaaaguaauuauauccggcgugaauaagaggccuucugggaucccagaucgguuuucgggaucaaaaagcggcacaagugccacucucgguauuaccgggcuucaaacaggagacgaggcggauuacuauugcggcaccugggacuccucucugagcgcuggcggggucuucggaacugguacaaaggugaccguuuug

SEQ ID NO: 25521 - RNA, 321 nt, Artificial Sequence
  derived and/or modified sequence opt3 from anti-HIV_048-216133_VR-Chain
acccagcccccuagccuguccgccacaccaggccaaagagugucuaucucaugcagugggggagguagcaacauuggcaauaacgacgucuucugguuucagcaguucccgggggcuggacccaggcuccuuauauacgauaaucacaagcggcauuauggcacuccugaccgcuuuuccgguucuaaaucggggacgucagcaacccuggccaucacaggauugcagacuggcgaugaggcggcuuacuauuguggcaccugggacgggagcuuaaguacaggagguguuauuggcaccgggacuaaggugacaguacug

SEQ ID NO: 25522 - RNA, 333 nt, Artificial Sequence
  derived and/or modified sequence opt3 from anti-HIV_048-214886_VR-Chain
cagagcgcccugacccaacccagauccgugucuggcucaccugggcagagugucacaaucagcugcacuggaacguccucugacguugguuacaacuaugugucgugguaccagcaccauccaggcaccgcuccgaagcuccuuauuuauaaaaauaacaauaggcccucagggauaccugaucgguucagcggaaguaaguccggcacaucugcaacucuggguaucaccggguugcagacaggagacgaggccgauuacuauuguggcaccugggacacuagcuuauccgcgggcgggguauuuggaacagguaccaaagugacgguccug

SEQ ID NO: 25523 - RNA, 333 nt, Artificial Sequence
  derived and/or modified sequence opt3 from anti-HIV_048-214709_VR-Chain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacgagaaugacagaaggccuucaggcaucccagaucgguucagcgggaguaaguccggaacgucugccaccuugggcauuacagguuuacaaacuggggacgaagcggauuauuacuguggaaccugggacacaagccuguccgcuggcggcguauuugggaccggaacuaaagugacaguccua

SEQ ID NO: 25524 - RNA, 333 nt, Artificial Sequence
  derived and/or modified sequence opt3 from anti-HIV_048-214001_VR-Chain
cagagcgugcugacccaacccccuuccgucucuggcgccccagggcagacaguuacuaucucaugcaguggaagcaacuccaauauugguaaccacgacgugcauugguaccagcacguaccgggcacggcucccaagcuccuuauauaugauaauaacaaaagaccuucugggaucccagacagguucucgggaucaaagagcggcaccagugcaacacuggguauuacuggguugcagaccggagaugaggccgaauacuauugugcgacaugggacgcuuccuuaucuggcggcgggguguuucggaccggaacuaaagucacagugcug

SEQ ID NO: 25525 - RNA, 333 nt, Artificial Sequence
  derived and/or modified sequence opt3 from anti-HIV_048-213230_VR-Chain
cagagcgugcugacccaacccccuuccaugucugccgcuccaggccagaaggucacaaucucaugcagugggagcuccaacaauauugguaaaaacguugugucuugguaccagcagcucccgggaacugcacccaagguacuuauauaugagaauaacaaaagacugucgggcaucccugacagguucucagggagcaagaguggaacguccgccaccuuggugauuacaggcuuacaaacuggugaugaagcggacuacuauugugggaccugggauucuagccuguccgcuggaggcgucuuuggcacagggaccaaagugacuguucua

SEQ ID NO: 25526 - RNA, 333 nt, Artificial Sequence
  derived and/or modified sequence opt3 from anti-HIV_048-212574_VR-Chain
cagagcgugcugacccaacccccuuccgucucugccgcuccaggccagagaguuacagugucaugcagugggagcacuuccaacaucgagucuaauuacguaucgugguaucaacaggugccgggaacggcacccaagcuccuuauuuacgaaaacaauaaaaggccuucagguauaccagaccgguucagcggcaguaaguccgggaccucugccacacuggcgaucacuggauugcagaccggcgaugaggcugccuauuacugugguacaugggacgggagcuuauccaccggaggcgucauuggcacugggacaaaagugaccguucug

SEQ ID NO: 25527 - RNA, 333 nt, Artificial Sequence
  derived and/or modified sequence opt3 from anti-HIV_048-212207_VR-Chain
cagagcgugcugacccaacccccuucccucucugccgcuccaggccagaaggucacaaucucaugcagugggggaagcuccaacauugguaauaacuacguuucuugguaucagcaccuuccgggcacugcacccaaacuguugauauacgacaauuauaagagaccuucggggaucccagauagguucucaggaagcaaaaguggcacguccgccaccuuagacauuacaggucugcagacuggggaugaggcggacuacuauuguggaaccugggauacaucucuaagcgcuggcggcguguuugggaccggaacuaagguaacagugcuc

SEQ ID NO: 25528 - RNA, 333 nt, Artificial Sequence
  derived and/or modified sequence opt3 from anti-HIV_048-209146_VR-Chain
cagagcgugcugacccaacccccuuccgucucuggcgccccagggcagaagaucacaguuucaugcacuggaacgaccaguaacauugguccgcacgacgugcauugguaccagcucguacccggcagaccuccaaaacuucugauauuccacaauaacaucaggcccagcgggauuccugaucgguuuuccggaucuaagucgggcaugucagcuacauuggguaucacuggguuacagaccggagacgaggcagauuauuacuguggcacaugggacagcagucuguccgccggcgggguguucggaaccgguacuaaagucacagugcua

SEQ ID NO: 25529 - RNA, 333 nt, Artificial Sequence
  derived and/or modified sequence opt3 from anti-HIV_048-208206_VR-Chain
cagagcgugcugacccaacccccuuccgucucugccgcuccaggccagaagguuacaaucucaugcagugggagcuccucuaacauuggaucgaauuacgugucaugguaucagcaguucccggguacugcacccagacuccuuauauacgagaacgacaaaaggccuagcgccaucccagaucgguuuaguggcuccaagucugggacgagcgcgacccugggaauuacaggcuugcacacuggugacgaagcugauuauuacugugggaccugggacggauccuuaucaacaggcggcguaaucgggaccggaacuaaagugacaguccug

SEQ ID NO: 25530 - RNA, 333 nt, Artificial Sequence
  derived and/or modified sequence opt3 from anti-HIV_048-208194_VR-Chain
cagagcgcccugacccaacccccuuccgcuucuggcucaccagggcagagugugacaaucagcugcacuggaacguccucugacauugguuacaaguaugucucgugguaccagcuccuuccgggcacacccccuaaacuguugauauucaagaacaaugagagaccaucagggauccccgauagguuuagcggaaguaaauccggcaccucugcaacuuuagguauuaccgggcugcagacaggagacgaagccgauuauuacuguggcgcgugggacaccagccuauccgcuggcgggguuuucggaacugguacaaaggugaccguacuc

SEQ ID NO: 25531 - RNA, 333 nt, Artificial Sequence
  derived and/or modified sequence opt3 from anti-HIV_048-207744_VR-Chain
cagagcgcccugacccaacccgcuuccgugucugcaucauucggccagaguaucacaauuagcugcacuggggccgcguccacgauaggaaacaaucucgucucuugguacagacuucugccugguaccgcuccaaaguuguuaaucuauaaaaacgacaauaggccgucgggcauucccgaucgguuuucagggagcaagaguggaacauccgccacucugggcaucucuggucuacagaccggggacgaggcagauuacuauuguggaacaugggacaccagccucuccggcggcgggguuuucggaacugguacaaaagugaccguacug

SEQ ID NO: 25532 - RNA, 333 nt, Artificial Sequence
  derived and/or modified sequence opt3 from anti-HIV_048-206501_VR-Chain
cagagcgugcugacccaacccccuuccgucucuggcgccccagggcagagaguuacaaucucaugcaguggaagcuccucuaacauugguaauaacgcugugaauugguaccagcagcucccgggcaaggcacccaaacuucugauauaugagaacaauaagaggccuucggggaucccagaccgguucucaggaagcaaaaguggcacuuccgccacguuggguauuaccggguuacaaacaggagaugaagcggacuacuauuguggcacuugggauucuagccuguccgcuggcgggguauuuggaaccgguacaaaggugaccguccua

SEQ ID NO: 25533 - RNA, 333 nt, Artificial Sequence
  derived and/or modified sequence opt3 from anti-HIV_048-204221_VR-Chain
cagagcgugcugacccaacccccuuccgccucuggcacaccagggcagagagucacuaucucaugcuucggaaguagcuccaacauugcuucuucggcaguuaauugguaccagcagcucccggguacggcccccaaacuucugauauauaagaacgacaagaggccuucaggcaucccagaucgguuuagcgggaguaaauccggaaccucugcgacauugggcauuacugguuuacaaaccggggacgaggcugauuacuauuguggaacaugggacaccagccuguccgccggcggcguguucgggacuggaacaaagguaaccgugcua

SEQ ID NO: 25534 - RNA, 333 nt, Artificial Sequence
  derived and/or modified sequence opt3 from anti-HIV_048-204015_VR-Chain
cagagcgugcugacccaacccccuuccgccucuggcacaccagggcagagagucacuaucucaugcaguggaagcuccucuaacauugguucgaaguacguuuauugguaccagcagcucccgggcacggcucccaaacuucugauauauaagaaugacaacaggccuucagggaucccagaucgguucagcggaaguaaauccggcaccucugcaacauuggguauuagcggguuacaaacuggagacgaggccgauuacuauuguggcaccugggacacaucccugucaggcgggggaguguuugguaccggcacuaagguaacagugcua

SEQ ID NO: 25535 - RNA, 333 nt, Artificial Sequence
  derived and/or modified sequence opt3 from anti-HIV_048-201240_VR-Chain
cagagcgugcugacccaacccccuuccgucucugccgcuccaggccagaagguuacaaucucaugcagugggagcuccucuaacauuggaaauaacuacguggcaugguaucagcagcucccggguacugcccccaaacuucugauaaaggaaaauucgcaaagaccuucaggcaucccagacagguucagcgggaguaaauccggaacgucugcgaccuuggcuauuacaggcuuacagacuggugaugaggccgacuacuauugugggaccugggauacaagccuguccaccggaggcguauuuggcacugggacaaaggugaccguccua

SEQ ID NO: 25536 - RNA, 333 nt, Artificial Sequence
  derived and/or modified sequence opt3 from anti-HIV_048-200455_VR-Chain
cagagcgcccugacccaacccgcuuccgugucuggcucaccugggcagaguaucacaauuagcugcacuggaacguccucugacgucgguuacaacuauguuucgugguaccaggugcucccaggcaccgcaccgaaacuucugauauauaagaauacagagagacccucagggaucccugauagguucagcggaaguaaguccggcacuucugccaccuuggacauuacagguuuacagaccggggaugaagcggacuacuauuguggaacuugggauacaagccuguccgcuggcggcguauuugggaccggaacgaaagugacuguccua

SEQ ID NO: 25537 - RNA, 333 nt, Artificial Sequence
  derived and/or modified sequence opt3 from anti-HIV_048-200319_VR-Chain
cagagcguggucacccaacccccuuccgccucuggcacaccagggcagagaguuacuaucucaugcaguggaagcuccucuaacauugguucgaaguacguguauugguaccaccagcauccgggcacggcucccaaacugcucauauaugacaauaacaauaggccuucagggaucccagaucgguucagcggaaguaaguccggcaccucugcaacacuugguauuacugggcugcagaccggagacgaggccgauuacuauuguggcacaugggacaccagcuugucccgcggcgggguauuuggaacugguacaaaagugaccgucuua

SEQ ID NO: 25538 - RNA, 333 nt, Artificial Sequence
  derived and/or modified sequence opt3 from anti-HIV_048-197896_VR-Chain
cagagcgugcugacccaacccccuuccgucucugccgcuccaggccagaagguuacaaucucaugcaguggggcaagcuacaacauugguaaaaauuccgugucuugguaucagcagcucccgggaacucccccuaaacuucugauauucaagaacaaugagagaccaucgggcauccccgacagguuuucagggagcaagaguggaacguccgccaccuugggcauuacagguuuacaaacuggggaugaagcggacuacuauugugcuaccugggauacaucucugagcgccggaggcguauucggcaccgggacuaaagugacaguccua

SEQ ID NO: 25539 - RNA, 333 nt, Artificial Sequence
  derived and/or modified sequence opt3 from anti-HIV_048-193813_VR-Chain
cagagcgugcugacccaaucccccucugucucagccgcuccuggccagaagguuacaaucaguugcagcggguccaacucuaaugugggaaacuacuauguaucgugguaccagcaccucccagguacugcaccgaaagugcuuauuuaugagggcaauaagagacccucaggggucccugacagguucagcggaaguaaauccggcacgucugccagccuggcgauaaccgguuugcagacaggggaugaagcugacuacuauuguggaacuugggauaccuccuuaucagccggcggcguguuugggaguggaacaaagguuaccgugcug

SEQ ID NO: 25540 - RNA, 333 nt, Artificial Sequence
  derived and/or modified sequence opt3 from anti-HIV_048-192098_VR-Chain
cagagcgugcugacccaacccccuuccgccucuggcacaccagggcagagagucacuaucucaugcaguggaagcacguccaacauugguucuaauuacguuuauugguaccagcagcucccgggcaccacacccaaacuucugauauaugagaacaauaagaggccuucggggaucacugaccgguucuuuggaucaaagagcggcccaagugcuaccuuggauauuacagguuuacaaaccggggacgaagcagauuacuauuguggaacuugggacgccucccugucugcgggcggcguguucgggacaggaaccaaaguaacggugcua

SEQ ID NO: 25541 - RNA, 333 nt, Artificial Sequence
  derived and/or modified sequence opt3 from anti-HIV_048-191786_VR-Chain
cagagcgugcugacccaacccccuuccgucucugccgcuccaggccagaacguuaauaucucaugcagugggagcuccucuaacauugagaauaacuucgugucgugguaccagaagcucccgggaacagcacccaaacuucugauauaugacaauaacaagagaccuucagguaucagggaucgguuuagcggcaguaaauccgggacuucugccacguugggaauuaccggcuuacagacaggugacgaagcggauuacuauugugggacuugggacaccagccuguccgcuggaggcguauucggcucagggacaaaggugaccguccua

SEQ ID NO: 25542 - RNA, 333 nt, Artificial Sequence
  derived and/or modified sequence opt3 from anti-HIV_048-188746_VR-Chain
cagagcgugcugacccaacccccuuccgccucuggcacaccagggcagaaggucacuaucucaugcaguggaagcaacuccaauauugguucuaacuucguuucgugguaccagcuccuuccgggcacgacccccaaacuguugauauauagaaauaaccagaggccuucaggggugccagaccgguuuagcggaaguaaguccggcacaucugcuacuuuagguaucaccgggcugcaaacaggagaugaggcagacuacuauuguggcaccugggauagcucccuaucagccggcgggguauucggaacugguacaaaagugaccguccuc

SEQ ID NO: 25543 - RNA, 333 nt, Artificial Sequence
  derived and/or modified sequence opt3 from anti-HIV_048-185937_VR-Chain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacgagaauaacaagagaccuucaggcaucccauaucccauuagcgggaguaaauccggaacgucugccaccuugggcaucacagguuuacaaacuggggacgaagcggauuacuauuguggaaccugggacagcucccugucagcuggcggcguauucgggacaggaaccaaggugacuguccua

SEQ ID NO: 25544 - RNA, 333 nt, Artificial Sequence
  derived and/or modified sequence opt3 from anti-HIV_048-184849_VR-Chain
cagagcgugcugacccaagcccccuccgcuucuggcacaccugggcagacugucacgaucucaugcaguggaagcuccucuaacauugguaccaaguacguuuauugguaccagcagcucccaggcacagcaccgaaacuucugauauauaagaauaacgagagacccucggggaucccugacagguucucaggaagcaaaaguggcacuuccgccaccuuggguauuacaggguuacaaaccggagaugaagcggacuacuauuguggcacuugggauacaucucugagcccaggcgggguguuuggaaccgguacgaagguaacugugcua

SEQ ID NO: 25545 - RNA, 333 nt, Artificial Sequence
  derived and/or modified sequence opt3 from anti-HIV_048-183089_VR-Chain
cagagcgugcugacccaacccccuuccgccucuggcacaccagggcagagagucacuaucucaugcaguggaagcuccucuaacauugguucgucauacguuuauugguaccagcuccuuccgggcacgcccccuaagcuguugauauucaaaaauaacgagaggccaagcgggauccccgaccgguuuaguggauccaagucuggcaccagcgcuacauuagguauuacugggcugcagaccggagaugaagcagacuauuacuguggcacaugggauaccucccuaucagccggcgggguguucggaacugguacaaaaguaaccgugcuc

SEQ ID NO: 25546 - RNA, 333 nt, Artificial Sequence
  derived and/or modified sequence opt3 from anti-HIV_048-181509_VR-Chain
cagagcgugcugacccaacccccuuccgucucuggcgccccagggcagagaguuacaaucucaugcacuggaaguagcuccaacauugguggcuacgacgugcacugguaucaucagcucccgggggcugcacccaaacuucugauauacaagaaugauaacaggccuucuggaaucccagaccgguucucgggcucaaagagcgguacgagugccaccuuggggauuuccggauuacagacaggcgaugaggcggacuauuacuguggcacuugggauaccucucugagcgggggagguguauuuggcacagggaccaaagugacuguccua

SEQ ID NO: 25547 - RNA, 333 nt, Artificial Sequence
  derived and/or modified sequence opt3 from anti-HIV_048-180990_VR-Chain
cagagcgugcugacccaacccccuuccgucucugccgcuccaggccagagaguuacaaucucaugcagugggagcacuuccaacauuggaaauaacuacgugucuugguaucagcacuucccggguaagguacccaaaguggucauaucggagacgaccaagaggccuucaggcaucccagaccgguuuagcgggaguaaauccggaacaucugcaacucucggcauuaccggucuucagacaggggaugaagccgacuacuauuguggaaccugggauagcucccugucagcgggcggcguguucgggacuggaacaaagguuaccguguug

SEQ ID NO: 25548 - RNA, 333 nt, Artificial Sequence
  derived and/or modified sequence opt3 from anti-HIV_048-177532_VR-Chain
cagagcgcccugacccaacccccuuccgcuucuggcucacucgggcagagugugacaaucagcugcacuggaacguccucugacgucgguaacaauuucguuucgugguaccagaagaaaccaggcaaggcaccgaaacuuauuguguaugagguaaacaagagacccucagggauaccugauagguuuagcggaaguaaauccggcaccucugccacacuggguaucacuggguugcagaccggagacgaagcggauuacuauuguggcacaugggacaccagcuuauccacuggcgggguguucggaacagguaccaaggucacggugcug

SEQ ID NO: 25549 - RNA, 324 nt, Artificial Sequence
  derived and/or modified sequence opt3 from anti-HIV_048-177426_VR-Chain
cugacccagccccacagcguguccgagucuccuggcaagacagucacuaucucaugcacggggaccaguagcgacguuggauacaacuauguguccugguaccaacaucacccagguaaagccccgaagcuccuuauuuaugaaguaacaaaaagacccucuggcauaccugauagguucucggggucaaagagcggaaccagugcuacucugggcaucacagguuugcagaccggggacgaggcagauuacuauuguggaacuugggacuccucuuuaagcgccggcggcguguuugggacaggaaccaaagucacggugcug

SEQ ID NO: 25550 - RNA, 333 nt, Artificial Sequence
  derived and/or modified sequence opt3 from anti-HIV_048-177389_VR-Chain
cagagcgugcugacccaacccccuuccaugucugccgcuccaggcgagagagucacaaucucaugcagugggagcuccucuaacauuggaaaucaccauguuucgugguaccagcagaggccggguacugcacccaagcuccuuauauaugaaaacaaugagcggccuucaggcaucccagaccgcuucagcgggaguaaauccggaacgucugccacccugggcauuacagguuugcagacuggggaugaagcggacuacuauuguggaaccugggauaccagcuuauccgcuggcggcguguuugggucaggaacaaagguaacugugcug

SEQ ID NO: 25551 - RNA, 333 nt, Artificial Sequence
  derived and/or modified sequence opt3 from anti-HIV_048-174266_VR-Chain
cagagcgugcugacccaacccccuuccgucucuggcgccccagggcagagaguuacaaucucaugcaguggaagcuccucuaacauugguucgcacuacgugucaugguaucagcagguaccgggcacugcucccaggcucgugauauacgacacgaucaagcggcauagcgggauuccugaucgcuucaguggauccaaaucuggcaccagcgcaacacuugguaucacugggcugcaaaccggagacgaggccgauuauuacuguggcacaugggacaccuccuugucagcgggcggggucuuuggaacugguacaaaggugaccguuuua

SEQ ID NO: 25552 - RNA, 333 nt, Artificial Sequence
  derived and/or modified sequence opt3 from anti-HIV_048-172847_VR-Chain
cagagcgugcugacccaacccccuuccgucucugccgcuccaggccagagaguuacagugucaugcagugggagcacuuccaacaucgagucuaauuacguaucgugguaucaacaggugccgggaacggcacccaagcuccuuauuuacgaaaacaauaaaaggccuucagguauaccagaccgguucagcggcaguaaguccgggaccucugccacacugggaaucacuggcuugcagaccggugaugaggcggacuauuacugugggacaugggauaccagcuuauccgcuggaggcgucuuuggcacugggacaaaagugaccguucug

SEQ ID NO: 25553 - RNA, 333 nt, Artificial Sequence
  derived and/or modified sequence opt3 from anti-HIV_048-172845_VR-Chain
cagagcgcccugacccaacccccuuccgcuucuggcucaccagggcagagugugacaaucagcugcacuggaacguccucugacgucgguuacaacuauguuucgugguaccagcagcucccgggcaccgcacccaaacuucugauuuauagaaauaaccaaaggccuucaggggugccagaucgguucagcggaaguaaguccggcacaucugccacuuuggguauaaccggguuacagacaggagacgaggcggauuacuauugugcuaccugggacacuagccuguccgccggcggcguauuugggacaggaaccaaggugacgguccua

SEQ ID NO: 25554 - RNA, 333 nt, Artificial Sequence
  derived and/or modified sequence opt3 from anti-HIV_048-172363_VR-Chain
cagagcgugcugacccaacccccuuccgucucugccgcuccaggccagaagguuacaaucucaugcagugggagcggauccaacauugguaauacuuacgugucuugguaucagcagcucccgggcacggcacccaaacuucugauauucgaggacaacaagagaccuucggggaucccagauagguuuucaggaagcaaaaguggcaccuccgccacauuggcgauuacugguuuacaaaccggggacgaagcugauuacuauuguggaacaugggacucuagccuguccggcggcgggguaaucggaaccgguacuaagcuaacagugcuc

SEQ ID NO: 25555 - RNA, 333 nt, Artificial Sequence
  derived and/or modified sequence opt3 from anti-HIV_048-171609_VR-Chain
cagagcgugcugacccaacccccuuccgucucugccgcuccaggccaggagguuacaaucucaugcagugcaagcuccucuucgauugggaacgacuucgugucaugguaccagcagcucccgggaacugcccccaaacuucugauauaugguaauagcaacagaccuaguggcaucccagauagguuuuccgggucuaagagcggaacguccgcgaccuugggcauuacagguuuacaaacuggggacgaagcugauuacuauuguggaaccugggacacaucacugaguaccggcggcguauucgggacuggaacaaaggugaccguccua

SEQ ID NO: 25556 - RNA, 333 nt, Artificial Sequence
  derived and/or modified sequence opt3 from anti-HIV_048-170705_VR-Chain
cagagcgugcugacccaacccccuuccgucucugccgcuccaggccagaugguuacaaucucaugcagugggagcacuuccaacauuggaauaaauuacgugucuugguaucagcacguaccggguacggcacccaagcuccuuaucuacgagaacguggaaagaaggucgggcauuccugaccgguucucagccagcaaaagugcgaccuccgcuacacuggggaucacuggauugcagaccggcgaugaggccgacuauuacugugguacaugggauaccucuuuaagcgcagggggagucuuuggcuccggcacuaaggugacaguucug

SEQ ID NO: 25557 - RNA, 333 nt, Artificial Sequence
  derived and/or modified sequence opt3 from anti-HIV_048-168381_VR-Chain
cagagcgcccugacccaacccgcuuccgugucuggcucaccugggcagaguaucacaauuagcugcacuggaacguccucuaacauagguucgaauuacgucucaugguaucagcagcucccaggcaccgcaccgaaacuucugaucuacgagaacaaucaaagacccagcgggauuccugacagguucaguggauccaagucuggcacaagcgccacuuuggguaucaccggguuacagacaggagaugaagcggacuauuacuguggcaccugggauacuucccugucagcuggcgggguuuuuggaagugguacaaaggugaccguacua

SEQ ID NO: 25558 - RNA, 333 nt, Artificial Sequence
  derived and/or modified sequence opt3 from anti-HIV_048-166619_VR-Chain
cagagcgugcugacccaacccccuuccgucucuggcgcgccagggcagagaguuacaaucucaugcacuggaaguagcuccaacauugguggcuaccacacgcauugguaucagcagcucccggggaccgcucccaaacuucugauauacgaaaauucuaagaggccuucgggaaucccagaccgguucucaggcagcaagagugguacauccgcaacuuuggggauuaccggauuacaaacaggcgaugaggccgacuauuacuguggcaccugggauacuucucugagcgccgggggaguguuugguuccggcacaaaaguaaccgugcua

SEQ ID NO: 25559 - RNA, 333 nt, Artificial Sequence
  derived and/or modified sequence opt3 from anti-HIV_048-162036_VR-Chain
cagagcgugcuggcccaacccccuuccgucucuggcgcuccagggcagaccguuacaaucucaugcacuggaaguagcuccaacauugguggcuacgacgugcacugguaucagcagcucccggggacggcacccaaacuucugauauacaaggaugacaagcggccuucuggaaucccagauagguucucgggcucaaaaagcgguaccagugccacauuggggauuacuggauuacaaaccggcgacgaggcggauuauuacuguggcacaugggacaccucccugaauagagggggaguauuugguacuggcacaaaggugaccguccua

SEQ ID NO: 25560 - RNA, 333 nt, Artificial Sequence
  derived and/or modified sequence opt3 from anti-HIV_048-160042_VR-Chain
cagagcgugcugacccaacccccuuccgucucugccgcuccaggccagaagguuacaaucucaugcagugggagcuccucuaacauuggaauaaauuacaucucgugguaucagcagcucccggguacugcacccaaaauucuuaucuacgacaacgauaagagaccucugggcauuccagacagguucucagggagcaaaaguggaacguccgccaccuugggcaucacagguuuacaaacuggggaugaggcggacuauuacuguggaaccugggaugcuucucugagcgccggcggcguguuugggacaggaaccaagguaacugugcua

SEQ ID NO: 25561 - RNA, 333 nt, Artificial Sequence
  derived and/or modified sequence opt3 from anti-HIV_048-159676_VR-Chain
cagagcgugcugacccaacccccuuccgucucugccucaccaggccagaagguuacaaucaguugcagcggguccucuucggacauuggaucaaacuacgugagcugguauguacagcucccggguacugcucccaaacuucugauauacaagaauaacgagagaccuaguggcaucccagauagguucuccgggucuaaaagcggaacguccgcaaccuugggcauuacagguuuacagacuggggacgaagccgauuauuacuguggaaccugggacacaucacugagugcgggcggcguguuugggaccggaacuaaggucacagugcua

SEQ ID NO: 25562 - RNA, 333 nt, Artificial Sequence
  derived and/or modified sequence opt3 from anti-HIV_048-159500_VR-Chain
cagagcgugcugacccaacccccuuccgucucugccgcuccaggccagaacguuacaaucucaugcagugggagcugguccaauauuggagcaaacuacgugucuugguaucagcagcucccggguacugcccccaaacuucugauauacgagaauaacaagagaccuucgggcaucccagacagguucucagggagcaagaguggaacguccgcgaccuugggcuuuacagguuuacaaacuggggaugaagcugacuauuacuguggaaccugggauacaucucugagcgccggcggcguauucgggaccggaacuaaagugacaguccua

SEQ ID NO: 25563 - RNA, 333 nt, Artificial Sequence
  derived and/or modified sequence opt3 from anti-HIV_048-159421_VR-Chain
cagagccugcucacccaagcccccuccgugucugcugcaccuggccagacagucacuaucucaugcagugggagcaacgccgacauuggaaagaauuucguuuccugguaccagcagucuccaggugcggcuccgaaacuucugauauaugagaacgauagaaggcccucgggcaucccugaccgguuuucagggagcaagaguggaacguccgccaccuugggcauuacagguuuacaaacuggggaugaagcagaguacuauugugccaccugggacgcuucucugagcggaggcggcguguucgggacaggaaccaaaguaacugugcua

SEQ ID NO: 25564 - RNA, 333 nt, Artificial Sequence
  derived and/or modified sequence opt3 from anti-HIV_048-159333_VR-Chain
cagagcgugcugacccaacccccuuccgccucuggcacaccagggcagagagucacuaucucaugcaguggaagcaacuccaauauugguucugacucgguuuacugguaucagcagcucccgggcaggucacccaaacuucugauauaccggaacaaugagcgcccuagcgggaucccagaucgauucaguggauccaagucuggcacgagcgcuaccuuggguauuacaggguuacaaacuggagacgaagcagauuauuacuguggcaccugggacacaucccugucagccggcgggguguuuggaaccgguacuaagguaacagugcua

SEQ ID NO: 25565 - RNA, 333 nt, Artificial Sequence
  derived and/or modified sequence opt3 from anti-HIV_048-158932_VR-Chain
cagagcgugcugacccaacccgccuccgucucuggcucaccugggcagaguaucacaauuagcugcuccggaucuucgucaaacauaggugacaucuucguuagcugguaccaacaggugccaggcgcugcaccgaagcuccuuauuuaugauaaugacaaaagacccagugggaucccugauagguuuuccggaucuaagagcggcacuuccgccacgcuggacauuaccgguuugcagacaggggaugaggcggacuacuauuguggaacuugggauaccucauuaagugcuggcggcguauucgggacaggaaccaaagugacuguccug

SEQ ID NO: 25566 - RNA, 333 nt, Artificial Sequence
  derived and/or modified sequence opt3 from anti-HIV_048-155811_VR-Chain
cagagcgcccugacccaacccgcuuccgugucuggcucaccugggcagaguaucacaauuagcugcacuggaacguccucugacgucgguuacgauuauguuucgugguaccagcuccuuccaggcaccccgcccaagcuguugauauucaaaaacaaugagagaccuucagggaucccagacagguuuagcggaaguaaguccggcacaucugcaacuuuagguauuaccgggcugcagacaggagaugaagccgacuauuacugugcgaccugggauacuagccuauccgcuggcggcguguucgggacaggaaccaaaguaacggugcuc

SEQ ID NO: 25567 - RNA, 333 nt, Artificial Sequence
  derived and/or modified sequence opt3 from anti-HIV_048-155464_VR-Chain
cagagcgcccugacccaacccgcuuccgugucuggcucaccugggcagaguaucacaauuagcugcacuggagcaacgggugacuccggccacaccuacgucucuugguaucagcagcucccagggacagccccgaaacuucugauauacucgaacaaugagagacccucaggaguuccugauagguucagcggcaguaaguccgguacuucugcgaccuuggggaucacaggauuacaaaccggcgacgaagcugauuauuacuguggcacuugggacacaagccuguccgccgggggaguguuugguucaggcaccaagguaacggugcua

SEQ ID NO: 25568 - RNA, 333 nt, Artificial Sequence
  derived and/or modified sequence opt3 from anti-HIV_048-155392_VR-Chain
cagagcgugcugacccaacccccuuccgucucugccgcuccaggccagaugguuacaaucucaugcagugggagcuccucuaacauuggagacaauuacgugucgugguaucagcagcucccggguagaggccccaaacuucugguauacgauacuuauaagagguacuuggagacgccugaccgguucucagggagcaagaguggaaccuccgcaacauuaggcauaacuggucugcaaaccggggaugaagccgacuauuacuguggaacaugggauaccucucuaagcgcgggcggcguguuugggacuggaacaaaagucaccgugcuc

SEQ ID NO: 25569 - RNA, 333 nt, Artificial Sequence
  derived and/or modified sequence opt3 from anti-HIV_048-155389_VR-Chain
cagagcgugcugacccaacccccuuccgucucugccgcuccaggccagaagguuacaaucucaugcagugggauuagcuccaacauaggaaauaacccggugucuugguaccagcaguuccccgguacugcaccuaaacuccuuaucuauaagaaugacaaaagaccaucgggcauucccgauagguuuucagggagcaagaguggaacguccgccacccugggcaucacagguuugcaaacuggggacgaggcggauuacuauuguggaaccugggacacaucuuuaagcaccggcggcguauucgggacuggaacaaaagugaccguccug

SEQ ID NO: 25570 - RNA, 333 nt, Artificial Sequence
  derived and/or modified sequence opt3 from anti-HIV_048-154449_VR-Chain
cagagcgugcugaagcaacccccuuccgucucuggcgccccagggcucagaguuaccaucucaugcacaggagguaguagcaacauuggcggguucgacgugcacugguaccagcauuuuccgggaacugcucccaaacuucugauauaugauaaugaccagaggccuuccggcaucccagaucgguucucugguucgaagucagggacgagcgcaaccuugggaauuacaggcuuacagacuggcgacgaggccgauuacuauugugggaccugggacaguucccugucugcgggagguguauuuggcacagggaccaaagugacuguccua

SEQ ID NO: 25571 - RNA, 333 nt, Artificial Sequence
  derived and/or modified sequence opt3 from anti-HIV_048-153379_VR-Chain
cagagcgugcugacccaacccccuuccgucucugccacaccaggccagaagguuacuaucucaugcagugggagcagauccaacauuggaucucacuacgugucgugguaucagcaguucccggagucagcucccaaacuccuuauauacaagaaugacaacaggccuagcgguaucccagaucgguuuaguggcuccaaaucugggacgagcgcaacccugggaauuuccggcuugcaaacaggugacgaagccgauuauuacugugggacuugggacaccucauuaaguggaggcggcguauucgggacaggaaccaaggugacuguccug

SEQ ID NO: 25572 - RNA, 333 nt, Artificial Sequence
  derived and/or modified sequence opt3 from anti-HIV_048-153171_VR-Chain
cagagcgugcugacccaacccccuuccgucucugccgcuccaggccagaagguuacaaucucaugcagugggagcacuuccaacauugaggacauauacgugucuugguaucagcaccucccgggaacggcacccaaacuucugaucuacgauaauaacaagagaccuucggguauuccagacagguucucaggcagcaaaagugggaccuccgccacauuggcgaucacuggauuacagaccggcgaugaagcugacuauuacugugguacaugggauaccucucugagcgccgggggaguauuuggcacuggcacaaaggugaccguccua

SEQ ID NO: 25573 - RNA, 333 nt, Artificial Sequence
  derived and/or modified sequence opt3 from anti-HIV_048-152324_VR-Chain
cagagcauggugacccaaucccccucugucucagccgcuccuggccagaagguuacaaucaguugcagcgggacuuccucuaacauuggacagaauuacgugucgugguaucagcaacugccagguacggcaccgaaacuccuuauauacgagaacucaaagagacccagcggcaucccugacagguucaguggguccaaaucuggaaccagcgccacacugggcauuacugguuugcagaccggggaugaagcggacuauuacuguggaacaugggauaccuccuuaucagcuggcggcguauuugggaguggaacuaaggugacaguccug

SEQ ID NO: 25574 - RNA, 333 nt, Artificial Sequence
  derived and/or modified sequence opt3 from anti-HIV_048-146102_VR-Chain
cagagcgugcugacccaacccccuuccgucucugccgcuccaggccagaagguuacaaucucaugcagugggagcuccucuacuauuggaaacaauuacauaucgugguaucagcuccuuccggguacgcccccuaaacuguugaucuacaagaacaaugagagaccaucaggcauucccgacagguucagcgggaguaaauccggaaccucugcaacauuaggcaucacuggucugcagaccggggaugaagccgacuauuacuguggaacaugggauaccagccuauccgcgggcggcguguuugggacuggaacaaagguaaccgugcuc

SEQ ID NO: 25575 - RNA, 333 nt, Artificial Sequence
  derived and/or modified sequence opt3 from anti-HIV_048-145984_VR-Chain
cagagcgugcugacccaaccccucuccgucucuggcgccccugggcagagaguuacaaucucaugcacuggaaguagcuccaacauugguucuaauuucgugucgugguaccagguacuuccaggcacgaccccgaagcuguugauauuuaaaaacaaugagaggcccucagggaucccugaccgguucagcggaaguaaguccggcacaucugcuacuuuagguauuaccgggcugcagacaggagaugaagcagacuauuacuguggcgccugggauaccagccuauccgcgggcgggguguuuggaacugguacaaaagucaccgugcuc

SEQ ID NO: 25576 - RNA, 333 nt, Artificial Sequence
  derived and/or modified sequence opt3 from anti-HIV_048-145371_VR-Chain
cagagcgugcugacccaacccccuuccgucucugccgcuucaggccagaagguuaguaucccaugcagcgggggaacauccaacauuggugacaauuacgugucuugguuccagcaguuuccgggcucggcacccaaaauacucaucuaugauucagacaagagaccuagcaggauuagugaucgguucuccgccucuaaaagcgggacuuccgcgacgcuugacaucacccgccugcaaacaggagaugaggcugacuacuauuguggcacuugggauaccucauugagugccggugggguauuuggaacaggcaccaaggugacugucuua

SEQ ID NO: 25577 - RNA, 333 nt, Artificial Sequence
  derived and/or modified sequence opt3 from anti-HIV_048-144907_VR-Chain
cagagcgcccugacccaacccgcuuccgugucuggcucaccugggcagaguaucacaauuagcugcacuggaacgagaagggacgucgguuucaacuacguuuccugguaucagcagcacccaggcaccgcaccgaagcuccuuauauacgagaauaacaaacggcccucugggaucccugaucgcuuuucgggaucaaagagcggcacaagugccacucuggguauuaccggguugcaaacaggagacgaagcggauuauuacuguggcaccugggacuccucuuuaagcgcuggcgggguguucggaacugguacaaaaguaaccgugcug

SEQ ID NO: 25578 - RNA, 333 nt, Artificial Sequence
  derived and/or modified sequence opt3 from anti-HIV_048-142298_VR-Chain
cagagcgugcugacccaacccccuuccgccucuggcacaccagggcagagagucacuaucucaugcaguggaagcuccucuacgauugguaacaauuacauaucgugguaucagcuccuuccgggcacacccccuaagcuguugaucuucaaaaacaaugagaggccaucagggauucccgaccgguuuagcgcuaguaaguccggaaccucugcaacuuuaggcaucaccggucugcagacaggggaugaagccgacuacuauuguggaaccugggauacuagccuauccgcgggcggcguuuucgggacaggaaccaaagugacgguacuc

SEQ ID NO: 25579 - RNA, 333 nt, Artificial Sequence
  derived and/or modified sequence opt3 from anti-HIV_048-142277_VR-Chain
cagagcgugcugacccaacccccuuccgucucuggcgccccagggcagagaaucacaauuucaugcacuggaaguagcuccaacauaggugcuuacgacguucagugguaucagcaccucccgggcacggcacccaaacuucugaucuacaagaauaccgagaggccuucugggauuccagaucgguucucgggaucaaagagcggcacaagugccacuuuggacaucaccgguuuacaaacaggggaugaagcggacuauuacuguggaaccugggauacuucccugucugcuggcggcguguuugggacaggaaccaaaguaacggugcua

SEQ ID NO: 25580 - RNA, 333 nt, Artificial Sequence
  derived and/or modified sequence opt3 from anti-HIV_048-141934_VR-Chain
cagagcgugcugacccaacccccuuccgucucuggcgccccagggcagagaguuacaaucucaugcacuggaaacaguagcaauauuggugcuuacgacgugcacugguaucagcagcucccgggcacggcacccaaacuuaugauauacgagguauccaagaggccuucugggaucccagaucgguucucgggaucaaagagcggcaccagugccacacuggguauuacuggguugcaaaccggagacgaagcggauuauuacuguggcacaugggacaccuccuuaucugcuggcgggguguuuggaagcgguacuaaagucacagugcug

SEQ ID NO: 25581 - RNA, 333 nt, Artificial Sequence
  derived and/or modified sequence opt3 from anti-HIV_048-141207_VR-Chain
cagagcgugcugacccaacccccuuccgucucugccgcuccaggccagaagguuacaaucgcaugcucagggaguagcuccaacauuggaaauaacuacgugucuugguaucagcagcucccggguacugcccccaaacuucugauauacgcgaauaacagaaggccuucgggcaucccagaccgguucucagcuagcaagagugggacguccgccaccuugggaauuacaggcuuacaaacuggugaugaggcagacuauuacugugggaccugggauacaucucugagcgccggaggcguauuuggcaccgggacuaaagugacaguccua

SEQ ID NO: 25582 - RNA, 333 nt, Artificial Sequence
  derived and/or modified sequence opt3 from anti-HIV_048-140796_VR-Chain
cagagcgugcugacccaacccccuuccgucucugccacaccaggccagaagguuacuaucucaugcagugggacgagaagcaacauuggaaauaacuacguguccugguauaggcaguucccggguaccgcucccaaacuccuuauauacgaggacaauaagcggccuucuggcaucccagcacgcuuuucggggucaaaaagcggaacaagugccacucugggcauuaccgguuugcagacaggggaugaagcggacuauuacuguggaaccugggauacuuccuuaucugcuggcggcguauucgggacaggaaccaaggugacgguccug

SEQ ID NO: 25583 - RNA, 333 nt, Artificial Sequence
  derived and/or modified sequence opt3 from anti-HIV_048-139893_VR-Chain
cagagcgugcugacccaacccccuuccgucucugccacaccaggccagaagguuacuuucucaugcagugggagcuccucuacgaucggaaagaacuacgugucgugguaucagguacucccggguaccgcucccaaacuucugauuuacaaaaauaacaagagaccuucaggcauaccagacagguuuagcgggaguaaauccggaacaucugcaacuuugggcaucaccgguuuacagacaggggaugaggccgacuauuacuguggaaccugggauagcucccugucagcgggcggcguguucgggacuggaacaaaggucaccgugcua

SEQ ID NO: 25584 - RNA, 333 nt, Artificial Sequence
  derived and/or modified sequence opt3 from anti-HIV_048-138820_VR-Chain
cagagcgugcugacccaacccccuuccgucucuggcgccccagggcagaagguuacaaucucaugcaguggaagcgguuccaacauuggcaauacuuacgugucuugguaucagcaccucccggggacggcucccaaacuucugauauacgagaacaauaagagaccuucgggaaucccagacagguucucaggcagcaaaagugcaaccuccgccacauuggguauuacuggguuacagaccggagaugaagcggacuauuacuguggcacaugggauaccucucugagcgcuggcgggguauuuggaacugguacaaaggugaccguccua

SEQ ID NO: 25585 - RNA, 333 nt, Artificial Sequence
  derived and/or modified sequence opt3 from anti-HIV_048-135858_VR-Chain
cagagcgugcugacccaacccccuuccgccucuggcacaccagggcagagagucacuaucucaugcaguggaagcuccucuaacauugguucgucauacguuuauugguaccagcaguucccgggcaggagcccccggcuccuuauauaucgcaauaacgagcgaccuagugggaucccagaccguuuuuccggaucuaagagcggcacguccgcuacccuggguauuacaggguugcaaacuggagaugaagcagacuacuauuguggcaccugggauacaucauuaagugccggcgggguguucggaaccgguacuaaaguaacagugcug

SEQ ID NO: 25586 - RNA, 333 nt, Artificial Sequence
  derived and/or modified sequence opt3 from anti-HIV_048-134968_VR-Chain
cagagcgugcugacccaacccccuuccgucucugccgcuccaggccagaagguuacaaucuucugcucagggaguagcuccaacauuggaaagaauuacgugucuugguaucagcagcucccggguacugcacccaaacuucugauauacgagaacucgaaaagaccuucaggcaucccagacagguuuagcgggaguaaguccggaacgucugccaccuugggcauuacagguuuacaaacuggggaugaagcggacuauuacuguggaaccugggauacaagccuguccgcuggcggcguauucgggucaggaaccaaagugacuguccua

SEQ ID NO: 25587 - RNA, 333 nt, Artificial Sequence
  derived and/or modified sequence opt3 from anti-HIV_048-134312_VR-Chain
cagagcgugcugacccaacccccuuccgccucuggcacaccagggcagagagucacuaucucaugcaguggaagcuccucuaacauugguaauaacuacguuucgugguauaggcuccuuccgggcacggcucccaagcuguugauauacaaaaaugacaaccggccuucagggaucccagaucgcuucagcggaaguaaguccggcaccucugcaacauuagguauuagcgggcugcagacuggagacgaggccgauuauuacuguggcaccugggacacaucccuaucaggcgggggaguguuugguaccggcacuaaaguaacagugcuc

SEQ ID NO: 25588 - RNA, 330 nt, Artificial Sequence
  derived and/or modified sequence opt3 from anti-HIV_048-132253_VR-Chain
agcgcccugacccagcccgcuuccgugucuggcucaccugggcaaaguaucgcaauuagcugcacaggaacuuccucugacgucgguuacgaucucguuucgugguaucagcagcacccaggcacggccccgaaacuucugauauacgacaacaauaagagacccucagggaucccugauagguucagcggaaguaaguccggcaccucugcgacauuggguauuacuggguuacagaccggagacgaggcugauuauuacuguggcacaugggacaccagccuguccgccggcgggguguuuggaucagguacuaaaguaacagugcua

SEQ ID NO: 25589 - RNA, 333 nt, Artificial Sequence
  derived and/or modified sequence opt3 from anti-HIV_048-130710_VR-Chain
cagagcgugcugacccaacccccuuccgucgcgggcgcuccagggcagagaguuacaaucucuugcacuggaaacacgucaaauauugguggcuacgacgugcacugguaucagcagcucccggggacacccccuaaacuucugauauucaagaacaaugagaggccaaguggaauccccgaucgguuuagcggcuccaagucugguaccucggcaacuuuggggauuaccggauuacaaacaggcgacgaagccgauuacuauuguggcaccugggacacuucacugagcgccgggggaguauucgguacaggcaccaaagugacgguccua

SEQ ID NO: 25590 - RNA, 333 nt, Artificial Sequence
  derived and/or modified sequence opt3 from anti-HIV_048-128564_VR-Chain
cagagcgugcugacccaacccccuuccgccucuggcacaccagggcagagagucacuaucucaugcaguggaagcuccucuaacauugguucgaauacgguuaacugguaccagcagcucccgggcaccgcucccaaacuucugauauauaagaauacagagaggccuucagggaucccagaccgguucagcggaaguaaguccggcacuucugcaaccuuggauauuacagguuuacaaaccggggacgaagccgauuacuauuguggaacuugggacacaagccuguccgcgggcggcguguuugggaccggaacgaaaguaacugugcua

SEQ ID NO: 25591 - RNA, 333 nt, Artificial Sequence
  derived and/or modified sequence opt3 from anti-HIV_048-126702_VR-Chain
cagagcgugcugacccaacccccuuccgccucugcugcaccaggccagagagucacaaucucaugcagugggagcaacuccaauauuggaaacaauuacguuucuugguaucagcagcucccggguacugcccccaaacuucugauauacgacaacucgaagaggccuucaggcaucccagaucgguucagcgcgaguaaguccgggacgucugcuaccuugggaauuacaggcuuacaaacuggugacgaggccgauuauuacugugggaccugggacacaagccuguccgcaggaggcguguuuggcaccgggacuaaaguaacagugcua

SEQ ID NO: 25592 - RNA, 333 nt, Artificial Sequence
  derived and/or modified sequence opt3 from anti-HIV_048-124521_VR-Chain
cagagcgugcugacccaacccccuuccgucucuggcgccccagggcagagaguuacaaucucaugcacuggaaguagcuccacguucgguggcuacgacguguauugguaccagcagauuccggggaccgcucccaagcuccuuauauaugagaacaauaaaaggccuucuggaaucccagaucgguuuucgggcucaaagagcgguacaagugcaacucuggccauuaccggguugcaaacaggagacgaagcggauuacuauuguggcaccugggacggcuccuuaucuacugggggaguaaucgguacaggcaccaaagugacgguccug

SEQ ID NO: 25593 - RNA, 333 nt, Artificial Sequence
  derived and/or modified sequence opt3 from anti-HIV_048-122740_VR-Chain
cagagcgugcugacccaacccccuuccaugucugccgcuccaggccagucagucacaaucaguugcagcggguccacuuucaauauugagaagcaccagguuacguggcucagacaucuuccgggaaccgcacccacaucugugauaaucaugaacucgcagaggccuucagguacuccagaccgguuuagcggcaguaaauccgggaccucugccacacuggcgauuaccggauugcaaacuggcgaugaagcugacuacuauugugguacaugggaugggagcuuauccaccggaggcguaaucggcacggggacuaaggugaccguccug

SEQ ID NO: 25594 - RNA, 327 nt, Artificial Sequence
  derived and/or modified sequence opt3 from anti-HIV_048-119536_VR-Chain
gagcugacccagagccccuccgugucugccgcuccuggcgaaaaggucacaaucucaugcagugggacuaacagcaauauuggauacuauuacguuuccugguaucaacaguucccagguacggcaccgaaagugguaauauacgagaacaccaagagacccucuggcaucccugacagguuuucggggucaaaaagcggaacaagugccacucucggcauuaccggucuucagacaggggaugaagcggacuauuacuguggaaccugggauacuucccugucugcuggcggcguguucgggagcggaacaaaggucaccguguug

SEQ ID NO: 25595 - RNA, 333 nt, Artificial Sequence
  derived and/or modified sequence opt3 from anti-HIV_048-116929_VR-Chain
cagagcgugcugacccaacccccuuccgucucuggcgccccagggcagagaguuacaaucucaugcacuggaaguagcuccaacauuggugacuacgaugugcacugguaucagcagcucccgggcacggcucccaaacuucugauauacaggaauaaccaacggccuucugggguaccagaccgcuucucgggaucaaagagcggcaccagugcaacauuggguaucacuggguuacagaccggagaugaggccgacuauuacuguggcacaugggaugcgucccugucugcuggcgggguguuuggaaccgguacuaaggucacagugcua

SEQ ID NO: 25596 - RNA, 333 nt, Artificial Sequence
  derived and/or modified sequence opt3 from anti-HIV_048-116577_VR-Chain
cagagcgugcugacccaacccccuuccgccucuggcacaccagggcagagagucacuaucucaugcaguggaagcuccucuaacauugguucgaauuacguuucaugguaucaggugcucccgggcacggcucccaaacuucugauauacaagaacaauaagaggccuagcgggaucccagaccgguucaguggauccaaaucuggcaccagcgcaacauuggguauuacuggguuacagaccggagaugaggccgacuauuacugugcgacaugggauaccucccugucagcuggcggcguauuugggacuggaacaaaggugaccguccua

SEQ ID NO: 25597 - RNA, 333 nt, Artificial Sequence
  derived and/or modified sequence opt3 from anti-HIV_048-116046_VR-Chain
cagagcgugcugacccaacccccuuccgucucuggcgccccagggcagagaguuacaaucucaugcacuggaaguagcuccaacauugguggcuacgacgugcacugguaucagcaguucccggggacggcucccaagcuccuuauauacgauaaugacaaaaggccuucuggaaucccagaucgguuuucgggcucaaagagcgguaccagugcaacacuggggauuacuggauugcaaaccggcgacgaggccaacuauuacuguggcgcgugggauacauccuuaucugcugggggaguauucgguaccggcacuaaagugacaguccug

SEQ ID NO: 25598 - RNA, 333 nt, Artificial Sequence
  derived and/or modified sequence opt3 from anti-HIV_048-115875_VR-Chain
cagagcgugcugacccaacccccuuccgucucugccgcuccaggccagagaguuacagugucaugcagugggagcuccucuaacaucggaaauaacuucguaucgugguaccagcaccucccggguacugcacccaaacuucugauuuaugacaauucaaacaggccuagcggcauaccagaucgguuuaguggguccaagucuggaacgagcgccaccuugggcaucacagguuuacauacuggggacgaggcggauuacuauuguggaaccugggacacaucccugucagcuggcggcguguucgggaguggaaccaaggucacugugcua

SEQ ID NO: 25599 - RNA, 333 nt, Artificial Sequence
  derived and/or modified sequence opt3 from anti-HIV_048-115599_VR-Chain
cagagcgugcugacccaacccccuuccgucucugccgcuccaggccagaugguuacaaucucaugcagugggagcuccucuaacauuggaucgcacucagugagcugguaccagcauuucccggguacugcacccaagcucguaauagaggaaaaugaccagagaccuaguggcaucccagauagguuuuccgggucuaaaagcggaacguccgccacccuuggcauuacaggucugcaaacuggggacgagggagauuauuacuguggcaccugggacacaucauugaguggcgggggaguguucgguaccggcacuaaggucacaguguua

SEQ ID NO: 25600 - RNA, 333 nt, Artificial Sequence
  derived and/or modified sequence opt3 from anti-HIV_048-113988_VR-Chain
cagagcgugcugacccaacccccuuccgucucugccgcuccaggccagaugguuacaaucucaugcagugggagcucccacaacauuggagagaauuacgugucuugguaucagcaucucccggguacugcacccaaacuucugauauucaagaacaaugaaagaccuucgggcaucccagacagguuuucagggagcaagaguggaacguccgccaccuugggcauuacagguuuacagacuggggaugaggcggacuacuauuguggaaccugggauacaucucugagcgcuggcggcguauucgggaccggaacuaaagugacaguccua

SEQ ID NO: 25601 - RNA, 333 nt, Artificial Sequence
  derived and/or modified sequence opt3 from anti-HIV_048-112989_VR-Chain
cagagcgugcugacccaacccccuuccgccucuggcacaccagggcagagagucacucucucaugcaguggagguagcuccaacaucggcaaugacaacguuuacugguaucagcagaggccggggacgacccccaaacuucugauuuacaaugauaaccggcgcccuucuggaacaccagaccgauucucgggcucaaagagcgguaccagugcuacuuuggcaauaacaggguuacaaaccggagaugaggccgacuauuacuguggcacuugggauggcucccugucuacagggggagugaucgguaccggcacgaagguaacugugcua

SEQ ID NO: 25602 - RNA, 333 nt, Artificial Sequence
  derived and/or modified sequence opt3 from anti-HIV_048-112435_VR-Chain
cagagcgugcugacccaacccccuuccgucucugccgcuccaggccagaagguuucaaucaguugcagcggguccucuucgaacauuggaaagaauuacgugucaugguaucagcagcucccggguacagcacccaaacuucugauauucaaaaacaaugagagaccuagcggcaucccagacagguuuaguggguccaagucuggaacuagcgccacguugggcauuaccgguuuacaaacaggggaugaagcggacuacuauugugcuacuugggauaccucccugucagccggaggcguauucggcacagggaccaaagugacuguccua

SEQ ID NO: 25603 - RNA, 333 nt, Artificial Sequence
  derived and/or modified sequence opt3 from anti-HIV_048-111339_VR-Chain
cagagcgugcugacccaacccccuuccgucucugccgcuccaggccagaagguuacaaucucaugcacugggaguagcuccaacauuggagguuacgcagugcacugguaucagcagguaccggccacggcgcccaaacuccuuauauacgagaauaacgaaagaccuucuggcaucccagacagguucucggggucaaagagcggaaccagugcuacacugggcauuacugguuugcaaaccggggaugaggccgacuauuacuguggaacaugggauaccuccuuaucugcaggcggcguguuugggacuggaacaaaagucaccgugcug

SEQ ID NO: 25604 - RNA, 333 nt, Artificial Sequence
  derived and/or modified sequence opt3 from anti-HIV_048-111055_VR-Chain
cagagcgcccugacccaacccgcuuccgugucuggcucaccugggcagaguaucacaauuagcugcacuggaacgagauccgacgucgguuacaacuauguuucuugguaccagcagcacccaggcaaggcaccgaaacuccuuauauaugagaauaccaagaggcccucggggaucccugaucgguucucaggaagcaaaaguggcacauccgccacucuggguauuaccggguugcaaacaggagacgaagcggauuacuauuguggcaccugggacacuucuuuaagcgcuggcgggguguuuggauccgguacaaagguaaccgugcug

SEQ ID NO: 25605 - RNA, 333 nt, Artificial Sequence
  derived and/or modified sequence opt3 from anti-HIV_048-111027_VR-Chain
cagagcgugcugacccaacccccuuccgucucugccgcuccaggccagaagguuacaaucucaugcagugggagcaacuccaaucucggaaacaauuacgugucuugguaucagcaccuuccggguacugcacccagacuguugauuuacgaggacaaaaagaggccuucgggcauaccagaucgguucucagggagcaaaaguggagccuccgcgacguuagacaucaccggccugcagacaggugaugaagcugacuauuacugugggauuugggauacuucucuaagcgccggaggcguauuuggcaccgggacaaaggugaccguccuc

SEQ ID NO: 25606 - RNA, 333 nt, Artificial Sequence
  derived and/or modified sequence opt3 from anti-HIV_048-109721_VR-Chain
cagagcgugcugacccaacccccuuccgucucugccgcuccaggccagaagguuacaaucucaugcagugggagcuccucugacauuggaucgaacuucgugucaugguaccagcaccucccggguacugcacccagacuucugauauaugagaauaacaggcggccuagcggcaucccagaucgcuuuaguggguccaaaucuggaacgagcgccaccuuggcgauuacaggcuuacagacuggugacgaagcugauuacuauugugggaccugggacacaucccugaaucgaggaggcguauucggcaccgggacuaaggugacaguccua

SEQ ID NO: 25607 - RNA, 333 nt, Artificial Sequence
  derived and/or modified sequence opt3 from anti-HIV_048-109666_VR-Chain
cagagcgugcugacccaacccccuuccaugucugccgcuccaggcgagagagucacaaucucaugcagugggagcuccucuaacauuggaaaucaccauguuucgugguaccagcagaggccggguacugcacccaagcuccuuauauaugaaaacaaugagcggccuucaggcaucccagaccgcuucagcgggaguaaauccggaucuagcgccacgcuggcgauuaccggcuugcagacaggugaugaagcugacuacuauugugggacuugggauggacgauuaaacaucggcggcgugauugggaccggaacaaagguaaccgugcug

SEQ ID NO: 25608 - RNA, 333 nt, Artificial Sequence
  derived and/or modified sequence opt3 from anti-HIV_048-109196_VR-Chain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacgagacgaauaagagaccuucaggcaucccagacagguucagcgggaguaaauccggaaccucugccacauuggcgauuacuggcuuacaaaccggugaugaagcugacuauuacugugggacaugggauaccagccuguccggaggcggcguauuugggacuggaacaaaggugaccguccua

SEQ ID NO: 25609 - RNA, 333 nt, Artificial Sequence
  derived and/or modified sequence opt3 from anti-HIV_048-109051_VR-Chain
cagagcgugcugacccaacccccuuccgucucugccgcuccaggccagaagguuacaaucucaugcagugggaacaauagcaacauggugaauaacuacauuuccugguaucagcuccuuccgggaacucccccuaaacuguugauauucaagaauaacgagagaccaucugguauccccgacagguuuucgggcucaaaaagcgggacgagugcaaccuuaggaauuacaggccugcagacuggugaugaagccgacuacuauugugggaccugggauacaucccuaucugcgggaggcguauucggcaccgggacuaaggugacaguccuc

SEQ ID NO: 25610 - RNA, 333 nt, Artificial Sequence
  derived and/or modified sequence opt3 from anti-HIV_048-108570_VR-Chain
cagagcgcccugacccaacccccuuccgugucugcugcaccaggccagaaggucacaaucucaugcagugggaaaagcuccaacauuggaacuaauuucguuucuugguaccagcaguuuccggaggccgcgcccaagcuccuuauauaugacaacaauaaaagaccuucggguaucccagauagguucucaggcagcaagagugggacguccgcuacccugggaauuacaggcuugcaaacuggugacgaagccgauuacuauugugggaccugggacggaucuuuaagcacaggcggcgugaucgggaccggaacuaaaguaacagugcug

SEQ ID NO: 25611 - RNA, 327 nt, Artificial Sequence
  derived and/or modified sequence opt3 from anti-HIV_048-108033_VR-Chain
gagcugacccagagccccuccgugucugccgcuccuggccaaagagucacaaucucaugcagugggaacagcuccaauauuggaaacaauuacguuucuugguaucagcuccuuccagguacugcaccgaagcuguugauauacaaaaacgacaagaggcccucgggcaucccugaucgguucucagggagcaaaaguggaacguccgccaccuuaggcauuacaggucugcagacuggggacgaagcggauuauuacuguggaaccugggacacaucucuaagcaccggcggcguguuugggacuggaacaaagguaaccgugcuc

SEQ ID NO: 25612 - RNA, 333 nt, Artificial Sequence
  derived and/or modified sequence opt3 from anti-HIV_048-107279_VR-Chain
cagagcgugcugacccaacccccuuccgucucugccgcuccaggccagaagguuaucauuucaugcagugggagcuccucuaacauaggaaagaauuacgugucgugguaucagcaccucccggguacagcacccaaacuucugaucuacgagaacaauaaaagaccuucaggcauuccagacagguucagcgggaguaaguccggaacuucugccacguugggcaucaccgguuuacagacaggggaugaagcggacuauuacuguggaacuugggaugcuagccuguccgccggcggcguacuagggaccggaacaaaagugaccguccuc

SEQ ID NO: 25613 - RNA, 333 nt, Artificial Sequence
  derived and/or modified sequence opt3 from anti-HIV_048-106271_VR-Chain
cagagcgugcugacccaacccccuuccgucucugccgcuccaggccagaagguuacaaucucaugcagugggagcagauccaacauuggaucuaauuacauaucgugguaucagcagcucccggguacugcacccaaacuucugaucuacaagaacgacaaaaggccuucaggcauuccagaucgguucagcgggaguaaguccggaacgucugccaucuugggcauuaccgguuuacaaacaggggacgaggcggauuauuacuguggagcuugggacacuagccuguccgccggcggcguguuugggaccggaacaaaaguaaccgugcua

SEQ ID NO: 25614 - RNA, 333 nt, Artificial Sequence
  derived and/or modified sequence opt3 from anti-HIV_048-106054_VR-Chain
cagagcgugcugacccaacccccuuccgucucugccgcuccaggccagcagguuacaaucucaugcagugggagcacuuccaacauuggaaauaacuacgugucuugguaucagcaaguaccggguacggcacccaagcuccuuauauacgacaauaacaauagaccuucgggcaucccagauagguucucagggagcaaaaguggaaccuccgccacacugggcauuucugguuugcagacuggggacgaggcggauuauuacuguggaaccugggacaccagcuuauccggcggcgggguguuuggaacagguacuaaggucacagugcug

SEQ ID NO: 25615 - RNA, 333 nt, Artificial Sequence
  derived and/or modified sequence opt3 from anti-HIV_048-104848_VR-Chain
cagagcgcccugacccaacccgcuuccgugucuggcucaccugggcagaguaucacaauuagcugcacuggaacguccucugacgucgguuacaacuauguuucgugguaccagcagcucccaggcaccgcaccgaaacuucugauauucgauaaugacgauagacccucagagaucccugacagguuuagcgggaguaaguccggaacaucugccacuuugggcauuaccgguuuacaaccaggggaugaagcggacuauuacuguggaacaugggauagcucccugucagcuggcggcguguucgggaccggaacuaagguaacagugcua

SEQ ID NO: 25616 - RNA, 333 nt, Artificial Sequence
  derived and/or modified sequence opt3 from anti-HIV_048-104638_VR-Chain
cagagcgugcugacccagcccccuuccgccucuggcacaccagggcacagagucacuaucucaugcaguggaaacagcuccaauauugguggcaaccauguuuacugguaucaacaggugccggggacgacccccaagcuccuuauauacaggaauaacgagcggccuucuggaaucccagaccgcuucucgggcucaaaaagcgguacaagugcuacucuggggauuaccggauugcagacaggcgaugaagcagacuauuacuguggcaccugggauacuuccuuaucugccgggggaguauuugguacaggcaccaaggugacgguccug

SEQ ID NO: 25617 - RNA, 333 nt, Artificial Sequence
  derived and/or modified sequence opt3 from anti-HIV_048-104567_VR-Chain
cagagcgugcugacccaacccccuuccgccucuggcacaccagggcagagagucacuaucucaugcaguggaagcaacuccaauauugguacgaacuucguuaauugguaccagcacgugccgggcagggcucccaagcuccuuauauauaaaaacaccgagcggccuucugggaucccagaccgcuuuucgggaucaaagagcggcacaagugcaacucuggauauuaccgguuugcagacaggggacgaagccgauuacuauuguggaaccugggacacuuccuuaucugcgggcggcguauucgggacaggaaccaaagugacgguccug

SEQ ID NO: 25618 - RNA, 333 nt, Artificial Sequence
  derived and/or modified sequence opt3 from anti-HIV_048-102804_VR-Chain
cagagcgugcugacccaacccccuuccgucucuacagccccaggccagaagguuacuaucucaugcagugggagcuccucuaacauuggauacucguaugugucaugguuccagcaccucccggguacggcucccaaacuucugauauacggcaauagcaacagaccuagugggguaccagacagguuuuccggaucuaagagcggcaccuccgcaucauuggccaucacagguuuacagacuggggaugaggcggacuauuacuguggaaccugggauaguagccugucugcuggcggcguguucgggacaggaaccaaagucacugugcua

SEQ ID NO: 25619 - RNA, 333 nt, Artificial Sequence
  derived and/or modified sequence opt3 from anti-HIV_048-101676_VR-Chain
cagagcgugcugacccaacccccuuccgucucuggcgccccagggcagucaguuacaaucaguugcacuggaacgagcuccaacauuggugacuucgaugugcacugguaccagcagcucccgggcaccgcucccaaacuucuguuguaugagaauaacaagagaccuucugggauaccagacagguuuucgggaucaaagagcggcacaagugcaacuuuagccaucaccggucugcaaacaggggaugaagcggacuacuauuguggaaccugggauggcucccuaucuacuggcgggguaauuggaacagguaccaaagugacgguccuc

SEQ ID NO: 25620 - RNA, 333 nt, Artificial Sequence
  derived and/or modified sequence opt3 from anti-HIV_048-097603_VR-Chain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucugauauacgacacgguaaagagaccuucaggcaucccagauagguucagcgggaguaaauccggaaccucugccacauugggcauuacugguuuacaaaccggggacgaggcggauuauuacuguggaacaugggacagcucccugucaggcggcgggguguuuggaaccgguacuaaggucacagugcua

SEQ ID NO: 25621 - RNA, 333 nt, Artificial Sequence
  derived and/or modified sequence opt3 from anti-HIV_048-097107_VR-Chain
cagagcgugcugacccaacccccuuccgucucugccgcuccaggccagaagguuacaaucucaugcagugggagcuccucuaacauugagaauaacuacgugucgugguauagacagguaccgggaacugcacccaaacuccuuauauacaagaaugacaacaggccuucagguaucccagaucgguucagcggcaguaaauccgggacgucugccacccugggaauuacaggcuugcagacuggugacgaagcggauuauuacugugggaucugggacaccagcuuauccgcuggaggcguguuuggcacagggaccaaggucacugugcug

SEQ ID NO: 25622 - RNA, 333 nt, Artificial Sequence
  derived and/or modified sequence opt3 from anti-HIV_048-096871_VR-Chain
cagcccgugcugacccaaccuccaagcgccuccggcacaccggggcagagagucacuaucucuugcucaggaaguagcuccaacauugguucuaauuacguuuauugguaccagcagcuccccggcacgaccccuaaacuucugauauauaggaacaaucaacggccaucggggauccccgaccgcuucucaggaagcaagaguggcacauccgcuacuuuggguauuaccggguuacagacaggagaugaggcagacuacuauuguggcaccugggauacuucucugagcacaggcgggguguuuggaaccgguacgaagguaacugugcua

SEQ ID NO: 25623 - RNA, 333 nt, Artificial Sequence
  derived and/or modified sequence opt3 from anti-HIV_048-096668_VR-Chain
cagagcgugcugacccaacccccuuccgucucugccgcuccaggccagaagguuacaaucucaugcagugggagcggauccaacauugguaauaacuacgugucuugguaucagcagcucccgggcacugcacccaaacuucugauauacaagaauacggagagaccuucggggaucccagacagguucucaggaagcaaaaguggcaccuccgccacauuggauauuacugguuuacaaaccggggacgaagcggauuauuacuguggaacaugggacaccucucugagcgcuggcggcguauuugggacuggaacaaaggugaccguccua

SEQ ID NO: 25624 - RNA, 333 nt, Artificial Sequence
  derived and/or modified sequence opt3 from anti-HIV_048-095236_VR-Chain
cagagcgugcugacccaacccccuuccgucucugccccaccgggccagaagguuacaaucucaugcagugggacuacgagcaacauuggauccaauuacguggcuugguaucagcagcuccccgguaccgcaccuaaacuuguaauauacgagaacucuaagagaccaucgggcauccccgacagguucucagggagcaaaaguggaacauccgccacucugggcauuaccgguuugcaaacaggggaugaagcggacuauuacuguggaaccugggauacuucuuuaagcgcuggcggcguguuuggguccggaacaaaggucaccgugcug

SEQ ID NO: 25625 - RNA, 333 nt, Artificial Sequence
  derived and/or modified sequence opt3 from anti-HIV_048-094155_VR-Chain
cagagcgugcugacccaacccccuuccgucucugccgcuccaggccagaagguuacagugucaugcagugggagcuccucugacaucggagagaacuacguaucgugguaucagcaguucccggaaacugcacccaaacuccuuauuuacgauaauaacaagagaccuucagguauaccagacagguuuagcggcaguaaauccgggacgucugccacccuggcgaucacaggauugcaaacuggcgaugaggcugacuauuacugugguaccugggauagcuccuuaucagccgggggaguguucggcacaggcaccaaggucacugugcug

SEQ ID NO: 25626 - RNA, 333 nt, Artificial Sequence
  derived and/or modified sequence opt3 from anti-HIV_048-093219_VR-Chain
cagccccugcucacccaaccuccagccgugagcgcuacaccgggccagagagucacuaucuccugcacggggucuucaaguaacauuggaaggaccuucguuaauugguaccagcagcuucccgguacagcaccuaagcuguugauauaugagaacagcaaacggccauccggcauccccgaccgcuuuucugggucgaagucaggaacuagcgccaccuuaggcauuacaggucugcaaaccggggaugaagcggacuacuauuguggaacuugggauacaagucuauccgcuggcggcguguucgggucuggaaccaaaguaacggugcuc

SEQ ID NO: 25627 - RNA, 333 nt, Artificial Sequence
  derived and/or modified sequence opt3 from anti-HIV_048-092976_VR-Chain
cagagcgugcugacccaacccccuuccgucucugccgcuucaggccagaagguuacaaucaguugcagcggguccucuucgaacauuggaaauaacuacgugucaugguaucagcaccucccagguacugcaccgaaacuucugauauacaagaaugacaaaagacccagcggcaucccugauagguucaguggguccaagucuggaacgagcgccaccuugggcauuacagguuuacagacuggggacgaggcggauuauuacuguggaaccugggacacaucccugucagcuggcggcguauuugggaccggaacuaaagugacaguccua

SEQ ID NO: 25628 - RNA, 333 nt, Artificial Sequence
  derived and/or modified sequence opt3 from anti-HIV_048-090866_VR-Chain
cagagcgugcugacccaacccccuuccgucucugccgcuccaggccagaagguuacaaucucaugcagugggagcagauccaacauuggaucuaauuacauaucgugguaucagcagcucccggguacugcacccaaacuucugaucuacgacaacaauaagaggccuucaggcauuccagaucgguucagcgggaguaaauccggaacgucugccaccuugggcaucacagguuuacaaacuggggacgaggcguauuacuauuguggaaccugggauacaagccuguccgcuggcggcguguuugggucaggaaccaagguaacugugcua

SEQ ID NO: 25629 - RNA, 333 nt, Artificial Sequence
  derived and/or modified sequence opt3 from anti-HIV_048-090650_VR-Chain
cagagcgcccugacccaacccgcuuccgugucuggcucacucgggcagaguaucacaauuagcugcuccggaucuucgucaacuauagguaacaauuacgucagcugguaucagguucuuccuggcgcagccccaaagcuguugaucuguaaaaacaaugagagaccgagugggauucccgacagguucuccggaucuaagagcggcacguccgcgaccuuagguaucacagggcugcagacuggagaugaagcugacuacuauugcggcaccugggauacaucacuaagugccggcgggguguuuggaaccgguacuaaaguaacagugcuc

SEQ ID NO: 25630 - RNA, 333 nt, Artificial Sequence
  derived and/or modified sequence opt3 from anti-HIV_048-089009_VR-Chain
cagagcgugcugacccaacccccuuccgucucugccgcuccaggccagaagguuacaaucucaugcagugggggaagcuccaacauugguaauaacuacgugucuugguaucagcagcucccggagacugcacccaaacuuauaaucuacgacaauaacaagagaccuucgggcauucacgauagguucucagggagcaaaaguggaacguccgccacccuggacaucacagcguugcaaacuggcgaugaagcugacuauuacugugguaccugggauacaucuuuaagcgccgggggaguauuuggcaccggcacuaaggugacaguccug

SEQ ID NO: 25631 - RNA, 333 nt, Artificial Sequence
  derived and/or modified sequence opt3 from anti-HIV_048-088654_VR-Chain
cagagcgcccugacccaacccagauccgugucugcugcaccuggccagaaggucucaaucaguugcagcgggagguccacaaaccucggauacaauuauguuucuugguaccagcaccuuccaggugccgcgccgaaagugcugauuuaugagaacaauaagcggcccucgggcauaccugaccgcuucucagggagcaaaaguggaacuuccgcuacguugggcaucaccgguuuacagacaggggaugaagccgacuacuauuguggaacuugggauaccucucugagcgcaggcggcguauuuggguccggaacaaaggugaccguccua

SEQ ID NO: 25632 - RNA, 333 nt, Artificial Sequence
  derived and/or modified sequence opt3 from anti-HIV_048-086513_VR-Chain
cagagcgcccugacccaacccccuuccgugucugcugcaccaggccagaaggucacaaucucaugcagugggagcacuuccaacauuggaaauaacuacguuucuugguaucagcagcucccggguacggcccccaaacuucugauauacaagaaugacaacagaccuucgggcaucccagauagguucucaagcaguaaauccgggaccucugcgacauugggaauuacuggcuuacaaaccggugacgaggcugauuauuacugugggaucugggacacaagccuguccgccggaggcguguuuggcaccgggacuaagguaacagugcua

SEQ ID NO: 25633 - RNA, 324 nt, Artificial Sequence
  derived and/or modified sequence opt3 from anti-HIV_048-086024_VR-Chain
cuggcccagcccccuagcguguccggcaccccagggcaaagagucacaaucucuugcucaggaaguagcuccaacauugguucuaaugcuguuaacugguaccagcaguucccgggcacugcacccaagcuccuuauauaugacacggauaaaaggccuucggggaucccagaccgguuuucaggaagcaagaguggcaccuccgccauucuggguaucacaggguugcagacuggagaugaggcggacuacuauuguggcgcuugggauaccucuuuaagcgccggcgggguguucggaacagguaccaaaguaacugugcug

SEQ ID NO: 25634 - RNA, 333 nt, Artificial Sequence
  derived and/or modified sequence opt3 from anti-HIV_048-085857_VR-Chain
cagagcgcccugacccaacccagauccgugucuggcucacucgggcagagugucacaaucagcugcacuggaacgaccuccgacguugguuucgauuacgugucuugguaucagguacuuccuggcacagcuccaaagcuguugauuuacaaaaacgacaagaggccgucggggauacccgaucgguuuucaggaagcaaaaguggcacuuccgcaaccuuagguaucacagggcugcagaccggagacgaggccgauuauuacuguggcacuugggacacaucucuaagcaccggcgggguguucggaacggguacuaaggucaccgugcuc

SEQ ID NO: 25635 - RNA, 333 nt, Artificial Sequence
  derived and/or modified sequence opt3 from anti-HIV_048-084277_VR-Chain
cagagcgugcugagacaacccccuucccucucuggcgcgccagggcagagggucacccuuucaugcacaggaaguagcuccaacaucgguggcuacgacguucacugguaucagcaugugccggggacugcucccaagcuguugauuuacgagaauacgaaacggccuucuggaauaccagaucgcuucucgggcucaaagagcgguaccagugcaacauuagggaucacuggacugcagaccggcgacgaagccgauuauuacuguggcacaugggacaccucccuaucugccgggggaguauuugguagcggcacuaaagugacaguccuc

SEQ ID NO: 25636 - RNA, 333 nt, Artificial Sequence
  derived and/or modified sequence opt3 from anti-HIV_048-084245_VR-Chain
cagagcacccugacacaacccccuuccgugucugccgcuccaggccagaaggucacuaucucaugcagugggagcaacuccaauauuggaaaacacuacguuucuugguaucagcaguucccgggugcagugcccaagcuccuuauauacgagaacaaaaagagaccuucgggcaucccagacagguuuucagggagcaaaagugauacguccgccacccuggacauuacaggauugcaaacuggcgaugaagcggacuauuacugugguaccugggauacaucuuuaagcgcugggggaguauucggcuccggcaccaaggugacuguccug

SEQ ID NO: 25637 - RNA, 333 nt, Artificial Sequence
  derived and/or modified sequence opt3 from anti-HIV_048-082487_VR-Chain
cagagccugcucacccaacccccuuccgugucugccgcuccaggccagaaggucacaaucucaugcagugggagcuccucuacuauuggaaacaauuacguuucgugguaucaggugcuuccgggugcagcccccaaacuguugauauguaagaacaaugagagaccuucaggcaucccagacagguucagcgggaguaaauccggaacgucugcgaccuuaggcauuacaggucugcagacuggggaugaagcugacuacuauugcggaaccugggauacaagccuauccgccggcggcguauuugggucaggaaccaaggugacuguccuc

SEQ ID NO: 25638 - RNA, 333 nt, Artificial Sequence
  derived and/or modified sequence opt3 from anti-HIV_048-081787_VR-Chain
cagagcgugcugacccaacccccuuccgucucuggcgccccagggcagagaguuacaaucucaugcacuggaaguagcuccaacauugguucuuacgacgugcacugguaucagcagcucccgggcacggcucccaaacuucugauauacgaaaauucgaagaggccuucagggaucccagaucgguucagcggaaguaaguccggcaccucugcaacauuggguauuacuggguuacaaaccggagacgaggccgauuauuacuguggcacaugggacaccagccuguccggcgggggaguauuugguacuggcacaaaagugaccguccua

SEQ ID NO: 25639 - RNA, 333 nt, Artificial Sequence
  derived and/or modified sequence opt3 from anti-HIV_048-081062_VR-Chain
cagagcgugcugacccaacccccuuccgucucugccgcuccaggccagaagguuacaaucucaugcagugggacuagcuccaacauuggagcaaauuacgugucuugguaucagcagguaccggguacggcccccaaacuccuuauauacgagaacaauaagagaccuucgggcaccccagacagguucucagggagcaaaaguggaacauccgcgacucugggcaucaccgguuugcaaacaggggaugaagcugacuauuacuguggaaccugggauacuucuuuaagcgccggcggcguguuuggguccggaacaaaggucaccgugcug

SEQ ID NO: 25640 - RNA, 333 nt, Artificial Sequence
  derived and/or modified sequence opt3 from anti-HIV_048-079639_VR-Chain
cagagcgugcugacccaacccccuuccgucucugccgcuccaggccagaagguuacaaucucaugcagugggagcuccucuaacauuggaaagaauuacgugucgugguaucagcaccucccggguacugcacccaaacuucugauauacgagaacaauaaaagaccuucaggcaucccagacagguucagcgggaguaaguccggaacggccgcgaccuugggcauuacagguuuacagacuggggaugaagcuggauauuacuguggcaccugggacacaucucugagcgccggcgggguauuuggaaccgguacuaaagugacaguccua

SEQ ID NO: 25641 - RNA, 333 nt, Artificial Sequence
  derived and/or modified sequence opt3 from anti-HIV_048-079126_VR-Chain
cagagcgugcugacccaacccccuuccgucucugccgcuccaggccagaagguuacaaucucaugcagugggagcuccucuaacauuggaaauaacuacgugucgugguaucagcaccucccggguacucccccuaaacuucugauauucaagaauaacgagagaccaucaggcauccccgacagguuuagcgggaguaaauccggaacgucugcaaccuugggcauuacagguuuacagacuggggaugaagccgacuacuauuguggaaccugggauacaagccuguccgcgggcggcguauucgggaccggaacuaaggugacaguccua

SEQ ID NO: 25642 - RNA, 333 nt, Artificial Sequence
  derived and/or modified sequence opt3 from anti-HIV_048-073118_VR-Chain
cagagcgugcugacccaacccccuuccgucucugccgcuccaagacacaacguuacaaucucaugcaguggcgggagcuccaauauuggaaacaauuucgugucuugguaccaguaucucccggguacugcacccaaacuucugauauacgacaacaauaagaggccuucgggcaucccagaucgguuuucagggagcaagaguggaacguccgccaccuugggcauuacagguuuacagacuggggacgaggcggauuauuacugugcuaccugggacacaucucugagcgccggaggcguauucggcaccgggacuaaagugacaguccua

SEQ ID NO: 25643 - RNA, 333 nt, Artificial Sequence
  derived and/or modified sequence opt3 from anti-HIV_048-070264_VR-Chain
cagagcgugcugacccaaucccccucugucucagccgcuccuggccagaagguuacaaucaguugcagcgggacuuccucuaacauuggaaauacguacgugucgugguaucagcagcucccagguaccgcaccgaaacuucugauauacaagaacgacaaaagacccucaggcaucccugauagguucagcgggaguaaguccggaacaucugccacuuugggcauuaccgguuuacaaacaggggacgaggcggauuauuacuguggaaccugggacagcucccugucagcuggcggcguauuugggacuggaacaaaagugaccguccua

SEQ ID NO: 25644 - RNA, 333 nt, Artificial Sequence
  derived and/or modified sequence opt3 from anti-HIV_048-069426_VR-Chain
cagagcgugcugacccaacccccuuccgucucugccgcuccaggccagaagguuacaaucucaugcagugggagcuccucuacuauuggaaacaauuacgugucgugguaucagcagcucccggguacggcacccaaacuucugauauacaagaacaauaaaagaccuucaggcguaccagacagguucagcgggaguaaguccggaaccucugccacacccggcaucacugguuugcaaaccggggaugaggcggacuauuacuguggaacaugggauaccagcuuauccgcuggcggcguguuugggacuggaacaaaagucaccgugcug

SEQ ID NO: 25645 - RNA, 333 nt, Artificial Sequence
  derived and/or modified sequence opt3 from anti-HIV_048-068564_VR-Chain
cagagcgcccugacccaacccagauccgugucuggcucaccugggcagagugucgcuaucagcugcacaggaacuuccucugacguugguuacaacuaugugucgugguaccagguacucccaggcacggcaccgaaacuucugauuuauaagaauaacgagaggcccucagggauaccugaucgguucagcggaaguaaguccggcaccucugccacauuggguaucacuggguuacagaccggagacgaagcggauuacuauuguggcacaugggacaccagccuguccgcuggcgggguguuuggaacugguacaaaagucaccgugcua

SEQ ID NO: 25646 - RNA, 333 nt, Artificial Sequence
  derived and/or modified sequence opt3 from anti-HIV_048-068345_VR-Chain
cagagcgugcugacccaaacacccuccgucucugccgcuccuggccagagaguuacuaucucaugcagugggagcacguccaacauuggaaauaacuacgugucuugguaucagcagcucccagguaccgcaccgaaacuucugauauacgagaauaacaagaggcccucgggcauccgggaccgcuucucagccagcaagagugggacauccgcgacuuugggaauuaccggcuuacaaacaggugaugaagcugacuauuacugugggaccugggauacuucucugagcgccggaggcguauuuggcacagggaccaaagugacgguccua

SEQ ID NO: 25647 - RNA, 333 nt, Artificial Sequence
  derived and/or modified sequence opt3 from anti-HIV_048-067337_VR-Chain
cagagcgugcugacccaacccccuuccgucucugccgcuccaggccagaagguuacaaucucaugcaguggggcaagcuacaacauugguaaaaauuccgugucuugguaucagcagcucccgggaacugcccccaaacuucugauauacaagaacgacaagagaccuucgggcaucccagauagguucucagggagcaaaaguggagcguccgcuacguuggacauuaccggcuuacaaacaggugaugaggccgacuauuacugugggaucugggauacuucucugagcgcaggaggcguauuuggcaccgggacaaaggugaccguccua

SEQ ID NO: 25648 - RNA, 333 nt, Artificial Sequence
  derived and/or modified sequence opt3 from anti-HIV_048-067180_VR-Chain
cagagcgugcugacccaacccccuuccgucucugccgcuccaggccagaagguuacaaucucaugcagugggagcuccccgaacauuggaaauaacuacgugucuugguaucagagacuccccgguacugcaccuaaacuucugauauacgagaaugaccagaggccaucgggcauccccgaucggauuucagggagcaagaguggaacguccgccaccuugggcaucacagguuuacaaacuggggacgaagcggauuauuacuguggaaccugggacacaucucugagcaccggcggcguauucgggacuggaacaaaagugaccguccua

SEQ ID NO: 25649 - RNA, 333 nt, Artificial Sequence
  derived and/or modified sequence opt3 from anti-HIV_048-063017_VR-Chain
cagagcgugcugacccaacccccuuccgucucugccgcuccaggccagaagguuacaaucucaugcagugggagcuccucuaacauuggaaauaacuacgugucgugguaucagcaccauccggguaaagcacccaagcucaugauauacgagguaucaaaaagaccuagcggcaucccagacagguucaguggguccaagucuggaacuagcgccacgcuuggcauuaccggucugcagacaggggaugaagcggacuauuacuguggaacuugggauaccuccuugaaucggggcggcguguuugggacaggaaccaaagucacuguguua

SEQ ID NO: 25650 - RNA, 333 nt, Artificial Sequence
  derived and/or modified sequence opt3 from anti-HIV_048-061885_VR-Chain
cagagcgugcugacccaacccccuuccgucucugccgcuccaggccagaagguuacaaucucaugcagugggagcuccucuaacauuggaucgcacuacauaucaugguaucagcaguucccgggugcagcccccaaacuccuuaucuacgagaaugacaagagaccuagcggcauuccagauagguuuagugcguccaaaucugggacuagcgcuacgcugggaaucaccggcuugcaaacaggugacgaagccgauuauuacugugggacuugggacaccuccuuaucagcaggaggcguguucggcacagggaccaagguaacugugcug

SEQ ID NO: 25651 - RNA, 333 nt, Artificial Sequence
  derived and/or modified sequence opt3 from anti-HIV_048-061671_VR-Chain
cagagcgugcugacccaacccccuuccgccucuggcacaccagggcagagagucacuaucucaugcaguggaagcagguccaacauugguucuaauuacguuuauugguaccagcaguucccgggcacggcucccaagcuccuuauauaugagaacaauaaacggccuucggggaucccagaccgcuuuucaggaagcaagaguggcaccuccgcaacacuggguauuacuggguugcaaaccggagaugaagccgacuacuauugugcgacaugggauaccucuuuaagcgcuggcggcguguucgggacuggaacaaaaguaaccgugcug

SEQ ID NO: 25652 - RNA, 333 nt, Artificial Sequence
  derived and/or modified sequence opt3 from anti-HIV_048-060700_VR-Chain
cagagcgugcugacccaacuccccucccuuucugccgcuccuggccagaaggucacaaucucaugcagugggagcuccucuaacauuggaaauaacuacguuucgugguaucagcagcugccagguacugcaccgaaauuguuaauauacgagaauaacaagagacccucaggcaucccugacagguucagcgggaguaaauccggaacgucugccacccugggcauuacaggucuacaaacuggggaugaagcggaguauuacugugcuaccugggacgccagccucuccggaggcggcguguuugggacaggaaccaagguaacugugcug

SEQ ID NO: 25653 - RNA, 333 nt, Artificial Sequence
  derived and/or modified sequence opt3 from anti-HIV_048-060592_VR-Chain
cagagcgugcugacccaacccccuuccgucucugccgcuccaggccagaagguuacaaucucaugcagugggagcuccucuaacauugguaaaaauuacgugucgugguaucagcaguucccggguacugcacccaagcuccuuauauacgagaacaauaaaagaccuucaggcaucccagacagguuuagcgccaguaaguccgcgacgucugcuacccugguaauuacaggguugcaaacuggagaugaagccguguauuacuguggcaccugggacaccagcuuauccgcaggaggggucuucggaucaggcacaaaagugacuguucug

SEQ ID NO: 25654 - RNA, 333 nt, Artificial Sequence
  derived and/or modified sequence opt3 from anti-HIV_048-060300_VR-Chain
cagcccgugcugacccaaccuccaagcgccuccggcacaccggggcagagagucacuaucucuugcucaggaaguagcuccaacauugguacgaauaccguuaacugguaccagcaguuccccggcacagcuccuaagcuccuuauauauaaaaauaacgagaggccaucugggauccccgaccgguuuucgggaucaaagagcggcaccagugcaacucuggguauuacaggguugcaaaccggagaugaagccgacuacuauuguggcacuugggauacauccuuaucuggcgggggaguguucgguaccggcacgaaaguaacugugcug

SEQ ID NO: 25655 - RNA, 333 nt, Artificial Sequence
  derived and/or modified sequence opt3 from anti-HIV_048-059141_VR-Chain
cagcccgugcugacccaaccuccaagcgccuccggcacaccggggcagagagucucuaucucaugcaguggaaacuucagcaauauugguuccaaguacguuuauugguaccagcagauacccggcacugcuccuaacgugaucauuuauaggacgaaucuccggccaucugggauccccgaccgcuuuucggcaucaaaaagcggaaccagugccacacuuggcauuacuggucugcaaaccggggaugaggcggacuacuauuguggaacaugggauaccuccuugucugcuggcggcguauucgggacuggaacaaaggugaccgucuua

SEQ ID NO: 25656 - RNA, 333 nt, Artificial Sequence
  derived and/or modified sequence opt3 from anti-HIV_048-057777_VR-Chain
cagagcgugcugacccaacccccuucccucucugccgcuccaggccagagagucacaaucucaugcagugggagcuccucuaacauuggaaauaacuacguuucgugguaucagcaguucccggguacugcacccacgcuucugauauacgagaaugacaagaggccuucaggcaucccagaucgguuuagcgccaguaaauccgggaccucugcgacauugggaauuacuggcuuacaagcuggugacgaagccgauuauuacugugggaccugggacacaagccuguccgcaggaggcguguucggcaccgggacuaagguaacagugcua

SEQ ID NO: 25657 - RNA, 333 nt, Artificial Sequence
  derived and/or modified sequence opt3 from anti-HIV_048-056928_VR-Chain
cagagcgugcugacccaacccccuuccgucucugccgcuccaggccagaagguuacaaucucaugcagugggagcuccucuacuauuggaaacaauuacgugucgugguaucagcuccuuccggguacggcacccaaacuguugauauacgacaacgauaauagaccuucagacaucccagauagguucagcggcaguaaguccgggaccucugccacauuaggaauuacuggccugcagaccggugacgaggcggauuauuacuguggggcuugggacacaagccuauccgccggaggcguauuuggcaccgggacuaaagugacaguccuc

SEQ ID NO: 25658 - RNA, 333 nt, Artificial Sequence
  derived and/or modified sequence opt3 from anti-HIV_048-056131_VR-Chain
caguucgugcugacccaacccgccagcgucuccggcucuccugggcagucaaucacaauuaguugcagcggaacuuccucugacguugguuacaacuaugugucgugguaccagcagcucccaggcacggcuccgaaacuucugauauaugagaauaccaagagacccucagggaucccugauagguuuagcggaaguaaguccggcacaucugcaacuuuggguauuaccggguuacaaacaggagacgaagccgauuacuauuguggcaccugggacacuagccuguccgcgggcgggguauucggaucagguacaaaagugaccguccua

SEQ ID NO: 25659 - RNA, 333 nt, Artificial Sequence
  derived and/or modified sequence opt3 from anti-HIV_048-055864_VR-Chain
cagagcgugcugacccaacccccuuccgucucuguugccccaggccagaaggugacaaucuacugcucagggaguagcuccaacauugguaaaaauucuguaucgugguaugugcaggucccgggaacugcucccaaguuccucauauacgagaacaaucagagaccuucaggcaucagcgacagguuuaguggguccaaaucuggaacgagcgcaacccuuggcauuuccggucugcaaacaggggaugaagccgacuauuacuguggaacuugggauaccucauugaguggcggcgggguguucggaacagguaccaagguuacuguguua

SEQ ID NO: 25660 - RNA, 333 nt, Artificial Sequence
  derived and/or modified sequence opt3 from anti-HIV_048-055094_VR-Chain
cagagcgugcugacccaacccccuuccgucucuggcgccccagggcagagaguuacaaucucaugcagugcuagcuccucuucgauuggaaacgacuucgugucaugguaccagcagcucccggguacugcacccaaacuucugauaagcgagaauaacaagaggccuaguggcaucccagaucgguuuuccgggucuaagagcggaacguccgccaccuugggcauuacagguuuacaaacuggggacgaagcggauuauuacuguggaaccugggacucaagucugagcgcuggcggcguauucgggacaggaaccaaagugacuguccua

SEQ ID NO: 25661 - RNA, 333 nt, Artificial Sequence
  derived and/or modified sequence opt3 from anti-HIV_048-054343_VR-Chain
cagagcgugcugacccaacccccuuccgucucuggcgcgccagggcagagaguuacaaucucaugcacuggaaguagcuccaacauugguggcuacgacgugaauugguaucagcagcucccggggacggcucccaaacuucugauauucaagaacaaugagaggccuucuggaaucccagaucgguuuucgggcucaaagagcgguaccagugcaacauuggggauuacuggauuacaaaccggcgacgaagccgauuacuauuguggcacaugggacaccucccugucugccgggggaguauucgguacuggcacaaaagugaccguccua

SEQ ID NO: 25662 - RNA, 333 nt, Artificial Sequence
  derived and/or modified sequence opt3 from anti-HIV_048-054193_VR-Chain
cagagcgugcugacccaacccccuuccgucucugccgcuccaggccagaagguuacaaucucaugcagugggggaagcuccaacauugguaauaacuacgugucuugguaucaccagguaccgggcacugcacccaaacuccuuauauucgagaauaacaagagaccuucggggaucccagacagguuuucaggaagcaaaaguggcacguccgccacccuggguauuacaggguugcagacuggagaugaagcggacuacuauuguggcaccugggauacaucuuuaagcggcgggggaguguucgguaccggcacuaaggucacagugcug

SEQ ID NO: 25663 - RNA, 333 nt, Artificial Sequence
  derived and/or modified sequence opt3 from anti-HIV_048-052521_VR-Chain
cagagcgugcugacccaacccccuuccgucucugccgcuccaggccagaagguuacaaucucaugcagugggagcuccucuaacauuggaagacacucggugucaugguaccagcagcucccggguacugcacccaaacuucugauauaugacacggauaagaggccuagcggcaucccagaccgguucaguggguccaaaucuggaaccagcgccacauugggcauuacugguuuacaaaccggggaugaggcggacuacuauuguggaacaugggauaccucccugucaggcggcgggguauuuggaacugguacaaaggugaccguccua

SEQ ID NO: 25664 - RNA, 333 nt, Artificial Sequence
  derived and/or modified sequence opt3 from anti-HIV_048-049037_VR-Chain
cagagcgugcugacccaacccccuuccgucucugccgcuccaggccagaagguuacaaucucaugcagugggagcuccuucaacauuggaaauaacuacgugucuugguaucagcaccucccggguacugcacccaaacuucugauauacgccgcgguaacgagaccuucgggcaucccagacagguuuucagggagcaagaguggaaccuccgcuacauuggauauuacuggcuuacagaccggugacgaggccgauuauuacugugggacaugggacaccucucugagcgcaggaggcguguucggcacugggacaaaagucaccgugcua

SEQ ID NO: 25665 - RNA, 333 nt, Artificial Sequence
  derived and/or modified sequence opt3 from anti-HIV_048-048720_VR-Chain
cagagcgugcugacccaacccccugccgucuccgcugcaccaggccagagaguugccaucucuugcucagggacaaguagcaacauuggauccaaucucgugucuugguaccagcagcuuccggguaaggcgcccaggcuguugauauaugacaacuacaaacggccuucgggcaucccagaucgcuucucagggagcaagaguggaacuuccgcuacguuaggcauuaccggucugcaaacaggggacgaggccgauuauuacuguggaacuugggacaccucucuaagcacaggcggcguauuugggaccggaacuaaagugacaguccuc

SEQ ID NO: 25666 - RNA, 333 nt, Artificial Sequence
  derived and/or modified sequence opt3 from anti-HIV_048-048542_VR-Chain
cagagcgugcugacccaacccccuuccgucucugccgcuccaggccagaagguuacaaucucaugcagugggagcuccucuaacauuggaaauaacuucgugucgugguaccagcagcucccggguacugcacccaaacuucugauauauaauaacgacagaaggccuucaggcguaccagaucgguuuagcgccaguaaguucgggacggcggcuaccuugggaaucacaggcuuacaaacuggugacgaggccgauuacuauugugggaccugggacuccucucugagcgcaggaggcguguuuggcacagggaccaaagucacugugcua

SEQ ID NO: 25667 - RNA, 333 nt, Artificial Sequence
  derived and/or modified sequence opt3 from anti-HIV_048-047777_VR-Chain
cagagcgugcugacccaacccccuuccgccucuggcacaccagggcagagagucacuaucucaugcaguggaagcuccgcuaacauugguacgaauuacguuuucugguaucagcaccucccgggcaccgcacccaaacuucugauauacgagaacaauaagaggccuucugggaucccagaccgguuuucgggaucaaagagcggcacaagugccacuuuggguauuaccggguuacagacaggagaugaagcggacuauuacuguggcaccugggauuccucucugagcgcuggcgggguguucggaacugguacaaaaguaaccgugcua

SEQ ID NO: 25668 - RNA, 333 nt, Artificial Sequence
  derived and/or modified sequence opt3 from anti-HIV_048-046841_VR-Chain
cagagcgugcugacccaacccccuuccgucucugccgcucucggccagaagguuacaaucacuugcucaggggacaacggaaauauugguuaccacuaugugaguugguaccagcagguaggcagagcagccccaaaacuucugauauaugcgaacaauaagaggccgagcgggauccccgaucgguucuccggaucuaaaucgggcacgucagcuaccuuggguauuacaggguuacaaacuggagacgaggccgauuacuauuguggcaccugggacacaagccugagugcaggcgggguguuuggauccgguaccaaggucacugugcua

SEQ ID NO: 25669 - RNA, 333 nt, Artificial Sequence
  derived and/or modified sequence opt3 from anti-HIV_048-046202_VR-Chain
cagagcgugcugacccaacccccuuccgucucugccgcuccaggccagaagguuacaaucucaugcagugggagcuccucuaacauuggaaauaacuacgugucgugguaucagcaccucccggguacugcacccaaacuucugauauacgacacguauaagagacauucaggcguaccugauagguucagcaauaguaaauccgggaccucugccacauuggcgaucacuggauuacagaccggcgacgagggugauuacuauuguggggcuugggacacaagccuguccgccggaggcguguuuggcaccgggacuaaggucacagugcua

SEQ ID NO: 25670 - RNA, 333 nt, Artificial Sequence
  derived and/or modified sequence opt3 from anti-HIV_048-046059_VR-Chain
cagagcgugcugacccaacccccuuccgucucugccgcuccaggccagaacguuacaaucucaugcagugggacuagcuccaauauugagaacaauuacgugucuugguaucagacgcucccgggaaccgcacccaaacuucugauauacgacaacaauaagagaccuucggguaucccagauagguucucaggcagcaagagugggacauccgccacuuugggaauuaccggcuuacagacaggugacgaagcggauuauuacugugggaccugggacucuagccuguccgcuggaggcguauuuggcacugggacaaaagugaccguccua

SEQ ID NO: 25671 - RNA, 333 nt, Artificial Sequence
  derived and/or modified sequence opt3 from anti-HIV_048-043568_VR-Chain
cagagcgugcugacccaacccccuuccgucucugccgcuccaggccagaagguuacaaucucaugcagugggagcgacuccaacauuggaucuaauuacgugucgugguaucagcagcucccgggugcagcccccaaacuucugauauacaagaacaauaacagaccuucaggcaucccagauagguucagcgggaguaaauccggaacuucugcgacguugggcauuagcgguuuacaaaccggggacgaggcugauuauuacuguggaacaugggacacuucccugucaggcggcgggguauuuggaaccgguacaaaggugaccguccua

SEQ ID NO: 25672 - RNA, 333 nt, Artificial Sequence
  derived and/or modified sequence opt3 from anti-HIV_048-042713_VR-Chain
cagagcgugcugacccaacccccuuccgucucugccgcuccaggccagaagguuacaaucucaugcagugggagcuccucuaacauuggaagacacuacgugucgugguaucagcagcucccggguacugcacccaaacuucugauauacgacaauaacucaaggccuagcggcaucccagaucgguucaguggguccaagucuggaacgagcgccaccuugggcauuacagguuuacaaacuggggacgaggcggauuauuacuguggaaccugggacacaucccugaaucgcggcggcguauuugggaccggaacuaaagugacaguccua

SEQ ID NO: 25673 - RNA, 333 nt, Artificial Sequence
  derived and/or modified sequence opt3 from anti-HIV_048-042440_VR-Chain
cagagcgugcugacccaacccccuuccgccucuggcacaccagggcagagagucacuaucucaugcaguggaagcuccucuaacauugguacgaauaccguuaacugguaccagcagcucccgggcacagcucccaaacuucugauauaugaaaauucgaagaggccuucagggaucccagaccgguucagcggaaguaaguccggcacuucugcaaccuuggguauuacaggguuacaaaccggagaugaggccgacuacuauuguggcacuugggauacaagccuguccgcgggcgggguguuuggaucagguaccaaaguaacggugcua

SEQ ID NO: 25674 - RNA, 333 nt, Artificial Sequence
  derived and/or modified sequence opt3 from anti-HIV_048-040511_VR-Chain
cagagcgugcugacccaacccccuuccgucucugccgcuccaggccagaagguuacaaucucaugcagugggagcuccucuaacauuggaaauaacuacgugucgugguaucagcaccucccggguacugcacccaaacuucugauauacgagaauaacaagagaucaagcggcaucccugaaagguucagugggucccagucuggaacgagcgccaccuugggcauuacagguuuacaaacuggggacgaggcggauuauuacuguggaaccugggacacaucccugucaaccggcggcguauuugggacuggaacaaaagugaccguccua

SEQ ID NO: 25675 - RNA, 333 nt, Artificial Sequence
  derived and/or modified sequence opt3 from anti-HIV_048-039195_VR-Chain
cagagcgugcugacccaacccccuuccgucucugccgcuccaggccagagaguuacaaucucaugcagugggagcacuuccaacauuggaaaucacuacgugucuugguaucagcagcucccggguacggcacccaaacuucugauauacgacaacggcaauaggccuucggggaucccagaucgguucucaggaagcaagaguggcaccuccgccacauuggacauuacugguuuacaaaccggggaugaggcggacuauuacuguggaacaugggauaccucucugaaccgcggcggcguauuugggacuggaacaaaggugaccguccua

SEQ ID NO: 25676 - RNA, 333 nt, Artificial Sequence
  derived and/or modified sequence opt3 from anti-HIV_048-036935_VR-Chain
cagagcgugcugacccaacccccuuccaugucugccgcuccaggcgagagagucacaaucucaugcacugggaguagcuccaauauuggagguuacgacguucacugguaucagcagcucccgggcauagcacccaagauccuuauuuacaggaacucuauccggccuucggggauuccagaucgcuucucaggaagcaaaaguggcacguccgccacccuggguaucacaggguugcagacuggagacgaagcggauuauuacuguggcaccugggacacaucuuuaagcaccggcgggguguuuggaacugguacaaagguaaccgugcug

SEQ ID NO: 25677 - RNA, 333 nt, Artificial Sequence
  derived and/or modified sequence opt3 from anti-HIV_048-034478_VR-Chain
cagagcgugcugacccaacccccuuccgucucugccgcuccaggccagaagguuacaaucucaugcacugggaguggaagcaacauugguaauaacgacguguccugguaccagcagcucccgggcacggcacccagacuucugauauauggggauaauaaaaggccuucuggaaucccagaccgguucucgggcucaaagagcgguaccagugccacauuggggauuacuggauuacaaaccggcgaugaggcggacuacuauuguggcacaugggauaccucccugucugcugggggaguauuugguacuggcacaaaagugaccguccua

SEQ ID NO: 25678 - RNA, 333 nt, Artificial Sequence
  derived and/or modified sequence opt3 from anti-HIV_048-031641_VR-Chain
cagagcgugcugacccaacccccuuccgucucugccgcuccaggccagaagguuacaaucucaugcagugggaacaauagcaacauuggaaauaacuacguguccugguaucagcagcucccggguacugcacccaaacuucugauauacgaaaauucuaagagaccuucgggcaucccagacagguucucagggagcaaaaguggaacguccgccaccuugggcauuacagguuuacaaacuggggaugaggcggacuauuacuguggaaccugggauacaucucugagcgcuggcggcguauuuggguccggaaccaaggugacuguccua

SEQ ID NO: 25679 - RNA, 333 nt, Artificial Sequence
  derived and/or modified sequence opt3 from anti-HIV_048-029760_VR-Chain
cagagcgcccugacccaacccgcuuccgugucuggcucaagugggcagagcaucacaauuuccugcacuggaacgaacucugacgucgguuacgauuauguuuguugguaccagcagcucccuggcaccgcaccaaaacuucugauauaugagaauaacaagagaccgucggggauccccgacagguucucaggaagcaagaguggcacauccgccacuuuggguauuaccggguuacaaacaggagaugaagcggacuacuauugcggcaccugggauacuucucugagcgcuggcgggguguuuggaacagguaccaaaguaacggugcua

SEQ ID NO: 25680 - RNA, 333 nt, Artificial Sequence
  derived and/or modified sequence opt3 from anti-HIV_048-027970_VR-Chain
cagagcgugcugacccaacccccuuccgucucugccccaccgggccagaagguuacaaucucaugcagugggacuacgagcaacauuggauccaauuacguggcuugguaucagcaguuccccgguaccgcaccuaaacuccuuauauacgagaacaauaagagaccaucuggcauccccgacagguuuucggggucaaaaagcggaacaagugccacucugggcauuaccgguuugcaaacaggggaugaagcggacuauuacugugcuaccugggauacuuccuuaucugccggaggcguauucggcacagggaccaaggugacgguccug

SEQ ID NO: 25681 - RNA, 333 nt, Artificial Sequence
  derived and/or modified sequence opt3 from anti-HIV_048-027337_VR-Chain
cagagcgugcugacccaacccccuuccgucucugccgcuccaggccagaagguuacaaucucaugcagugggagcuacuccaacauuggaaauaacuaucucucuugguaccagcagcuuccggguacugcacccaaacuguugauauauaagaauaacaaaagaccuucgggcgugccagacagguucucagggagcaagaguggagccuccgcgacguuagauaucaccggccugcaaacaggugacgaggcugauuacuauugugggauuugggacacuucucuaagcgccggaggcguauuuggcaccgggacaaaagugaccguccuc

SEQ ID NO: 25682 - RNA, 333 nt, Artificial Sequence
  derived and/or modified sequence opt3 from anti-HIV_048-027217_VR-Chain
cagagcgugcugacccaacccccuuccgucucugccgcuccaggccagaagguuacaaucucaugcagugggagcuccucuauuauaggaaacaauuacgugucgugguaucagcagcucccggguacugcacccaaacuucugaucuacgagaacaauaagagaccuucaggcauuccagacagguucagcgggaguaaauccggaacgucugccaccuuggcgaucgcuggcuuacaaacaggugaugaagccgacuauuacugugcaacuugggauaccagccuguccgccgggggaguauuuggcacaggcaccaaggugacuguccua

SEQ ID NO: 25683 - RNA, 333 nt, Artificial Sequence
  derived and/or modified sequence opt3 from anti-HIV_048-026760_VR-Chain
cagagcgugcugacccaacccccuuccgucucugccgcuccaggccagaagguuacaaucucaugcagugggagcuccucuaacauuggaaauaacuacgugucgugguaucagcaccucccggguacugcacccaaacuucugauauacgacacgguaaagagacauucaggcgugccugauagguucagcgggaguaaauccggaaccucugccacauugggcaucagcgguuuacagacuggggacgaggcggauuauuacuguggaaccugggacacaucccugucagcuggcggcgucuuugggaguggaaccaaggugacuguucua

SEQ ID NO: 25684 - RNA, 333 nt, Artificial Sequence
  derived and/or modified sequence opt3 from anti-HIV_048-024800_VR-Chain
cagagcgugcugacccaacccccuuccgucucugccgcuccaggccagaagguuacaaucucaugcagugggagcuacuccaacauuggaaauaacuaugugucuugguaccagguacucccggguacugcacccaaacuucugauauauaagaauaacgagagaccuucgggcaucccagacagguucucagggagcaaaaguggaacguccgccaccuugggcauuacagguuuacagacuggggaugaagcggacuacuauuguggaaccugggauacaucucugagcgcuggcggcguguuugggaccggaacuaaggucacagugcua

SEQ ID NO: 25685 - RNA, 333 nt, Artificial Sequence
  derived and/or modified sequence opt3 from anti-HIV_048-024313_VR-Chain
cagagcgugcugacccaacccccuuccgucucugccgcuccaggccagaagguuacaaucucaugcagugggagcuccucuacuauuggaaacucgcacgugucaugguaccagauacucccggguacggcacccaaacuucugaucuauaaggacgauaaaagaccuagcggcauuccagacagguucaguggguccaagucuggaaccagcgccacauugggcaucacugguuuacagaccggggaugaggcggacuacuauuguggaacaugggauaccucccugaaucggggcggcguauuugggacuggaacaaaagugaccguccua

SEQ ID NO: 25686 - RNA, 333 nt, Artificial Sequence
  derived and/or modified sequence opt3 from anti-HIV_048-021748_VR-Chain
cagagcgugcugacccaacccccuuccgucucugccgcuccaggccagagaguuacaaucucaugcagugggagcacuuccaacauuggaaauaacuacgugucuugguaucagcagcucccggguacggcacccaaacuucugauauacgagaauaacaagaggccuucgggcaucccagaccgguucucagggagcaagaguggaaccuccgccacauugggcauuucugguuuacaaacuggggaugaagcggacuauuacuguggaaccugggauagcucccugucaggcggcgggguauuuggaacagguaccaaagugacuguccua

SEQ ID NO: 25687 - RNA, 333 nt, Artificial Sequence
  derived and/or modified sequence opt3 from anti-HIV_048-020991_VR-Chain
cagagcgugcugacccaacccccuuccgccucuggcacaccagggcagaaggucacuaucucaugcaguggaagcuccucuacgauugguaacaauuacguuucgugguaucaggugcucccgggcaccgcucccaaacuucugauauacaagaacgacaaaagaccuucagggaucccagauagguucagcggaaguaaguccggcacaucugcaacuuuggguauuaccggguuacagacaggagacgaggccgauuauuacuguggcaccugggacacuagccuguccacaggcgggguauuuggaaccgguacgaaagugacuguccua

SEQ ID NO: 25688 - RNA, 333 nt, Artificial Sequence
  derived and/or modified sequence opt3 from anti-HIV_048-020340_VR-Chain
cagagcgugcugacccaacccccuuccgucucugccgcuccaggccagagaguuacaaucucaugcagugggagcuccucuaacgugggaaauaacuacguaucgugguaucagcagcucccggguacugcacccaaacuucugauuuacgagaauaacaagaggccuucaggcauaccagaccgguucagcgggaguaaguccggaacgucugccaccuugggcaucacagguuuacaaacuggggaugaagcggacuauuacuguggaaccugggaugcuagccuguccgccggcggcguguuugggacaggaaccaaagucacugugcua

SEQ ID NO: 25689 - RNA, 333 nt, Artificial Sequence
  derived and/or modified sequence opt3 from anti-HIV_048-019993_VR-Chain
cagagcgugcugacccaacccccuuccgucucuggcgcgccagggcagagaguuacaaucucaugcacuggaaguagcuccucuauugguggcuucgacgugcacugguaccagaggcucccggggacggcuccccggcuucugauauaugagaacaauaagcgcccuucgggaaucccagaucgauuuucaggcagcaaaagugguaccuccgcaacauuggggauuacuggauuacagaccggcgacgaagccgauuacuauuguggcacaugggacucuagccuguccgccgggggaguauucgguaccggcacuaaggugacaguccua

SEQ ID NO: 25690 - RNA, 333 nt, Artificial Sequence
  derived and/or modified sequence opt3 from anti-HIV_048-019947_VR-Chain
cagagcgugcugacccaacccccuuccgucucugccgcuccaggccagagaguuacaaucucaugcagugggagcuccucuaacauuggaucgaaguacgugucaugguaucagcagcucccggguacugcacccaaacuucugauauacgagaauagcaagaggccuaguggcaucccagaccgguucuccgggucuaaaagcggaacguccgccaccuugggcauuacagguuuacaaacuggggaugaagcggacuauuacuguggaaccugggauacaucacugaguaccggcggcguauuugggacuggaacaaaggugaccguccua

SEQ ID NO: 25691 - RNA, 333 nt, Artificial Sequence
  derived and/or modified sequence opt3 from anti-HIV_048-017871_VR-Chain
cagagcgugcugacccaacccccuuccgucucugccgcuccaggccagaagguuacaaucucaugcagugggagcuccucuaacauuggaaauagauacgugucgugguaucagcagcucccggguacugcacccaaacuucugauauacaagaacaauaaaaggccuucaggcaucccagaccgguucagcgggaguaaguccggaacgucugccaccuugggcauuacagguuuacaaacuggggaugaggcggacuauuacuguggaaccugggauggcagccuguccacaggcgggguaaucggaaccgguacuaaagugacaguccua

SEQ ID NO: 25692 - RNA, 333 nt, Artificial Sequence
  derived and/or modified sequence opt3 from anti-HIV_048-015931_VR-Chain
cagagcgugcugacccaacccccuuccgucucugccgcuccaggccagaagguuacaaucucaugcagugggggaagcuccaacauugguucuacuuacgugucgugguaucagcagguaccgggcacggcacccaaacuccuuauauacgagaauaacaagagaccuucagggaucccagacagguucagcggaaguaaauccggcaccucugccacacuggauauuacugguuugcaaaccggggacgaagcggauuauuacuguggaacaugggacaccagcuuauccggcggcgggguguuuggaacugguacaaaggucaccgugcug

SEQ ID NO: 25693 - RNA, 333 nt, Artificial Sequence
  derived and/or modified sequence opt3 from anti-HIV_048-015920_VR-Chain
cagagccugcucacccaacccccuuccgugucugccgcuccaggccagaaggucacaaucucaugcagugggagcuccucuacuauuggaaacaauuacguuucgugguaucaggugcuuccggguacggcacccaaacuguugauauacaagaacaaugagagaccuucaggcaucccagacagguucagcgggaguaaauccggaaccucugccacauuaggcauuacuggucugcagaccggggaugaagcggaguauuacugugcuacaugggacgccagccuauccggaggcggcguauuugggaccggaacuaaggugacaguccuc

SEQ ID NO: 25694 - RNA, 333 nt, Artificial Sequence
  derived and/or modified sequence opt3 from anti-HIV_048-013898_VR-Chain
cagagcgugcugacccaacccccuuccgucucugccgcuccaggccagaagguuacaaucucaugcagugggagcuccucuaacauuggaaaacacucggugucaugguaccagcagcucccggguacugcacccgagcuucugauauaugacaauaacaauagaccuagcggcaucccagauagguucaguggguccaagucuggaacgagcgccaccuugggcauuacagguuuacaaacuggggacgaagcggauuacuauuguggaaccugggacacaucccugucagcuggcggcguauuugggaccggaacuaaagugacaguccua

SEQ ID NO: 25695 - RNA, 333 nt, Artificial Sequence
  derived and/or modified sequence opt3 from anti-HIV_048-013429_VR-Chain
cagagcgugcugacccaacccccuuccgucucugccgcuccaggccagaagguuacaaucucaugcagugggagcuccucuaacauuggaaauaacuacgugucgugguaucagcagcucccggguacugcacccacgcuucugauauacgagaaugacaaaagaccuucaggcaucccagauagguucagcgggaguaaguccggaaccucugccacauugggcauuacugguuuacaaaccggggacgaagcggauuauuacuguggaacaugggacagcucccugucagcuggcggcguauuugggaccggaacuaaagugacaguccua

SEQ ID NO: 25696 - RNA, 333 nt, Artificial Sequence
  derived and/or modified sequence opt3 from anti-HIV_048-012358_VR-Chain
cagagcgugcugacccaacccccuuccgucucugccgcuccaggccagaagguuacaaucucaugcagugggagcaacuccgcaauuggaaauaacuacgugucuugguaucagguacucccggguacugcccccaaacuucugauauacaagaauaacgagagaccuucgggcaucccagacagguucucagggagcaaaaguggaacguccgcgaccuuggauauuacaggcuuacagacuggugacgaagcugauuauuacugugggaccugggacacaucucugagcgccggaggcguguuuggcaccgggacuaaggucacagugcua

SEQ ID NO: 25697 - RNA, 333 nt, Artificial Sequence
  derived and/or modified sequence opt3 from anti-HIV_048-011158_VR-Chain
cagagcgugcugacccaacccccuuccgucucugccgcuccaggccagaagguuacaaucucaugcagugggauuagcuccaacauaggaaauaacgacgugucuugguaccagcagcucccggguacugcacccaaacuucugaucuaugauaaugacaagagaccuucgggcauuccagauagguucucagggagcaaaaguggaacguccgccaccuugggcaucacagguuuacaaacuggggacgaggcggauuacuauuguggaaccugggacucuagccuguccgcuggcggcguauuugggacaggaaccaaggugacuguccua

SEQ ID NO: 25698 - RNA, 333 nt, Artificial Sequence
  derived and/or modified sequence opt3 from anti-HIV_048-010720_VR-Chain
cagagcgugcugacccaacccccuuccgucucugccgcuccaggccagaagguuacaaucucaugcagugggagcuccucuaacauuggaucgcacuacgugucaugguaucagcagguaccggguacugcacccagacucgugauauacgagaauagcaaaaggccuaguggcaucccagaccgguucuccgggucuaagagcggaacguccgccacccuuggcauuacaggucugcaaacuggggaugaagcggacuauuacuguggaaccugggauacaucauugagugcuggcggcgucuuugggagcggaaccaaagugacuguuuua

SEQ ID NO: 25699 - RNA, 333 nt, Artificial Sequence
  derived and/or modified sequence opt3 from anti-HIV_048-009445_VR-Chain
cagagcgugcugacccaacccccuuccgucucugccgcuccaggccagaagguuacaaucucaugcagugggagcuccucuaacauuggaaauaacuacgugucgugguaucagcagcucccggguacuguacccaaacuucugauauacgacacguauaccagaccuucaggcacaccagauagguucagcgggaguaaguccggaacuucugcaaccuuggccaucacaggcuuacaaaccggugacgaggcggauuacuauugugggacuugggacggaagccuguccacaggcggcgugauugggaccggaacgaaagucacugugcua

SEQ ID NO: 25700 - RNA, 324 nt, Artificial Sequence
  derived and/or modified sequence opt3 from anti-HIV_048-006126_VR-Chain
cagagcgugcugacccaacccccuuccgucucuggcgccccagggcagaagguuacaaucucaugcaguggaauuagcuccaacuucgguauaucuugguaccaacaggugccgggcacugcucccaaacuccuuaucuaugagaaugacaagagaccuucggggauuccagauagguuuucaggaagcaaaaguggcacguccgcaacccuggguaucacaggguugcagacuggagacgaagccgauuacuauuguggcaccugggacacaucuuuaagcgcgggcgggguauucggaaccgguacuaaggugacaguccug

SEQ ID NO: 25701 - RNA, 333 nt, Artificial Sequence
  derived and/or modified sequence opt3 from anti-HIV_048-005652_VR-Chain
cagagcgugcugacccaacccccuuccgucucugccgcuccaggccagaagguuacaaucucaugcagugggagcaacuccgcaauuggaaauaacuacgugucuugguaucagguacucccggguacugcccccaaacuucugauauacgacacguauaagagagcgucgggcaucccugauagguucucagggagcaaaaguggaaccuccgcuacauugggcauuacugguuuacagaccggggacgaggccgauuacuauuguggaacaugggacaccucucugagcggcggcgggguguuuggaacugguacaaaggucaccgugcua

SEQ ID NO: 25702 - RNA, 333 nt, Artificial Sequence
  derived and/or modified sequence opt3 from anti-HIV_048-005532_VR-Chain
cagagcgugcugacccaacccccuuccgucucugccgcuccaggccagaagguuacaaucucaugcagugggacuagcuccaacauuggaaauacguacgugucuugguaucagcagcucccggguaccgcacccaacuaccuuauauauaaaaucgacaagagaccuucgggcauuccagauagguucucagggagcaaaaguggaacauccgccacucugggcaucaccgguuugcaaacaggggacgaggcggauuacuauuguggaaccugggacacuucuuuaagcgcuggcggcguauuugggacaggaaccaaggugacgguccug

SEQ ID NO: 25703 - RNA, 333 nt, Artificial Sequence
  derived and/or modified sequence opt3 from anti-HIV_048-005189_VR-Chain
cagagcgugcugacccaacccccuuccgucucugccgcuccaggccagaagguuacaaucucaugcagugggagcggauccacuauugguaacaaugacgugucuugguaccagcagcucccgggcgcagcccccaaacuucugauauaugaggauaacaagagaccuucggggaucccagcgagguucucaggaagcaaaaguggcacguccgcuaccuugcggauuacagguuuacaaacuggggacgaagccgauuacuauuguggaaccugggacucuagccuguccgcaggcggcguauuugggacaggaacccgcgugucaguccua

SEQ ID NO: 25704 - RNA, 333 nt, Artificial Sequence
  derived and/or modified sequence opt3 from anti-HIV_048-005088_VR-Chain
cagagcgugcugacccaacccccuuccgucucugccgcuccaggccagaagguuacaaucucaugcagugggagcuccucuaacauuggaaagaauuacgugucgugguaucagcagcucccggguacugcacccaaacuucugauauacgacaacaauaacagaccuucaggcaucccagauagguucagcgggaguaaauccggaacgucugccaccuugggcauuacagguuuacaaacuggggacgaggcggauuauuacuguggagcuugggacaccagccuguccgccggcggcguauuugggacaggaaccaaggugacuguccua

SEQ ID NO: 25705 - RNA, 333 nt, Artificial Sequence
  derived and/or modified sequence opt3 from anti-HIV_048-004023_VR-Chain
cagagcgugcugacccaacccccuuccgucucugccacaccaggccagaagguuacuaucucaugcagugggggaagcuccaacauugguaaaaaugacgugucuugguaccagcagcucccgggcacggcucccaaacuucugauauaugauaccaacaagagaccuucggggaucccagacagguucucagcagcccggagcggaacaagugcgacuuuggauauuaccggcuuacaaacaggugacgaggcugauuacuauugugggaccugggacacuucccugucugccggaggcguauuuggcacagggaccaaggugacgguccua

SEQ ID NO: 25706 - RNA, 333 nt, Artificial Sequence
  derived and/or modified sequence opt3 from anti-HIV_048-001580_VR-Chain
cagagcgugcugacccaacccccuuccgucucugccgcuccaggccagaagguuacaaucucaugcagugggagcuccucuaacauuggaaauaacuacgugucgugguaucagcagcucccggguacugcacccaaacuucuguuguacgagaauaacaagagaccuucaggcauaccagacagguucagcgggaguaaauccggaacgucugccaccuuagcgaucacaggccugcaaacuggugaugaagcugccuauuacugugggaccugggacggaagccuauccacaggcggcguaauugggaccggaacuaaggugacaguccuc

SEQ ID NO: 25707 - RNA, 333 nt, Artificial Sequence
  derived and/or modified sequence opt3 from anti-HIV_038-221120_VR-Chain
cagagcgugcugacccaacccccuuccgucucugccgcuccaggccagaagguuacaaucucaugcagugggagcacuuccaacauuggaaagaauuacgugucuugguaucagcagcucccggguacggcacccaaacuucugauauacgacaacaaugagagaccuucgggcaucccagauagguucucagggagcaaaaguggaaccuccgccacauugggcauuacugguuuacaaaccggggacgaagcggauuauuacugugcuacaugggacucuagccuguccggaggcggcguauuugggaccggaacucgggugacaguccua

SEQ ID NO: 25708 - RNA, 333 nt, Artificial Sequence
  derived and/or modified sequence opt3 from anti-HIV_038-197677_VR-Chain
cagagcgugcugacccaacccccuuccgucucugccgcuccaggccagaagguuacagugucaugcagugggagcaacuccaauaucggaaaccacuacguaucuugguaucagcagcucccggguacugcacccaaacuucugauuuacgacaauaacaagagaccuucgggcauaccagauagguucucagggagcaaaaguggaacguccgccaccuugggcaucacagguuuacaaacuggggacgaggcggauuauuacuguggaaccugggacucuagccuguccgcuggcggcguguuugggacaggaaccaaggucacugugcua

SEQ ID NO: 25709 - RNA, 333 nt, Artificial Sequence
  derived and/or modified sequence opt3 from anti-HIV_038-196765_VR-Chain
cagagcgcccugacccaacccgcuuccgugucuggcucaccugggcagaguaucacaauuagcugcacuggaacguccggugacgucggcuacaaccucguuucuugguaucagcagcuuccagggaccgcaccgaaggugcugauauacgagaauaacaaaagacccucgggaaucccugauagguucucaggcagcaagagugguacauccgccacuuuggggauuaccggauuacaaacaggcgacgaagcggauuauuacuguggcaccugggacucuagccuguccgcugggggaguauuugguacuggcacaaaagugaccguccua

SEQ ID NO: 25710 - RNA, 333 nt, Artificial Sequence
  derived and/or modified sequence opt3 from anti-HIV_038-186200_VR-Chain
cagagcgugcugacccaacccccuuccgccucuggcacaccagggcagagaaucacuauuucaugcaguggaacgagcuccaacauagguucuaauaucgucucgugguaccagcaccucccgggcaccacacccaaacuuguuauuuucaggaacaaucagcggccuucagggaucccagaccgcuuuagcggaaguaaguccggcacuucugcuacccuggguauuacaggguugcaaaccggagaugaggcagacuauuacuguggcacuugggauagcuccuuaucagccggcgggguguucggaacagguaccaagguaacggugcug

SEQ ID NO: 25711 - RNA, 333 nt, Artificial Sequence
  derived and/or modified sequence opt3 from anti-HIV_038-126170_VR-Chain
cagagcgugcugacccaacccccuuccgucucugccccaccgggccagaagguuacaaucucaugcagugggacuacgagcaacauuggauccaauuacguggcuugguaucagcagcuccccgguaccgcaccuaaacuucugauauacgacaacguaaagagaccaacaaauauccccgauagguucucuggcucgaaaucagggacuagcgccaccuugggaauuacaggcuuacaaaccggugacgaggcggauuauuacugugggacuugggacaguucccugucugcuggaggcguguuuggcacagggaccaaggucacggugcua

SEQ ID NO: 25712 - RNA, 333 nt, Artificial Sequence
  derived and/or modified sequence opt3 from anti-HIV_038-108545_VR-Chain
cagagcgugcugacccaacccccuuccgccucuggcacaccagggcagagagucacuaucucaugcaguggaagcuccucuaacauugguuacaauacgguuucgugguaucagcagcucccgggcaccgcucccaaacuucugauauacgagaacaauaagaggccuucagggaucccagaccgguucagcggaaguaaguccggcacaucugcaacuuuggguauuaccggguuacaaacaggagaugaagccgacuauuacuguggcaccugggauagcucccugucagcgggcgggguguuuggaacugguacaaaaguaaccgugcua

SEQ ID NO: 25713 - RNA, 333 nt, Artificial Sequence
  derived and/or modified sequence opt3 from anti-HIV_038-107263_VR-Chain
cagagcgugcugacccaacccccuuccgccucuggcacaccagggcagagagucacuaucucaugcaguggaagcuccucuaacauugguucgaauacgguuaacugguaccaacaggugccgggcaccgcucccaaucuccuuauauauucaaacgaccagaggccuagcgggaucccagaucgguucaguggauccaagucuggcacaagcgcaacucuggguauuaccggguugcagacaggagacgaggccgauuacuauuguggcaccugggacuccucauuaagugcgggcgggguauuuggaacugguacaaaagugaccguccug

SEQ ID NO: 25714 - RNA, 333 nt, Artificial Sequence
  derived and/or modified sequence opt3 from anti-HIV_038-104530_VR-Chain
cagagcgugcugacccaacccccuuccgucucugccgcuccaggccagaagguuacaaucucaugcagugggagcuccucuaacauuggaucgaauuacgugucaugguaucagcaccucccggguaaagcacccaaacuucugauauacgacaacaauaagagaccuagcggcaucccagauagguucaguggguccaagucuggaacuagcgccacguugggcauuaccgguuuacagacaggggacgaggcggauuauuacuguggaacuugggacuccucacugagugcuggcggcguauuugggaccggaacaaaagugaccguccua

SEQ ID NO: 25715 - RNA, 333 nt, Artificial Sequence
  derived and/or modified sequence opt3 from anti-HIV_038-099169_VR-Chain
cagagcgugcugacccaacccccuuccgccucuggcacaccagggcagagagucucaaucaguugcagcggaauuacuuccucucucgguucgaaccacaugucaugguaccagcagcuuccgggcacggcucccaagcuguugauauaugagaauaacaaaaggccuagcgggaucccagaccgguucaguggauccaagucuggcaccagcgcaacauuagguauuacugggcugcaaaccggagaugaagccgacuacuauuguggcacaugggauuccucacuaagugcgggcgggguuuuuggaaccgguacuaaagugacaguacuc

SEQ ID NO: 25716 - RNA, 333 nt, Artificial Sequence
  derived and/or modified sequence opt3 from anti-HIV_038-075067_VR-Chain
cagagcgugcugacccaacccccuuccgucucuggcgccccagggcagagaguuacaaucucaugcaguggaagcuccucuacuauugguaacaauuacgugucgugguaucagcuccuuccgggcacggcucccaagcuguugauauacaaaaacaauaagaggccuucagggaucccagaccgguucagcggaaguaaauccggcaccucugcaacauuagguauuacugggcugcagaccggagaugaggccgacuauuacuguggcacaugggauaccagccuauccgcgggcgggguauuuggaacugguacaaaggugaccguccuc

SEQ ID NO: 25717 - RNA, 333 nt, Artificial Sequence
  derived and/or modified sequence opt3 from anti-HIV_038-072368_VR-Chain
cagagcgugcugacccaaucccccucugccucaggcacaccugggcagagagucacuaucaguugcagcggauccucuucgaacauugguaauaacuacguuucaugguaucagcagcucccaggcacggcuccgaaacuucugauauacgagaauaacaagaggcccagcgggaucccugaccgguucaguggauccaagucuggcaccagcgcaacauuggguauuacuggguuacaaaccggagaugaagccgacuauuacuguggcacaugggauuccucacugagugcgggcgggguguuuggaaccgguacuaaaguaacagugcua

SEQ ID NO: 25718 - RNA, 333 nt, Artificial Sequence
  derived and/or modified sequence opt3 from anti-HIV_038-068503_VR-Chain
cagagcgugcugacccaacccccuuccgucucugccgcuccaggccagaugguuacaaucucaugcagugggagcagauccaacauugagaaucacuacgugucuugguaucagcaucucccgggagcagcccccaaacuucugauauacgacaacgguaagaggccuucgggcaucccagaucgguucucagggagcaagaguggaacuuccgcgacguugggcauuaccgguuuacagacaggggacgaagcugauuauuacuguggaacuugggacucuagccuguccgccggcggcguauuugggaccggaacaaaagugaccguccua

SEQ ID NO: 25719 - RNA, 333 nt, Artificial Sequence
  derived and/or modified sequence opt3 from anti-HIV_038-068016_VR-Chain
cagagcgugcugacccaacccccuuccgccucuggcacaccagggcagagagucacuaucucaugcaguggaagcuccucuaacauugagucgaauuucguuuacugguaucagcaguuuccggguacgacccccaagcuccuuauauacagggacggccaacggccuucagggaucccagaucgcuucagcggaaguaaauccggcacaucugcuacucuggguauuaccggguugcagacaggagacgaagcagauuauuacuguggcaccugggacagcuccuuaucagccggcgggguguuuggaacugguacaaagguaaccgugcug

SEQ ID NO: 25720 - RNA, 333 nt, Artificial Sequence
  derived and/or modified sequence opt3 from anti-HIV_038-063958_VR-Chain
cagagcgugcugacccaacccccuuccgucucuggcgcgccagggcagagaguuacaaucucaugcacuggaaguagcuccaacauugguaauucuggcgugcacugguaccagcagcucccggggacggcucccaaacuucugauauaugagaacaauaagaggccuucgggaaucccagaccgguucucaggcagcaagagugguaccuccgcaacauuggggauuacuggauuacaaaccggcgaugaagccgacuacuauuguggcacaugggauucuagccuguccgccgggggaguauuugguaccggcacuaaagugacaguccua

SEQ ID NO: 25721 - RNA, 333 nt, Artificial Sequence
  derived and/or modified sequence opt3 from anti-HIV_038-033733_VR-Chain
cagagcgugcugacccaacccccuuccgccucuggcacaccagggcagagagucacuaucucaugcaguggaagcuccucuaacauugguucgaaguacguuuauugguaccagcagcucccgggcacggcucccaaacuucugauauaugacaaugauaagaggccuucagggaucccagaccggauuagcgcaaguaaauccggaaccucugccacauuggauaucacucgcuuacaaaccggcgacgaggcggauuacuauugugguacaugggacagcucccugucagcugggggaguguucggcaccggcacuaagguaacagugcua

SEQ ID NO: 25722 - RNA, 333 nt, Artificial Sequence
  derived and/or modified sequence opt3 from anti-HIV_038-030557_VR-Chain
cagagcgugcugacccaacccccuuccgucucugccgcuccaggccagaagguuacaaucucaugcagugggagcuccucuacuauuggaaacaauuacgugucgugguaucagcuccuuccggguacggcacccaaacuguugauauacaagaacaauaaaagaccuucaggcaucccagacagguucagcgggaguaaguccggaaccucugccacauuaggcauuacuggucugcagaccggggauggagcggacuauuacuguggcacaugggauaccagccuauccgcuggcgggguauuuggaacugguacaaucgugaccguccuc

SEQ ID NO: 25723 - RNA, 333 nt, Artificial Sequence
  derived and/or modified sequence opt3 from anti-HIV_038-024298_VR-Chain
cagagcgugcugacccaacccccuuccgucucugccgcuccaggccagaagguuacaaucucaugcagugggagcuccucuaacauuggaaauucgcacgugucaugguaccagcaguucccggguacuggccccaaacuccuuauauaugagaacgcaaagagaccuagcgggaucccagacaggauuaguggauccaaaucugauacgagcgccacccugggcaucacagguuugcaaacuggggacgaagcggauuacuauuguggaaccugggacuccucauuaagugcuggcggcguauuugggacaggaaccaaggugacuguccug

SEQ ID NO: 25724 - RNA, 333 nt, Artificial Sequence
  derived and/or modified sequence opt3 from anti-HIV_038-011154_VR-Chain
cagagcgugcugacccaacccccuuccgucucugccgcuccaggccagagaaucacaauuucaugcagugggagcuccucuaacauaggaaauaacuacguuucgugguaucagcagcucccggguacugcacccaaacuucugaucuacaagaauaacaagaggccuucaggcauuccagaccgguucagcgggaguaaauccggaacgucugccaccuugggcaucacagguuuacaaacuggggaugaggcggacuauuacuguggaaccugggauacaagccuguccgcuggcggcguguuugggaccggaacuaagguaacagugcua

SEQ ID NO: 25725 - RNA, 318 nt, Artificial Sequence
  derived and/or modified sequence opt3 from anti-HIV-1_LightChain
gagaucgugcugacccagagccccggcacacucucccuuucuccuggggaaagagccacucugucaugcagggcuagucaaagcgucuccaacaauuucuuggcaugguaccaguauaagccaggacagccgccccggguuuuaauuuacgguacgucucgccgagccucgggcauaccugaccguuuuucagggagcggaaguggcaccgaugguucccugacaaucucuagacuagaggcggaagacuucgcuguguauuacugucagcaauaugaguuuuucgggcagggaacuaggcucgaaaugaaacggacc

SEQ ID NO: 25726 - RNA, 318 nt, Artificial Sequence
  derived and/or modified sequence opt3 from anti-HIV-1_LightChain
gaggugguccugacccagagccccggcacacucucccuuucuccuggggaaagagccacucugucaugcagggcuagucaaagcguuucccggaacuacuuggcaugguaucagcagaaguuaggacacgguccacgccugcuaguguacgccacgucucgacgugcgaccggcaucccggacagauucauugggucgcagucaggaacagaguauaaucucacuauaaccaggcuggaucccggcgacuuugcucaauacuucugucagcaguaugaauuuuucgguccugggacacggcuugauaucaaacgcacc

SEQ ID NO: 25727 - RNA, 309 nt, Artificial Sequence
  derived and/or modified sequence opt3 from anti-HIV-1_LightChain
gaagugguccugacccagagccccggcacacucucccuuucuccuggggaaagagccucauucaguugcaagagcucccaauacggacacacugcuugguaucagcagaaacugggucauggcccaagguuguuaaucuacgcaacgucucggcgcgccaccgggauuccggaccgauuuauaggaucgcagucaggcacagaguauaaccugacuaucacccgucuagaucccggugacuucgcgcacuacuuuugucaacagaaugaguucuuugggccuggaacaagacucgauaugaagaggacc

SEQ ID NO: 25728 - RNA, 306 nt, Artificial Sequence
  derived and/or modified sequence opt3 from anti-HIV-1_LightChain
gagaucgugcugacccagagccccuccucucucucacuuaguccuggcgaaagagccagccuguccugcagggggucucacggacaugucgcuugguaccaacacaagccaggucagauuccgcgguuguuaauauaugcaacaucgaaacgcgccucaggcaucagcgaccgauucaguggguccggaucuggcacugaugcgacgcugagcauuucccgucuagagcccgaagacuuugcuguuuacuucugucagcaguaugaguuuuucggucaagggaccagacucgaaaucaagaggaca

SEQ ID NO: 25729 - RNA, 306 nt, Artificial Sequence
  derived and/or modified sequence opt3 from anti-HIV-1_LightChain
gagaucaugcugacccagagccccggcacacucucccuuucuccuggggaaagagccacucugucaugcaggggaagucacggucauguggcuugguaccaacagaagccaggccggauuccgcgcuuguuaauauaugggacgagcaaacgagcauccggaauccccgaccguuucucuggcucggguucagggaccgaugccacacugacuauuagcagacuagagagugaagacuuugcggucuacuucugucagcaguaugaguuuuucggacaaggcaccaggcucgauaucaaccggaca

SEQ ID NO: 25730 - RNA, 309 nt, Artificial Sequence
  derived and/or modified sequence opt3 from anti-HIV-1_LightChain
gagagcgugcugacccagucccccggcacacucucucuuucaccuggggaaacugccagucugagcugcacggcugcauuguacggacacaugaccugguaucaaaagaaaccaggucagccgcccaaguuacugcuauacgccuccucuaaaagagcgucgggcaucccugacagguucucagggagccaguuuggaaagcaguauacacucauuauaacuaaaauggagccagaagauuucgcugaguacuauugucaacaguuugaagucuucggccaggguacccggcuggacaugcgccgaaca

SEQ ID NO: 25731 - RNA, 306 nt, Artificial Sequence
  derived and/or modified sequence opt3 from anti-HIV-1_LightChain
gaggugguccugacccagagccccggcacacucucccuuucuccuggggaaagagccacucugucaugcaggggaagucacggucauuugagcugguaccaauauaagccaggccagccgccccggguuuuaaucuacgggacgucccgccgagcuucuggcauuccugaccguuucucgggaucagguagcgggaccgauggaagucugacaauauccagacuagaggcagaagacuuugccguguauuacugucagcaguaugaguucuuuggccaaggcacuaggcucgaaaugaaacggacc

SEQ ID NO: 25732 - RNA, 309 nt, Artificial Sequence
  derived and/or modified sequence opt3 from anti-HIV-1_LightChain
gaggugguccugacccagagccccggcacacucucccuuucuccuggggaaagagccucacugaguugcaagagcucccaauacggacacacugcuugguaucagcagaaauugggucagggcccaagguuacugaucuacgcaacgucucggcgcgccaccgggauuccggaccgauucucgggaucacaaagcggcacagaguauaaccuaacuauaacccgucucgaucccggugacuuugcgcaguacuucugucagcaguaugaauuuuucgggccuggaacaagacuggauaucaagaggacc

SEQ ID NO: 25733 - RNA, 306 nt, Artificial Sequence
  derived and/or modified sequence opt3 from anti-HIV-1_LightChain
gagaucaugcugacccagagccccggcacacucucccuuucuccuggggaaagagccacucugucaugcaggggaagucacggucauguggcuugguaccaacagaagccaggccggauuccgcgcuuguuaauauaugggacgagcaaacgagcauccggaauccccgaccguuucucuggcucggguucagggaccgaugccacacugacuauuagcagacuagagagugaagacuuugcggucuacuauugucagcaguacgaguucuuuggacaaggcaccaggcucgauaucaagcggaca

SEQ ID NO: 25734 - RNA, 309 nt, Artificial Sequence
  derived and/or modified sequence opt3 from anti-HIV-1_LightChain
gagagcgugcugacccagucccccggcacacucucucuuucaccuggggaaacugccagucugagcugcacggcugcauccuacggacacaugaccugguaucaaaagaaaccaggucagccgcccaaguuguuaaucuucgccacaucuaaaagagcgucgggcauuccugacagguuuucagggagccaguucggaaagcaguacacucugaccauaacacggauggagccagaagauuuugcuggcuauuacugucaacaggucgaguucuuuggucaggggacccgccuagaaauccgacguacu

SEQ ID NO: 25735 - RNA, 309 nt, Artificial Sequence
  derived and/or modified sequence opt3 from anti-HIV-1_LightChain
gacauccagaugacccaaagccccuccucucugucagccagugugggcgauagagucacaauuacuugccaggcuagccaggacauauccaacuaccucaauugguaucagcaaaagccugggaaagcaccaaaacuucugaucuacgaugccucuaacuuggagacgggaguuccgucgagguucucagguagcggcuuucacaccacauucaguuuaacuauuuccgggcugcagcgggacgauuuugcgaccuauuucugugcugugcuagaauuuuucggacccggcacaaagguagacuuuaau

SEQ ID NO: 25736 - RNA, 309 nt, Artificial Sequence
  derived and/or modified sequence opt3 from anti-HIV-1_LightChain
gacauccagaugacccaaagccccuccucucugucagccagugugggcgauagagucacaauuacuugccaggcuagccaggacauaacgaacuaccucaauugguaucagcaaaagccugggagggcaccaaaacuucugguucacggagccuccaacuugcagcggggugugccgucucgcuucucgggcucaggguuucauaccacauucacuuuaaccaucagcagucugcagcccgaugacguagcgacauacuuuugugagguguuccagugguuuggaccuggcacccgagucgauuucaau

SEQ ID NO: 25737 - RNA, 309 nt, Artificial Sequence
  derived and/or modified sequence opt3 from anti-HIV-1_LightChain
ggcuuccagcugacccaaagccccuccucucucucagccagugugggggacagagucagcaucaacugccaggcuggagaggguauuggcuccucucuuaauugguaccagcagaagccugggagggcaccaaaacuguugguucacggagccucgaacuuacaacggggcgugccgucacgcuuuagcgguaguggguuccauacaacuuuuacgcugaccauauccucucuacagcccgaugacguagcgacauauuucugugaaguguuucagugguucggaccuggcacucgagucgauuuuaau

SEQ ID NO: 25738 - RNA, 309 nt, Artificial Sequence
  derived and/or modified sequence opt3 from anti-HIV-1_LightChain
ggcauccagcugacccaaagccccuccucucucucagugagugucggggacagaguuacaauuacuugcagggccagccagggaauagguaacucccuuaauugguaccagcagaagccuggcaaagcuccaaaccugaugguguucgggacgaccaaguugaaucggggaguaccgucucgcuuuucgggcucagguagcgggacaacugcaaccuuaacaaucaacagucugcaacccgaagauauugccaccuauuucugucagguguuugaguuccuaggaccuggcacuaaacucgacaugaag

SEQ ID NO: 25739 - RNA, 309 nt, Artificial Sequence
  derived and/or modified sequence opt3 from anti-HIV-1_LightChain
gacauccagaugacccaaagccccuccucucugucagccagugugggcgauagagucacaauuacuugccaggcugggcagggaauagguagcucccucaagugguaccagcaaaaaccuggcagggcaccacggcuucugguucacggggccucuaacuugcaucgcggagugccgucgcgauucucaggcagcgguuuucacacgaccuucaguuuaacaaucuccgggcugcagcgugacgauuuugcgacuuauuucugugcuguacuagaguuuuucggacccggcaccaagguggacuuuaau

SEQ ID NO: 25740 - RNA, 309 nt, Artificial Sequence
  derived and/or modified sequence opt3 from anti-HIV-1_LightChain
ggcauccagcugacccaaagccccuccucucucucagccagugugggggacagagucacaauuacuugccaggcuagccagggaauagguuccucucuucagugguaccaacagaagccuggcagggcaccaaaccuguugguucacggggccucgaauuuacaucggggagugccgucacgcuucagcggcagugguuuucacacgaccuucucccugacaaucucugggcuacagcgagaugacuuugcgacuuauuucugugcuguacucgaguuuuucggacccggcaccaaaguggaaauuaag

SEQ ID NO: 25741 - RNA, 309 nt, Artificial Sequence
  derived and/or modified sequence opt3 from anti-HIV-1_LightChain
ggcgugcagcugacccaaagccccuccucucucucagccagugucggggacagaguuagcaucaacugccaggcuggacaggguauuggcuccucucuuaauugguaccagcaaaagagggggaaagcaccuaagcuguuggugcacggagccucgacauuacagcggggcguaccaucacgcuucagcgguaguggguuucauacuacguucacccugacaauauccucucuacagccggaugacguggcgacuuauuuuugugaggucuuccagugguuuggacccggcacccgaguggauuucaac

SEQ ID NO: 25742 - RNA, 306 nt, Artificial Sequence
  derived and/or modified sequence opt3 from anti-HIV-1_LightChain
uacauccagcugacccaaagccccuccucucucucagccaguauuggcgacagagugacaauagcuugcagggcaagccaggggaucggauauguccacugguaccagcagaagcgggguaaaccuccaaaacuucugauucauggcgccuccaucuuggagcgcgggguuccgucucgauucucgggaucaggcagcgguacuuuauuuaaccugacggugagugggcuacaacccgaagauuucgcgaccuauaugugucagguauuugaguccuucggaccuggcacaaaggugcagaugaag

SEQ ID NO: 25743 - RNA, 309 nt, Artificial Sequence
  derived and/or modified sequence opt3 from anti-HIV-1_LightChain
ggcauccagcugacccaaagccccuccucucucucagccagucuuggggacagagugacaauuacuugccaggcuagccagggaauagguuccucucugcagugguaccaacagaagccuggcaaagcaccaaaguuguuaguccacggggccucgaaacugcauaggggaguuccgucacgguucagcggcagugguuuucacacgaccuucucccuaacaaucucuagccuccagcccgaagauuuugcgacuuaucugugucaggugcuugaguucuuugggccuggaaccaagguagacuucaac

SEQ ID NO: 25744 - RNA, 309 nt, Artificial Sequence
  derived and/or modified sequence opt3 from anti-HIV-1_LightChain
ggcauccagcugacccaaagccccuccucucucucagccagugugggggacacagucacuauuacgugccaggcuagccagggaauagguuccucucuucagugguaccaacagaagagaggcagggcaccuaaacuguugguucacggggccucgaacuuacagggaggcgugccaucacgguucagcgguaguggguuucauaccacauucacucuggcgauccgcggacuacagccggaugacuuugcuaccuauuucugucaaucccucgaguuuuucggccccggcacaaagguagauaugaaa

SEQ ID NO: 25745 - RNA, 306 nt, Artificial Sequence
  derived and/or modified sequence opt3 from anti-HIV-1_LightChain
uacauccagcugacccaaagccccuccucucucucagccagugugggcgacagagucacaauuacuugcagggcuagccaggauauaggguauguuuccugguacgcacagaagcggggacgcgccccuaaacuucugauccacggugcgucuggcuuggagcgaggggugccaucgcguuucucaggaagcggcagugguacguuauuuacccugacaauugaaucccuacagccggaggacuucgcuacuuauaugugucaaguauuugaaucuuucgggcccggaaccaagguggagaugaaa

SEQ ID NO: 25746 - RNA, 309 nt, Artificial Sequence
  derived and/or modified sequence opt3 from anti-HIV-1_LightChain
ggcauccagcugacccaaagccccuccucucucucagccagugugggggacagagucagcauuaacugccaggcuggacaggguauaggcuccucucuuaauugguaccagcaaaagccugggagggcaccaaaacuguugguucacggagccucgaacuuacagcggggcgugccgucacgcuucagcgguaguggguuucauacaacuuucacgcugaccaucuccucucuacagcccgaugacguagcgacauauuuuugugcuguguuccagugguuuggaccuggcacucgagucgauuucaau

SEQ ID NO: 25747 - RNA, 366 nt, Artificial Sequence
  derived and/or modified sequence opt3 from anti-HIV-1_HeavyChain
agccagcaacuggugcaguccggcacacaggucaagaaacccggggccucuguuagaaucucaugccaggcuaguggauacacauucacugacuaugugcuccacugguggaggcaagcaccuggucagggccuugaguggaugggguggauuaagccaguauacggagcccggaacuaugcgcgccgauuucagggccguauagauuucagcagagacaucuacagggaaauugcuuauauggaucuguccgguuugcggucugacgauacggccuuauacuuuugugcacgcgacgggucgggagaugacaccucauggcaucuggauccguggggccagggcacccuagugaucgucagcgcc

SEQ ID NO: 25748 - RNA, 366 nt, Artificial Sequence
  derived and/or modified sequence opt3 from anti-HIV-1_HeavyChain
agccagcaacuggugcaguccggcacccaggucaagaaacccggggccucuguuagaaucucaugccaggcuaguggauacacauucacugacuaucuccuucacugguggaggcaagcaccuggucagcggcuggaguggaugggcuggauuaagccaguguacggggcccgcaacuaugcgcaucgauuucagggacguauaaauuucgauagagacaucuacagggaaauugcuuuuauggauuugagcggcuuacgguccgacgauacggccguauauuucugugcacgcgacggugggggagaugacagaaccuggcugcuagauacauggggccagggcacucucguggucgugucuucg

SEQ ID NO: 25749 - RNA, 366 nt, Artificial Sequence
  derived and/or modified sequence opt3 from anti-HIV-1_HeavyChain
caggugcaccuggagcaacccggcagcgucguuagauggccuggggccucccucacccuuucuugcacagcuucaggauacaucuucgugaacuaucauauucacuggcugaggcaggcaccaggucagcgguuggaauuacugggcacuauaaauccgguagggggagccacgaguuacgcgcagaaguuucgcggccgucuagugcucacccgagacaucgguagcuccacagucacucugcuucugaaccauuugagaagggaugacucugcuguguauuucugugcccgggagucgaaugcaucagggcgcggaagaagcauggaucacuggggcaggggcagucggguuauugugucccaa

SEQ ID NO: 25750 - RNA, 366 nt, Artificial Sequence
  derived and/or modified sequence opt3 from anti-HIV-1_HeavyChain
caggugcaacugguccagagcggcgccgagguuaagaaacccggggcuuccgugagaguaucuugccaggcaucaggauacaccuucacaaacuauauccuccacugguggaggcaggccccuggucaaggccuugaauggauggggcugauuaagccaguguacggagcggucaauuaugcucggcaguuucagggccgcauacaguugacucgagacaucuaccgugagauugccuucuuagaucugaguggucuaagaagcgacgauacggcaguguauuacugugccagggacgaauccggggaugaccucaaauggcaucugcacccguggggacaaggcacccagguuaucgugucuccc

SEQ ID NO: 25751 - RNA, 366 nt, Artificial Sequence
  derived and/or modified sequence opt3 from anti-HIV-1_HeavyChain
caggugcaacugguccagagcggcgccgagguuaagaaacccggggcuuccgugagaaucucuugccaggcaucaggauacaccuucacagacuauguacuccacugguggaggcaggccccuggucaaggccuugaauggaugggguggauuaagccaguguacggagcgcggaacuaugcucgccgauuucagggccguauaaauuucgauagagacaucuacagggagauugccuauauggaucugagugguuugcggagcgacgauacugcacgcuacuuuugugccagagacggguccggagaugacacgucuuggcauuuacacccguggggccagggcacccuggucaucgugucggcu

SEQ ID NO: 25752 - RNA, 366 nt, Artificial Sequence
  derived and/or modified sequence opt3 from anti-HIV-1_HeavyChain
agccagcaacuggugcaguccggcacccaggucaagaaacccggggccucuguuagagugucaugccaggcuaguggauacacauucacuaacuauauccuccacugguggaggcaagcaccuggucagggccuugaguggauggggcugauuaagccaguauacggagccgugaauuaugcgcggcaguuucagggccgcauacaauugacgcgagacaucuaccgugaaauugcuuucuuagaucugagcggucuaagaaccgacgauacagccgucuauuacugugcaagggacgaguccggggaugaccucaaauggcaucugcacccguggggacagggcacucaggugaucguuucuccc

SEQ ID NO: 25753 - RNA, 366 nt, Artificial Sequence
  derived and/or modified sequence opt3 from anti-HIV-1_HeavyChain
caggugcaccuggagcaaagcggcuccgucguuagauggcccggggccucucucacccuuucaugcacagcuaguggauacaucuucgugaacuaucauauucacuggcugaggcaggcaccuggucagcgguuggaauuaaugggcacuauaaauccaguagggggagccacgagcuacacccagcgcuuucgaggccgucuggugcuaacaagagacaucgguuccaacacugucacccuccugcuuaaucaucugaggucugaugacucggcgguguauuucugugcucgggagucaaacgccagcgggcgcggaagaaguauggaucacuggggcaggggcucccauguuauugugucuccg

SEQ ID NO: 25754 - RNA, 366 nt, Artificial Sequence
  derived and/or modified sequence opt3 from anti-HIV-1_HeavyChain
agccagcaccuggugcaauccggcacccaggucaagaaacccggggccucuguuagagugucaugccaggcuaguggauacacauucacuaacuauauccuccauugguggaggcaggcaccuggucaaggccuugaguggauggggcugauuaagccaguauacggagccgugaauuaugcgcggcaguuucagggccgcauacaguugacgcgagacaucuaccgugauauugcuuucuuagaccugagcggucuaagauccgaugacaccgccgucuauuacugugcaagggaugaaucuggggacgaucucaaauggcaucugcacccguggggacaaggcacacaggugaucguuucgccc

SEQ ID NO: 25755 - RNA, 366 nt, Artificial Sequence
  derived and/or modified sequence opt3 from anti-HIV-1_HeavyChain
agccagcaacuggugcaguccggcacccaggucaagaaacccggggccucuguuagaaucucaugccaggcuaguggauacacauucacugacuaugugcuccacugguggaggcaagcaccuggucagggccuugaguggaugggguggauuaagccaguauacggagcccggaacuaugcgcgccgauuucagggccguauaaauuucgauagagacaucuacagggaaauugcuuauauggaucugagcgguuugcgguccgacgauacggcccgcuacuuuugugcaagagacgggucuggagaugacaccucguggcauuuacacccguggggccagggcacacuggugaucgucucagcc

SEQ ID NO: 25756 - RNA, 366 nt, Artificial Sequence
  derived and/or modified sequence opt3 from anti-HIV-1_HeavyChain
caggugcaccuggagcaacccggcagcgucguuagauggccuggggccucccucacccuuucuugcacagcuucaggauacaucuucgugaacuaucauauucacuggcugaggcaggcaccaggucagcgguuggaauuacugggcacuauaaauccgguagggggagccacgaguuacgcgcagaaguuucgcggccgucuagugcucacccgagacaucgguagcuccacagucacucugcuucugaaccauuugagaagggaugacucugcuguguauuucugugcccgggagucgaaugcaucagggcgcggaagaagcauggaucacuggggcaggggcaaacccguuauugugaguccu

SEQ ID NO: 25757 - RNA, 321 nt, Artificial Sequence
  derived and/or modified sequence opt3 from anti-HIV-1_HeavyChain
gagaucgugaugacccagagccccgccauucuguccgucucuccuggcgacagagcuacauucucaugcagggcaagucaaagcguuaagaacaaucucgccugguaccagaaacggccagggcaggcgccgcgccuucugauauuugaugcuuccucucgagccucgggaauccccgcacguuucucagguggcgggagcggaacugaauuuacguugaccgugaacaguaugcaguccgaggacuucgccacauauuacugucaacaguaugaagaguggccuagaacuuuuggccaggguaccaagguagaaauuaug

SEQ ID NO: 25758 - RNA, 321 nt, Artificial Sequence
  derived and/or modified sequence opt3 from anti-HIV-1_HeavyChain
cagaucgugcugacccaaagcccucccacacucucccuuucuccaggcgagagagccacucugucaugcagggcuagucagagcgucaagaacaauuuggcaugguaccagaaacggccggggcaggcgccccgcuuacugauuuucgacacguccucucgagccucgaacauaccugcucguuuuucaggagguggcagcgggaccgaguucacacuaacuguuaauaguaugcaauccgaagauuuugccaccuauuacugucagcaguaugaagaguggccaagaacauucggacagggcaccaagguggaaaucauu

SEQ ID NO: 25759 - RNA, 321 nt, Artificial Sequence
  derived and/or modified sequence opt3 from anti-HIV-1_HeavyChain
gagaucgugaugacccagagccccgccguccuguccguuucuccuggcgacagagcuacacucucaugcagggcaagucaaagcgugaagaacaaucuugccugguaccagaaacggccagggcaggcgccgcgccuguugauuuucgauacuuccucucgagcuucgaacauacccgcccguuuuucaggagguggcagcgggacggaguucaccuuaacaguaaauaguaugcaguccgaagacuuugcaacuuauuacugucaacaguaugaagaguggccuagaaccuucggacagggcacaaagguggaaaucaac

SEQ ID NO: 25760 - RNA, 321 nt, Artificial Sequence
  derived and/or modified sequence opt3 from anti-HIV-1_HeavyChain
gagaucgugcugacccagagcccucccacacucuccgucucuccaggcgaagccgcuacucuuucaugcagagcaagucaaagcguuaagaacaaucuggccugguaccacuugaaagcggggcaggcuccgagguuacugauuuucgacgccuccucucgggcaggagaugcccccgcucgcgugucggguucaggcuaugggacggaguuuacccuaacaguaaacagcgugcagagugaagacuucggagauuacuauugucagcaauacgaggaauggccucgaacuuuuggccaggguaccaaggucgaccuccgu

SEQ ID NO: 25761 - RNA, 321 nt, Artificial Sequence
  derived and/or modified sequence opt3 from anti-HIV-1_HeavyChain
gagaucgugaugacccagucacccccuacacuguccgucucuccaggcgaaacugccacgcucucaugcagagcuagucaaaacguuaagaauaaccuugcaugguaccagcugaaaccggggcaggcccccagguuguuaauuuucgacgcgagcucccgggcuggagguauaccugaucgcuuuucuggcucgggguauggaaccgacuucacacugacugugaauagcguacagagcgaggauuuuggcgacuacuucugucaacaguaugaagaguggccacgaaccuuuggucaggggacaaagguggaucuacgu

SEQ ID NO: 25762 - RNA, 321 nt, Artificial Sequence
  derived and/or modified sequence opt3 from anti-HIV-1_HeavyChain
gagaucgugaugacccagagccccgccguccuguccguuucuccuggcgacagagcuacacucucaugcagggcaagucaaagcgugaagaacaaucuugccugguaccagaaacggccagggcaggcgccgcgccuguugauuuucgauacuuccucucgagcuucgaacauacccgcccguuuuucaggagguggcagcgggacggaguucaccuuaacaguaaauaguaugcaguccgaagacuuugcaacuuauuacugucaacaguaugaagaguggccuagaaccuucggacagggcacaaagguggaaaucauu

SEQ ID NO: 25763 - RNA, 399 nt, Artificial Sequence
  derived and/or modified sequence opt3 from anti-HIV-1_HeavyChain
gaggugcaucugcaggaaagcggccccgggcucgucagaccucuugagacccuguccuugacaugcacugccucuggagcuucaaucagggguggcgaauggggagacaacgauuaccacuggggguggguucggcacaguccagagaagggcuuagaauggauugguagcauacauuggcgcgggacgacccacuauaaugcaccguuccgaggacgugccacacuguccaucgacacuucuagaaaccaauuuuuccuaaggcucaccucgaugacagcggaugacaccgcuguguacuauuguguaaaacauaaguaccacgauauugugauggucgugcccaucgccggcugguuugacccuuggggccaggggcugcagguuacugugucagca

SEQ ID NO: 25764 - RNA, 399 nt, Artificial Sequence
  derived and/or modified sequence opt3 from anti-HIV-1_HeavyChain
gaggugcaucugcaggaaagcggccccgggcucgucagaccucuugagacccuguccuugacaugcacugccucuggagcuucaaucagggguggcgaauggggagacaacgauuaccacuggggguggguucggcacaguccagagaagggcuuagaauggauugguagcauacauuggcgcgggacgacccacuauaaugcaccguuccgaggacgugccacacuguccaucgacacuucuagaaaccaauuuuuccuaaggcucaccucgaugacagcggaugacaccgcuguguacuauuguguaaaacauaaguaccacgauauugugauggucgugcccaucgccggcugguuuaauccuuggggccaggggcugcaggcaacuguuccauca

SEQ ID NO: 25765 - RNA, 399 nt, Artificial Sequence
  derived and/or modified sequence opt3 from anti-HIV-1_HeavyChain
caggugcaacugaaggagagcggccccgggcucgucaaaccuuccgaaacccuuucucugacaugcacuguuucaggagguaguaugagaggcacggacuggggagagaacgauuuccacuacggguggaucaggcauagcuccgccgaaggcuuggaguggauugguucuauacacuggcgggggaccacacauuauaagaugucguuucgcucacgagcuacuaucagcauugacaccaguaauaaccguuucuccuuaauguuuucuuucgugacagcagaagauaccgccguauacuauugugcgagacacaaauaccaugacaucuuuaggguggucccaguggcuggaugguucgauccguggggccagggccugcuaguuacugugagcucc

SEQ ID NO: 25766 - RNA, 399 nt, Artificial Sequence
  derived and/or modified sequence opt3 from anti-HIV-1_HeavyChain
gaggugcaucugcaggaaagcggccccgggcucgucagaccucuugagacccuguccuugacaugcacugccucuggagcuucaaucagggguggcgaauggggagacaacgauuaccacuggggguggguucggcacaguccagagaagggcuuagaauggauugguagcauacauuggcgcgggacgacccacuauaaugcaccguuccgaggacgugccacacuguccaucgacacuucuaaaaaccaauuuucgcuaagacucaccucaaugacagcggaugacaccgcuguguacuauuguguaaagcauaaauaccacgauauugugauggucgugcccuucgccggcugguuugacccuuggggccaggggcugaggguuacugugagcgca

SEQ ID NO: 25767 - RNA, 399 nt, Artificial Sequence
  derived and/or modified sequence opt3 from anti-HIV-1_HeavyChain
gaggugcaucugcaggaaagcggccccgggcuggucagaccucuugagacccuguccuugacaugcacugccucuggagcuucaaucagggguggcgaauggggagacaacgauuaccacuggggguggguucggcacaguccagagaagggcuuagaauggauugguagcauacauuggcgcgggacgacccacuauaaugcaccguuccgaggacgugccacacuguccaucgacacuucuaaaaaccaauuuuuccuaagacucaccucgaugacagcggaugacaccgcuguguacuauuguguaaagcauaaauaccacgauauuugcauggugguccccaucgccggcugguuugacccuuggggccaggggcuccaggugacuguuucacag

SEQ ID NO: 25768 - RNA, 399 nt, Artificial Sequence
  derived and/or modified sequence opt3 from anti-HIV-1_HeavyChain
caggugcaucugcaagagagcggccccgggcucgucagaccucuugaaacccuguccuugacaugcacugccucuggagcuucaaucagggguggcgaguggggagacaacgauuaccacuggggguggguucggcacaguccagaaaagggcuuagaguggauugguagcauacauuggcgcgggacgacccacuauaaugcaccguuccgaggacgugccacacuguccaucgacacuucuagaaaccaguuuuuccuaaggcucaccucgaugacagcggaugacaccgcuguguacuauuguguaaaacauaaguaccacgauauugugauggucgugcccaucgccggcugguuugacccuuggggccaggggcugcagguuacugugucaagc

SEQ ID NO: 25769 - RNA, 399 nt, Artificial Sequence
  derived and/or modified sequence opt3 from anti-HIV-1_HeavyChain
caggugcaucugcaagagagcggccccgggcucgucagaccucuugaaacccuguccuugacaugcacugccucuggagcuucaaucagggguggcgaguggggagacaacgauuaccacuggggguggguucggcacaguccagaaaagggcuuagaguggauugguagcauacauuggcgcgggacgacccacuauaaugcaccguuccgaggacgugccacacuguccaucgacacuucuagaaaccaguuuuuccuaaggcucaccucgaugacagcggaugacaccgcuguguacuauuguguaaaacauaaguaccacgauauugugauggucgugcccaucgccggcugguuugacccuuggggccaggggcugcggguuacugugucacag

SEQ ID NO: 25770 - RNA, 399 nt, Artificial Sequence
  derived and/or modified sequence opt3 from anti-HIV-1_HeavyChain
caggugcaucugcaagagagcggccccgggcucgucagaccucuugaaacccuguccuugacaugcacugccucuggagcuucaaucagggguggcgaguggggagacaacgauuaccacuggggguggguucggcacaguccaggcaaggguuuagaauggauugggagcauacauuggcgcggaacgacccacuauaaugcaccguuccgaggccgugccacacuguccaucgacacuuuuagaaaccaguucuuucuaaggcucaccucuaugacagcggaugacaccgcuguguacuauuguguaaaacauaaguaccacgauauugugauggucgugcccaucgccggcugguucgacccuugggggcagggacugcagguuacugugucgcaa

SEQ ID NO: 25771 - RNA, 399 nt, Artificial Sequence
  derived and/or modified sequence opt3 from anti-HIV-1_HeavyChain
gaggugcaucugcaggaaagcggccccgggcucgucagaccucuugagacccuguccuugacaugcacugccucuggagcuucaaucagggguggcgaauggggagacaacgauuaccacuggggguggguucggcacaguccagagaagggcuuagaauggauugguagcauacauuggcgcgggacgacccacuauaaugcaccguuccgaggacgugccacacuguccaucgacacuucuagaaaccaauuuuuccuaaggcucaccucgaugacagcggaugacaccgcuguguacuauuguguaaaacauaaguaccacgauauugugauggucgugcccaucgccggcugguuugacccuuggggccaggggcugcggggaacuguuucagca

SEQ ID NO: 25772 - RNA, 393 nt, Artificial Sequence
  derived and/or modified sequence opt3 from anti-HIV-1_HeavyChain
caggugcaacugguccagagcggcgccguuaucaagacccccggguccucugugaaaauuucaugcagagcuaguggauacaacuucagggacuauagcauacacuggguacggcucaucccugauaaggguuuugaguggauuggcuggaucaaaccacuuuggggagcaguguccuacgcccgccagcugcaggggcgagucucuaugacacgucaauugucgagagacccggaugaccccgauuggggcguggcguauauggaguucucagguuuaacuccugcugacacggccgaauacuuuuguguuaggcgggggagcugcgauuauuguggagacuucccauggcaguacuggggccagggcaccguggucgugguaaguuccgca

SEQ ID NO: 25773 - RNA, 393 nt, Artificial Sequence
  derived and/or modified sequence opt3 from anti-HIV-1_HeavyChain
caggugcaacugguccagagcggcgccguuaucaagacccccggguccucugugaaacucucaugcagagcuaguggauacaacuucagggacuauagcauucacuggguacggcuuauaccugauaaggguuuugaguggaucggcuggauuaaaccacuguggggagcaguguccuacgcccgccaguugcaggggcgagucucuaugacacgucaauuaucgcaggacccggaugaccccgauuggggcguggcguauauggaguucucaggucugacuccugcugacacggccgaauacuuuuguguuagaagggggagcugcgauuauuguggagacuucccauggcaguacuggggccagggcaccguggucgugguaaguuccgca

SEQ ID NO: 25774 - RNA, 303 nt, Artificial Sequence
  derived and/or modified sequence opt3 from anti-HIV-1_LightChain
accgccggccugacacagagccccgggacucucucccuuucuccuggagagagagcuauccugucaugcaggacgagucaauacgguagcuuggcaugguaucagcagcggccaggccaggccccgcgcuuagugauuuacgcggggcugacccgagcuacaggaauacccgaccguuucuccggcucuagauggggugccgaauauaaccuaacuaucucgaaucucgagucagaagauuuuggggucuacuauugucaacaguacgacuucuuuggacagggcaccaagguucagguggau

SEQ ID NO: 25775 - RNA, 378 nt, Artificial Sequence
  derived and/or modified sequence opt3 from anti-HIV-1_HeavyChain
caggugcaacugguccagagcggcuccgggguuaagaaacucggagccucugugagaguaucaugcuggaccagugaggacaucuucgaaaggacagagcuuauucacugggugcggcaggcucccggucagggccuggaauggauagggugggucaaggcagugagcggagccguuaacuacggcuccuuggauuuucgccaucgagugucuuuaacucgugacagagaucugucgacggcgcacauggacaucaggggucuaacccaagaugacacagcuacuuauuucugugcccggcagaaauuugcacgcggggaucagggaugguucuuugaccucuggggcagaggcacccugauugucgugucaagcgcc

SEQ ID NO: 25776 - RNA, 384 nt, Artificial Sequence
  derived and/or modified sequence opt3 from anti-HIV-1_HeavyChain
caggugcaacugguccagagcggcuccgggguuaagaaacucggagccucugugagaguaucaugcuggaccagugaggacaucuucgaaaggacagagcuuauucacugggugcggcaggcucccggucagggccuggaauggauagggugggucaaggcagugacuggaacgguuaacuuuggcagcuugaauuuccgccaacgaguguccuuaacccgugauagagaccuguuuacagcccauauggauaucaggggucuaacucagggggacaccgcgacauacuucugugcucggcagaaauuugagaaguauaccggaggccagggcugguacuucgaucucugggggcgcggaacucugauugucgugucuucggcc

SEQ ID NO: 25777 - RNA, 378 nt, Artificial Sequence
  derived and/or modified sequence opt3 from anti-HIV-1_HeavyChain
caggugcaacugguccagagcggcuccgccaugaagaaacccggggcuucuguuagagugucaugcuggaccagugaggacaucuucgauacaacugaacucauuuacuggguaaggcaggcaccuggacagggucuugaguggauaggcugggugaagaucgucagcgggacggugaacuuugccucccuggacuuccggaaucgcauuucuuugucgcgagaucgugacuuauuuaccgcgcacauggauaucagaggacugacacaaggcgacacugcuaccuauuucugugccaggcagaaauuuuacgccggugggcagggaugguauuucgaucuauggggccggggcacacucauuguugugucaagcgca

SEQ ID NO: 25778 - RNA, 387 nt, Artificial Sequence
  derived and/or modified sequence opt3 from anti-HIV-1_HeavyChain
caggugcaacugguccagagcggcgccgagguuaagaaacccggggcuuccgugagaguaucuugcuggaccucagaagacaucuucgauacaacugagcucauuuacugggugaggcaggcaccuggacagggucuugaauggauaggcugggucaagaucgugagugggacgguuaacuuugccagccuggacuuccggaaucgcauuuccuugucucgagaucgugacuuaucgaccgcgcacauggauaucagaggacugacacaagacgauacugcuaccuauuuuugugccaggcagaaauucgagucacgguacacaggcggucaggggugguauuuugaccuauggggacgcggcacccauauuguggucagcagugca

SEQ ID NO: 25779 - RNA, 387 nt, Artificial Sequence
  derived and/or modified sequence opt3 from anti-HIV-1_HeavyChain
caggugcaacugguccagagcggcuccgccaugaagaaacccggggcuucuguuagagugucaugcuggaccagugaggacaucuucgaaaggacagagcucauuuacuggguacggcaggcaccuggacgcggucuugaauggauaggcugggugaagacugucagcgggacggugaacuuuggauccucugauuuccgaaaucguaucucgcugaccagagacagggauuugucaacagcccacauggacauucggggcuuaacucaggaugacaccgcgacauauuuuugugcucgccaaaaauucgagagccuguacagugaugaccaggguuccuauuuugaucuaugggggagaggaacccucaucauuguuucuagcgcc

SEQ ID NO: 25780 - RNA, 387 nt, Artificial Sequence
  derived and/or modified sequence opt3 from anti-HIV-1_HeavyChain
caggugcaacugguccagagcggccucgagguuaagaaacccggggccuccgugagaguaucuugcuggaccucagaagacaucuucgauacaacugagcuuauuuacugggugaggcaggcuccuggacagggucuggaauggauaggcugggucaagaucgugagugggacgguuaacuuugccagcuuggacuuccggaaucgcauuuccuuaucucgagaucgugaccugucgaccgcacacauggauaucagaggacuaacacaagacgauacugcgaccuauuuuugugcuaggcagaaauucgccucacgguacagcggcgaccaggguaguuauuuugaucucugggggcgcggaacacugauuaucguguccucugca

SEQ ID NO: 25781 - RNA, 387 nt, Artificial Sequence
  derived and/or modified sequence opt3 from anti-HIV-1_HeavyChain
caggugcaacugguccagagcgccuccggcguuagaaggcccggggcuucugugcggguaucaugcuggaccagugaggacaucuucgaacgcagcgagcucauuuacugggugcgacaggcaccuggacguggucuugaauggauaggcuggaucaagcuggucuccggggccgugaacuuuggaucuguugauuucagagacagggugucguugacacgggaucgcgacuuauuuacugcgcacauggauauuagaggccugacgcaggacgauaccgcuacauauuucugugccaggcaaaaauuugcaucacgguacagcggugaccaggggaguuauuucgaucuauggggacgcggcacucucaucauugucuccucugcc

SEQ ID NO: 25782 - RNA, 375 nt, Artificial Sequence
  derived and/or modified sequence opt3 from anti-HIV-1_HeavyChain
caggugcaacugguccagagcggcuccgggguuaagaaacccggagccucugugagaguaucaugcuggaccagugaggguaucuucgaaaagagcgagcucauucacugggugaggcaggcuccuggccaggggcuugaauggauaggaugggucaaaacagugacuggcgcaguuaacuuuggucaucaaaucuccgaccgggugucucugacgcgcgaucgagacuuguucaccgcccacauggauauucguggguuaacacagggagacacugcgaccuacuuuugugcuagacagaaguucgagaggggcggccagggguggaucuuugaucuguggggacgggguacacuaauugccgucucgucagca

SEQ ID NO: 25783 - RNA, 378 nt, Artificial Sequence
  derived and/or modified sequence opt3 from anti-HIV-1_HeavyChain
caggugcaacugguccagagcggcgccgagguuaagaaacccggggcuuccgugagaguaucuugcuggaccucagaagacaucuucgagaagagugaacucauucacugggugaggcaggcaccuggacagggucuugaguggauaggcugggucaaaacagugacuggggccguuaacuuuggaagcuccgauuuccggcaacgcgugucucugacgcgagaccgugauuuguuuaccgcgcauauggacaucagaggcuuaacacagggugauacugcuaccuacuucugugccaggcagaaguuugaacgcgggggacagggcugguauuucgaccuguggggccgggggacacuaauugucgugucgucagca

SEQ ID NO: 25784 - RNA, 378 nt, Artificial Sequence
  derived and/or modified sequence opt3 from anti-HIV-1_HeavyChain
caggugcaacugguccagagcggcgccgagguuaagagacccggggcuuccgugaaaguaucuugcuggaccucagaagacaucuucgagaggacagaacucauucacugggugcggcaggcaccuggacagggucuugaguggauaggcugggucaagacugugaguggggccguuaacuuuggaagcccaaauuuccgccaucgagugucccugacgcgugauagagacuuguuuaccgcgcacauggauaucaggggcuuaacacaaggugacacugcuaccuacuucugugcccggcagaaauuugaacgcgggggacagggcugguauuucgaucuguggggcagagggacacuaauugucgugucuucggca

SEQ ID NO: 25785 - RNA, 378 nt, Artificial Sequence
  derived and/or modified sequence opt3 from anti-HIV-1_HeavyChain
caggugcaacugguccagagcggcuccgggguuaagaaacccggagccucugugagaguaucaugcuggaccagugaggacaucuucgaagguagcgagcucauucacugggugaggcaggcuccuggccaggggcuugaauggauaggaugggucaagacagugacuggcgcaguuaacuuugguuccgccuacuuccggcaucgcgugucucugacgcgagaucgugacuuguuuaccgcgcacauggauaucagaggguuaacacaaggagacacugcuaccuauuucugugccaggcagaaauuuaugucgggcggccaggggugguacuucgaucuguggggacgggguacagucauugugguaucaagcgca

SEQ ID NO: 25786 - RNA, 387 nt, Artificial Sequence
  derived and/or modified sequence opt3 from anti-HIV-1_HeavyChain
caggugcaacugguccccagcggcuccgggguuaagaaaccuggagccucugugagaguaucaugcuggaccagugaggacaucuucgaaaggacagagcucauucacugggugcggcaggcuccaggucagggccuugaauggauagggugggucaagacugugacgggagcaguuaacuuuggcagccuggauuuccgccaucgaaucuccuugacccgugacagagauuuauuuacagcccacauggacauuaggggucugacucagggggauaccgcgacauacuucugugcucggcaaaaauuugagucucgcuauaccggaggccagggcugguacuucgaccuaugggggagaggaacucauaucguggucucgucagcc

SEQ ID NO: 25787 - RNA, 378 nt, Artificial Sequence
  derived and/or modified sequence opt3 from anti-HIV-1_HeavyChain
caggugcaacugguccagagcggcuccgggguuaagaaagugggagccucuguaagagugucaugcuggaccagugaggacaucuucgaaaggacagagcucauucacuggguccggcaggcucccggucagggccuugaauggauagggugggugaaggcaguuagcggagccgugaacuacggcucccuggauuuucgccaucgagucucuuugacucgugacagagauuuauucacggcgcacauggacaucaggggucugacccaagaugacacagcuauuuauuuuugugcccggcagaaauucuacgcagggggacagggcugguauuuugaucuauggggccgcgggacucucaucgugguaucgucagcc

SEQ ID NO: 25788 - RNA, 387 nt, Artificial Sequence
  derived and/or modified sequence opt3 from anti-HIV-1_HeavyChain
caggugcaacugguccagagcggcgccgagguuaagaaacccggguccucugugagaguaucaugcuggaccagugaagacaucuucgagaggacagaacucauucacugggugcggcaggcuccuggacagggucuugaguggauaggcugggucaagacugugacgggggcaguuaacuuuggaagcccaaauuuccgccaucgagugucccugacccgugauagagacuuguuuacagcccacauggauaucaggggcuuaacucaaggugacaccgcgacauacuucugugcucggcagaaauuugaaucucgcuauucgggggaucagggaucauacuucgaccuguggggcagaggcacccuaauuaucgucagcagugcc

SEQ ID NO: 25789 - RNA, 375 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacaaguuauuacaugcacugggugagacaggccccuggucagggccucgaauggaucgggugggucaagccagugacuggagcgguuaacuuuggcagcccgaauuucaggcaucgggugucccuuacgcgcgaccgagaucuguuuaccgcucacauggacauucgugguuugacacaaggggauacugccaccuauuucugugcaagacagaaauacuaugccggaggccagggcugguacuuugacuuaugggggaggggaacacugauagucgugucuucggcu

SEQ ID NO: 25790 - RNA, 375 nt, Artificial Sequence
  derived and/or modified sequence opt3 from anti-HIV-1_HeavyChain
caggugcaacugguccagagcggcgccgagguuaagaaacccggggcuuccgugcagguaucuugcaaggcaucaggauacccuuucaccaaauauuacaugcacugggugagacaggccccaggucaaggccucgaauggaucgggugggucaaggcggugaguggagcuguuaacuauggcagccuugacuuuaggcaucgggugucccugacacgcgaucgagacuugucuacugcccacauggauauucgugguuuaacgcaggacgauaccgcaacauacuucugugccagacagaaauuugcuaggggagaccaggggugguucuuugaucuguggggccggggcacucuaauagucgugucgucagca

SEQ ID NO: 25791 - RNA, 375 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacagguuauuacaugcacugggugagacaggccccuggccaggggcucgaauggaucggaugggucaagacugugaguggcgcgguuaacuuugguagccuuaauuucaggcaucgggugucccugacgcgcgaccgagauuuguuuaccgcucacauggacauucguggguuaacacaaggagauacugccaccuauuucugugcaagacagaaauuugccaggggcgaccagggcugguucuuugaucugugggggcggggaacacuaauagucgugucuucggcu

SEQ ID NO: 25792 - RNA, 402 nt, Artificial Sequence
  derived and/or modified sequence opt3 from anti-HIV-1_HeavyChain
caggugcaacugguccagagcggcuccgggguuaagaaacccggagccucugugagaguaucaugcagggcuagugaggaccucuucggugaugaaaucauuuacgacgaugaggugauacacuggcuucggcaggucccuggccagcgcccagaauggaugggguggauccgaccgaagaccggagcacguaaccaagccagacaguuucagcccaggauuagccugacacgggaccgcgcguuguccacugcuuauuuagaucuaaauucucugacgucggccgacucaggcaccuacuucugugcaagacagacauuuaaaccugauuucuauuuugccgaccaagguuggagcuucaaccucugggggaggggagcucauuuuaucgugaguuccgca

SEQ ID NO: 25793 - RNA, 381 nt, Artificial Sequence
  derived and/or modified sequence opt3 from anti-HIV-1_HeavyChain
caggugcaacugguccagagcggcgggggaguuaagaaacccggugccuccgcuucuuucucaugcagaaccagugaggacccuuuugauaacgaauuuuucgacagcgaguucaugcacugggugaggcucacaccaggccagcggccggaauggaugggguggaugaauccccgcuccggaggcguaaacuacgcaggucaguuucgaccucguaugucuauguggagagauagggagcuuucgacugccuauauggaacugcgggacuugacguucgcggauaccggguuauacuuuugugcucgcagaaaggaggacgauuaugacugguacuaugaucuguggggaaggggcgcccauaucauugugucagcagcc

SEQ ID NO: 25794 - RNA, 384 nt, Artificial Sequence
  derived and/or modified sequence opt3 from anti-HIV-1_HeavyChain
caggugcaacugguccaggccggcgggggaguuaagaaacccggugcuagcgugacccucuccugcaagacagcagacgaggauguauucgacgccgcguacaugcacugggugagacaggcuccuggccagacuuuugaauggcuuggguggaugaaaccagucacgggagccgugaacuaugcaaggaaguuccaaggccggguuucuuuuuaccgcacccgagagcuggguaucgccuauauggauuugcguaauuuaagauucgacgauacagcuguguacuuuugugcaaggaaaacugccggggacgucucaggagauaagcggggcuucuuuuucgaccuguggggccgcgggaguagagugauuguaagcuccgcu

SEQ ID NO: 25795 - RNA, 384 nt, Artificial Sequence
  derived and/or modified sequence opt3 from anti-HIV-1_HeavyChain
caggugcaacugguccagagcggcgccgagguuaagaaacccggggcuuccgugacccucucuugcaagacagcagacgaagauguauucgacgccgcguacaugcacugggugagacaggcuccuggacagacuuuugaguggcuugguuggaugaaaccagucacgggcgccgugucauaugcaaggaaguuccaagggcggguuaguuuuuacaugacccgcgaacugggaauggccuauauggauuugcgaaacuuacguuucgacgauacagcuguguacuuuugugcaagaaaaacugccggcgacgucagcggugauaauaggggguauuucuuugaccuguggggacggggcucccgcgugaucguaucuucggcu

SEQ ID NO: 25796 - RNA, 384 nt, Artificial Sequence
  derived and/or modified sequence opt3 from anti-HIV-1_HeavyChain
caggugcaacugguccagagcgaggccgaaguuaagaaacccggcgcuuccaugaccgugucuugcgagacagcagacgaagauaucuucgacgccgcguacaugcacuggguaagacaggcuccugggcagacuuuugaguggcucggauggaugaagccagugacgggugccgucaacuaugcaaggaaauuccaaggccggauuucauuuuaccgcacccgagaacuugccauagcuuauauggaucugcgugacuugagauucgaugacacagcaguguacuuuugugccaggaagacugcuggggauguuaguggagacaaucggggcuauuucuuugauuuauggggucgcgggagcagagugaucgucuccucugcc

SEQ ID NO: 25797 - RNA, 420 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcuccuuuggguuaggcaggcaccuggacagggucuggaauggauuggcugggugaagauaguauccgggacggugaacuuugccucuuuggacuuccggaaucgcaucucguuaucacgagaucgugaccugagcaccgcgcauauggauauuagaggacuaacacaggacgauacugcuaccuacuauugugccaggcaaaaauuugcaagucgguacuccggcgaccaggguucuuauuucgaucucugggggcgcggaacacugaucauugucagcuccgccucaaccaagggcccaaguguguuuccgcacgaccuu

SEQ ID NO: 25798 - RNA, 417 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuuguuuacagcccauauggacauucggggcuuaacucagggugauaccgcgacauauuucugugcucgccagaaauuugaaagagggggacaaggcugguacuucgaccuguggggcagggggacccuaaucgucgugagcagugccuccacuaacggaccaauuggucucccgccccggucugca

SEQ ID NO: 25799 - RNA, 423 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugaaucacuguauagcgacgaucagggaaguuacuucgaccuauggggccggggcacacucauuaucguuuccucugcaagcaccaaagggccauccucaaguccgacuauuugc

SEQ ID NO: 25800 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugaacgcggaggccagggcugguauuucgaucugugggggagaggaacacuaauuguugugucgucagcaagcaccaaggguccgagugucuuuccccacgaccucagg

SEQ ID NO: 25801 - RNA, 411 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugaacgcggaggccagggcugguauuucgaucugugggggagaggaacacuaauuguugugucgucaagccuccaccaggguccgaguggccugccccaugac

SEQ ID NO: 25802 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuguugugucaagcgccaguaccaaagguccauccgucuuuccgcaugaucuccgc

SEQ ID NO: 25803 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuauugugcccggcaaaaauucgaaucgcuguacucagaugaccagggaagcuauuuugaucuauggggccgcggcacacucauuaucguuaguuccgcaucuaccaaggggccgagcguguucccccacgaccugaga

SEQ ID NO: 25804 - RNA, 384 nt, Artificial Sequence
  derived and/or modified sequence opt3 from anti-HIV-1_HeavyChain
caggugcaccuggagcaaagcggcuccggggucaagaaacccggagccucuguuagagugucaugcuggaccagugaagacaucuucgaaaagagcgagcucauucauuggguaaggcaggcuccuggucagggccuugaguggauagggugggugaaaacagucacuggagcagugaacuuuggcuccucugauuuccggcagcgcguuucgcugacgcgagaccgugauuuguuuaccgcccacauggacaucagagguuuaacacaaggggauacugcgaccuacuucugugcuaggcagaaguuugaaucacgguauacaggaggccagggcugguacuucgaccugugggggcgcggaacccauauuguggucagcagu

SEQ ID NO: 25805 - RNA, 423 nt, Artificial Sequence
  derived and/or modified sequence opt3 from anti-HIV-1_HeavyChain
cagguguacauggagcaagccggcgcuggggucaagaaacccggagcaagcguuacccuguccugcaagacagccgacgaagauguguucgacgcggcuuauaugcacuggguaagacaggccccuggucagacuuuugaguggcucggcuggaugaaaccagugacgggggcagucaacuacgccaggaaguuccagggacgggugucuuuuuaucgcacccgagaacuuggcaucgcuuacauggaucugcguaauuugagauucgacgauacagcaguuuauuuuugugccaggaaaacugcuggugacgugucaggggauaagcggggauucuuuuucgacuuauggggccgcggcaguagagucauugugagcuccgccucuaccaaggggccgucgguauuuccccaugaucugagg

SEQ ID NO: 25806 - RNA, 414 nt, Artificial Sequence
  derived and/or modified sequence opt3 from anti-HIV-1_HeavyChain
caggcccaccuggagcaaagcggcuccggggugaagaaacccggaaccucugucagaguuucaugcuggacaagugaagacaucuucgagaggacugaacucauucauugggugcggcaggcuccuggucagggccuugaguggauaggguggguaaagacggugaccggagcagucaacuuuggcagcccaaauuuccgccaccgagugucccugacacgugauagagacuuguuuacugcccauauggauaucagggguuuaacccagggggacacagcgaccuacuucugugcucggcaaaaauuugcccgcggagaucagggcugguucuuugaccuguggggcagagggacucuaauuguugugucuucggcaucaacaaagggaccgagcgucuuccccaccaucugc

SEQ ID NO: 25807 - RNA, 411 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacaaguuauuacaugcacugggugagacaggccccuggucagggccucgaauggaucgggugggucaagccagugacuggagcgguuaacuuuggcagcccgaauuucaggcaucgggugucccuuacgcgcgaccgagaucuguuuaccgcucacauggacauucgugguuugacacaaggggauacugccaccuauuucugugcaagacagaaauacuaugccggaggccagggcugguacuuugacuuaugggggaggggaacacugauagucgugucuucggcuucaaccaagggucccguaguuuucccuacuaucugc

SEQ ID NO: 25808 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucaacuacgcaaggaaguuccagggccgggugucuuuuuaucgcacccgagaacuugguaucgccuacauggaucugcguaauuugagauucgacgauacagcuguuuauuuuugugcaaggaaaacugccggggacgugucaggagauaagcggggcuucuuuuucgacuuauggggccgcgggaguagagucauugugagcucc

SEQ ID NO: 25809 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggaucaagacuguaacgggagccgugaacuuuggcagccuggauuuccgccaccgaauuuccuugacccgugacagagauuuauuuacagcgcauauggacaucaggggucugacucagggggauaccgcuacauacuucugugcccggcaaaaauuugaaucucgcuauaccggaggccagggcugguacuucgaccuaugggggagaggaacucacauugucgugucguca

SEQ ID NO: 25810 - RNA, 420 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaauucgaaagaggugggcaaggaugguacuuugaucuguggggcaggggcacccuaaucgucgugaguuccgccucuacugaggggccaagccgguccuucccgcagauucuccgc

SEQ ID NO: 25811 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuugcguuucaagcgccaguccacgcgcucauagauccucuccgaggagcgca

SEQ ID NO: 25812 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacgcggggauacugcuaccuacuauugugcccggcagaaauucgaaucgagauacacaggaggccaaggcugguauuuugaccuaugggggaggggaacccacaucgugguuucaagc

SEQ ID NO: 25813 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaaucgcgcuauacaggaggccagggcugguacuucgaccuaugggggagaggaacccacaucauugugucaagc

SEQ ID NO: 25814 - RNA, 423 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacuuccauuuuuauaggaugugacaggccucucgauaaggacuggucuggucuuggcgggucgaaacugucauuggcaccaagcaucuucgccaguuuagauuuucggaaccgcauuucccugucucgagaccgugaucuaagcacggcguacauggacaucagaggacucacccaggaugacacagcuacuuauuucugcgccaggcagaaguuugcaucccgguacucaggcgaucaggguaguuauuucgaccugugggggcgcggaacccuuauuguugugagcucugccuccacaaaaggcccgucaguauuuccccaugaucug

SEQ ID NO: 25815 - RNA, 399 nt, Artificial Sequence
  derived and/or modified sequence opt3 from anti-HIV-1_HeavyChain
agagaguaccuggaacagagcggcgggggagugaagaaacucggugccuccgucaggguuucuugccgggcuucagaggaccuuuucggcgaugaagugaucuaugacgaugagcugauucacugguugcgccaaguacccgggcagcgaccugaauggaugggauggauacguccaaagaccggcgcaagaaaccaggccaggcaguuucaaccgcggaucaauuuaagucgcgacagagcgcugaacacagcuuaccuagaucucagcucccugacuucugccgacucggcaacguauuucugugccaggcagaccuuuaaacccgauuucuacuuugcugaccaggguuggucauucaaucuuugggggcggggagcacgcgugauugucagcagu

SEQ ID NO: 25816 - RNA, 384 nt, Artificial Sequence
  derived and/or modified sequence opt3 from anti-HIV-1_HeavyChain
caggugcaccugguccaaagcggcgccgagguuaagaaacccggguccucugugagaguaucaugcuggaccagugaagacaucuucgagaggacagaacucauucauugggugcggcaggcuccuggacagggucuugaguggauaggcugggucaagacugugacgggggcaguuaacuuuggaagcccaaauuuccgccaccgagugucccugacccgugauagagacuuguuuacagcccauauggauaucaggggcuuaacucagggugacaccgcgacauacuucugugcucggcaaaaauuugaaucucgcuauucgggggaucagggaucauacuucgaccuguggggcagaggcacccuaauuaucgucagcagu

SEQ ID NO: 25817 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuugaacgcggaggccagggcuggaucuucgaucugugggggagaggaacccuaauugcaguuucgucagccagcacaaaggguccgaguguguuucccaccaucugc

SEQ ID NO: 25818 - RNA, 441 nt, Artificial Sequence
  derived and/or modified sequence opt3 from anti-HIV-1_HeavyChain
agagaguuccuggaacagagcggcgggggagugaagaaacucggugccucccuuagggucucuugccgggcuucagaggaccuguuuggcgaugaguucaucuacgacgaugaaguuauucacugguugcgccaagugcccgggcagcgaccugaauggaugggauggauacguccaaagaccggcgcaagaaaccaggccacacaguuucaaccgaggaucaguuuaacucgggaccgcgcgcugagcacggcuuaucuagaucucaauucccugaccucugccgacucggguacauacuucugugcaagacagacuuuuaaacccgauuucuauuuugccgaccagggguggucauucaaccuuuggggaaggggcgcucauuuuauuguaagcagugcauccaccaagggcccuucuguguucccacacgauagcgcc

SEQ ID NO: 25819 - RNA, 399 nt, Artificial Sequence
  derived and/or modified sequence opt3 from anti-HIV-1_HeavyChain
agagaguaccuggaacagagcggcgggggagugaagaaacucggugccucccuuagggucucuugccgggcuucagaggaccuguucggcgaugaaaucauuuaugacgaugagguuauacacugguugcgccaagugcccgggcagcgaccugaauggaugggauggauccguccaaagaccggcgcaagaaaccaggccaggcaguuucaaccgcggauuaguuuaacacgcgacagagcgcugagcacugcuuaccuagaucucaauucccugacgucugccgacucggguaccuauuucugugcaaggcagacauuuaaacccgauuucuacuuugccgaccagggguggucauucaaccuuuggggacggggcgcucauuuuaucguaagcagu

SEQ ID NO: 25820 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaaucgcgcuauacaggaggccagggcugguacuucgaccuaugggggagaggaacccacaucgugguuucaagc

SEQ ID NO: 25821 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucucuuacgcaaggaaguuccagggccgggugucauuuuauaugacccgcgaacuugguauggccuacauggaucugcgaaacuugcguuucgacgauacagcuguuuauuuuugugcaagaaaaacugccggggacgugaguggagauaauaggggcuacuucuuugacuuauggggccgggggagccgcgucaucguguccucu

SEQ ID NO: 25822 - RNA, 414 nt, Artificial Sequence
  derived and/or modified sequence opt3 from anti-HIV-1_HeavyChain
caggcccaccuggagcaaagcggcaccggggugaagaaacccggagcuuccgucagaguuucuugcuggacaucagaagacaucuucgagaagagugaacucauucauugggugaggcaggcaccuggucagggccuugaguggauaggguggguaaaaaucgugagcggagccgucaacuuuggcuccccaaauuuccggcagcgcgugucucugacucgagaucgugacuuguuuacggcgcaaauggauauuagagguuuaacccagggggacacagcuacuuacuucugugccaggcagaaguuugaacggggaggccagggcuggaucuucgaucugugggggcgcggaacccuaauugcaguuucgucagccagcacaaaagguccgaguguguuuccccacgaccuc

SEQ ID NO: 25823 - RNA, 399 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugcccgcggggaucagggaugguucuuugaccucuggggcagaggcacccugauuguugugucaagcgcuaguacaaaggggccuuccgga

SEQ ID NO: 25824 - RNA, 414 nt, Artificial Sequence
  derived and/or modified sequence opt3 from anti-HIV-1_HeavyChain
caggcccaccucgagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccaugaucgugacuuguuuacagcgcacauggauaucagagguuuaacucagggggacaccgcuacauacuucugugccaggcaaaaauuuuaugcaggaggccagggcugguacuucgaucugugggggcggggaacccuaauuugcguuucuucggccucaacuaaggguccgagcggccugcccccucgcagu

SEQ ID NO: 25825 - RNA, 426 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugaaucacucuacagcgaugaccaggggaguuauuucgaucuguggggacgcggcacccuuauuaucguuuccucugccagcacaaagggcccuuccguguuuccacacgaccugaga

SEQ ID NO: 25826 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuauugugcccggcaaaaauucgaacgcggaggccagggcugguacuuugaucugugggggagaggaacacuaauuguugugucgucagcaagcaccaaggguccgagugucuuccccacuaucuau

SEQ ID NO: 25827 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuauugugcccggcaaaaauucgaaucgcgcuacacaggaggccagggcugguauuuugaccuaugggggagaggaacccacaucgugguuucaagc

SEQ ID NO: 25828 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguagcgaacucauucauugggugaggcaggcaccuggccaggggcuugaguggauaggauggguaaagacagugacuggcgccgucaacuuugguuccgcguacuuccggcaccgcgugucucugacgcgagaucgugacuuguuuaccgcucauauggauaucagaggguuaacacagggagacacugccaccuauuacugugcaaggcaaaaauucuauaagggcggccaggggugguacuuugaucuguggggacgggguacacuaauuguugugucgucagccagcaccaaaggcccaagugucuucccgacuaucugc

SEQ ID NO: 25829 - RNA, 399 nt, Artificial Sequence
  derived and/or modified sequence opt3 from anti-HIV-1_HeavyChain
agagaguaccuggaacagagcggcgggggagugaagaaacccggugccuccgucaggguuucuugccgggcuucagaggaccucuucggcgaugaaaucauuuaugacgaugaggugauacacuggcuucgccaaguaccugggcagcgaccagaauggaugggauggauccguccgaagaacggcgguagaaaucaggcaaggcaguuucaaccccggauuagucugacccgcgacagagccuugaacacagcguacuuagaucugaauagccuaacuuccgcugacucugggacguauuucugugccaggcagaccuuuaaaccugauuucuacuuugcagaccagggauggucguucaaccucuggggccggggcgcccgcgugaucgucucaagc

SEQ ID NO: 25830 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugcccgcggggaucagggaugguucuuugaccucuggggcagaggcacccugauuguugugucaagc

SEQ ID NO: 25831 - RNA, 420 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucucuuacgcaaggaaguuccagggccgggugucauuuuauaugacccgcgaacuugguauggccuacauggaucugcgaaacuugcguuucgacgauacagcuguuuauuuuugugcaagaaaaacugccggggacgugaguggagauaauaggggcuacuucuuugacuuauggggccgggggagccgcgucaucguguccucugcuucgaccaagggaccgucaguauuccccacaauuugc

SEQ ID NO: 25832 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguagcgaacucauucauugggugaggcaggcaccuggccaggggcuugaguggauaggauggguaaagacagugacuggcgccgucaacuuugguuccgcguacuuccggcaccgcgugucucugacgcgagaucgugacuuguuuaccgcucauauggauaucagaggguuaacacagucggacacugccaccuauuucugugcaaggcaaaaauuuuacgccggaggccagggcugguauuucgaucugugggggcggggaacacuaauuguugugucaagcgcuaguaccaaggguccauccgucuuuccgcacgaccuccgc

SEQ ID NO: 25833 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaauucgaaagucuguacuccgaugaccaagguucuuauuuugaucuaugggggagaggaacccucaucauugucagcuccgccucaccaaagggcccgaguggccugcccccuaggagcgca

SEQ ID NO: 25834 - RNA, 411 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacaacuuaugguaucaguugggugagacaggccccuggccaggggcucgaauggauuggaugggucaagacggugaccggcgcgguuaacuuuggucaccaaauaagcgacagggugucccuuacacgggaucgcgaccuguucacugcucauauggauauccgaggguugacccagggagacacagccaccuacuuuugugcacgucagaaauucuaugccggcggccaggggugguacuuugauuuauggggaagagguacucugauugucgugucuucggcuucaacaaagggcccaagcguauucccgcacgaccuaagg

SEQ ID NO: 25835 - RNA, 417 nt, Artificial Sequence
  derived and/or modified sequence opt3 from anti-HIV-1_HeavyChain
caggcccaacuggagcagagcggcuccggggugaagaaacccggagcuucugucagaguuucaugcuggaccagugaagacaucuucgagaggacagaacucauucacugggugcggcaggcaccuggucagggccuugaguggauaggguggguaaagacugugacgggagccgucaacuuuggcagcuccgauuuccgccaacgagugucucugacccgugacagagauuuguuuacagcgcauauggacaucagggguuuaacucagggggauaccgcuacauacuucugugcccggcagaaauuuuaugcaggaggccagggcugguacuucgaccugugggggcgcggaacccuaauuguugugucgucagccagcacuaaggguccaagugucuuuccgcacgaucucaga

SEQ ID NO: 25836 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuauugugcccggcaaaaauucgaacgcggaggccagggcugguacuuugaucugugggggagaggaacccuaauuguugugucuucg

SEQ ID NO: 25837 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuauugugccaggcagaaguucgaaucacgguacacaggaggccagggcugguauuuugaccugugggggcgcggaacccauauuguugugagcagu

SEQ ID NO: 25838 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugaacgcggaggccagggcugguauuucgaucugugggggagaggaacccuaauuguugugucuucggcaucaacuaaggguccgagcgucuuucccacaaucugc

SEQ ID NO: 25839 - RNA, 381 nt, Artificial Sequence
  derived and/or modified sequence opt3 from anti-HIV-1_HeavyChain
caggugcaacugguccagagcggcgccgagguucagaagcccggggcuuccgugaccguaucuugcaaagcaucaggauacacacucaucaguuaugguauuagcugggugagacaggccccuggccaagggccagaauggaugggauggauaaggccgaagacuggcgcgcggaaccaggcucgccaguuccagccccgaaucucccuuacgcgugacagagcccugucuaccgcauacuuggauuuaaauucgcugacaucagccgacagcgguacuuauuuuugugcuaggcaaaccuucaaaccugauuuuuacuucgcagaccagggguggaguuuuaaccuauggggacggggcgcccacuucauugucuccucu

SEQ ID NO: 25840 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacauccucaggaagaaagagcuuauucauugggugcggcaggcaccuggucagggccuggaauggauaggguggguaaagacagugacuggaacggucaacuucggcagcuccgauuuucgccagcgagugucuuugacccgugacagagauuuauucacagcccacauggacaucaggggucugacucaaggggauaccgcgacauaccuaugugcucggcagaaauuugagcgcggaggccagggcuggauuuucgaccucugggggagaggaacccugaucgccguuucgucagcaagcacuaaggguccaaguguguuuccgcaugaucuu

SEQ ID NO: 25841 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaaucgcgcuauacaggaggccagggcugguacuucgaccuaugggggagaggaacccacaucgugguuucaagcgcaaguacuaaugguccaauuggccucccgcauagguccgcc

SEQ ID NO: 25842 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgguaagagcgagcucauucauugggugaggcaggcaccuggccaggggcuugaauggauaggauggguaaaaacagugacuggcgccgucaacuuugguuccucugauuuccggcagcgcgugucgcugacgcgagaccgugauuuguuuaccgcgcacauggacaucagaggguuaacacaaggagauacugcuaccuacuucugugccaggcagaaguuugagucacuguauagcgacgaucagggcaguuacuucgaccuauggggccgggggacacucauuaucguuuccucu

SEQ ID NO: 25843 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuugaacgcggaggccagggcugguauuucgaucugugggggagaggaacccuaaucguugugucgucagcaagcacaaaggguccgaguggccucccccauggguccgcc

SEQ ID NO: 25844 - RNA, 423 nt, Artificial Sequence
  derived and/or modified sequence opt3 from anti-HIV-1_HeavyChain
caggugcaauacggcagagaggccggggcuggaaugaagaaacccggugcaagcaugaccgucuccugcaagacagccgacgaagauaucuucgacgcggcuuauaugcacaggguucggcaggccccuggccagacuuuugaguggcugggguggaugaaaccagugacgggagcaguaaacuacgcccgccaguuccaaggccgagugucuuuuuaucguaccagagaacucgguauugcuuacauggaucuuagggaccugaaguucgaugacacagcagucuauuuuugugcccggaaaacuaagggggaugugucaggagacgaucgcggcuucuuuuucgacuuguggggcagagggaccaggguuauagugaguagcgcuuccacaaagggaccgucugucuuucccaccaucuac

SEQ ID NO: 25845 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagccuggauuuccgccaccgaaucuccuugacccgugacagagauuuauuuacagcgcauauggacauuaggggucugacucagggggauaccgcuacauacuucugugcccggcaaaaauuugaaucucgcuauaccggaggccagggcugguacuucgaccuaugggggagaggaacucacaucgugguuucgucagcaagcacaaaggguccaaguguguuuccgcaugaucucagg

SEQ ID NO: 25846 - RNA, 423 nt, Artificial Sequence
  derived and/or modified sequence opt3 from anti-HIV-1_HeavyChain
caggugcaacugguccagagcgaggccgaacucaagaaacccggcgcuuccguuucugugucaugcaaggcaaguggguacagcuucaccuccuauggaaucucuuggguaagacaggugccuggucagggccuugaguggauugccuggauaaggccaaaaacaggggcgcggaaccaagcucgccaguuucagccgcgaaucucgcugacucgugacagagccuugucaacggcauacuuagaucugaauagccuaaccagugccgacuccggaacauauuucugugcuaggcagacuuuuaagcccgauuucuacuuugcagaccaaggcuggucuuucaaccucuggggucgcggggcccacuuuauugucagcuccgcuucaaccaaaggaccuaguguguucccacaugaucugcgg

SEQ ID NO: 25847 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuauugugcccggcaaaaauucgaacgcggaggccagggcugguacuuugaucugugggggagaggaacccuaauuguugugucuucggcaucaacuaaggguccgagcgucuucccccacgaccuc

SEQ ID NO: 25848 - RNA, 381 nt, Artificial Sequence
  derived and/or modified sequence opt3 from anti-HIV-1_HeavyChain
caggugcaacugguccagagcggcgccgagguucagaagcccggggcuuccgugaccguaucuugcaaagcaucaggauacacacucaucaguuaugguauuagcugggugagacaggccccuggccaagggccagaauggaugggauggauaaggccgaagacuggcgcgcggaaccaggcucgccaguuccagccccgaaucucccuuacgcgugacagagcccugucuaccgcauacuuggauuuaaauucgcugacaucagccgacagcgguacuuauuacugugcuaggcaaaccuuuaaaccugauuucuauuuugcagaccagggguggaguuucaaccuauggggacggggcgcccacuuuauugucuccucu

SEQ ID NO: 25849 - RNA, 414 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccacuuauuuuugugcacggcaaaaauucgcccgcggggaucagggaugguuuuucgaccucuggggcagaggcacccugauuguugugucgucagcuagcacaaaggggccuagugucuuuccacagaucugc

SEQ ID NO: 25850 - RNA, 378 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugaacgcggaggccagggcugguauuucgaucugugggggagaggaacccuaauuugcguuucuucggca

SEQ ID NO: 25851 - RNA, 438 nt, Artificial Sequence
  derived and/or modified sequence opt3 from anti-HIV-1_HeavyChain
cagggcuaccuggcccaaagcgggggaggugugaagaaacccggcaccuccgcuucuuucucaugcagaacaagugacgauaucuaugacaacgaguuuuucgauagcgcauuuaugcacugggucaggcucauuccugggcagcggccagaauggaugggauggaugaauccgcgcuccggcgccguuaacuacgcgcgacagcuucagccccgugugucuauguauagagacagggaucugucgacugcuuacuuggacuuaaauucacugacgagcgccgauagugguaccuauuucugugcacggcaaacauuuaagccugacuucuacuuugccgaucaggggugguccuucaaccuauggggacgcggcgcucauuuuauaguaucuagcgcauccacuaaaggcccaucagugcucccccacgaccugaga

SEQ ID NO: 25852 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucacucauugggugcggcaggcaccuggucagggccuugaguggauuggguggguaaagauagugagcggagccgucaacuuuggcuccccaaauuuccgccagcgagugucucugacgcgugauagagacuuguuuaccgcgcacauggauaucagggguuuaacacaaggggacacugcuaccuacuucugugcccggcagaaauuugaacgcggaggccagggcuggauuuucgaucugugggggagaggaacacuaaucgcaguuucgucagccagcaccaaggguccgaguguguuucccagguccgcu

SEQ ID NO: 25853 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaagaaagaacucauucauugggugaggcaggcaccuggucagggccuugaguggauaggguggguaaagacagugacuggagccgucaacuuuggcagcuccgauuuccggcagcgcgugucucugacgcgagaccgugauuuguuuaccgcgcacauggacaucagagguuuaacacaaggggauacugcuaccuacuucugugccaggcagaaauuuuaugcaggaggccagggcugguacuucgaccugugggggcggggaacacuaauuguugugucgucagccagcaccaaggguccaagugucuuuccgcaugaucuc

SEQ ID NO: 25854 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcucccuggauuuccggcaccgcaucucuuugacgcgagaccgugauuuauuuaccgcgcauauggacauuagaggucugacacagggggauacugcuaccuacuauugugccaggcaaaaguucgaaucgcgguacacaggaggccagggcugguauuuugaccuaugggggcgcggaacccacaucgugguuucaagc

SEQ ID NO: 25855 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuauugugccaggcagaaguucuacgcaggaggccagggcugguauuuugaccugugggggcggggaacacuaauuguugugucaagcgccaguaccaaagguccauccgucuucccgacuaucugc

SEQ ID NO: 25856 - RNA, 384 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugaaucacucuacagcgaugaccaggggaguuauuucgaucuguggggacgcggcacccuuauuaucguuuccucu

SEQ ID NO: 25857 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguagcgaacucauucauugggugaggcaggcaccuggccaggggcuugaguggauaggauggguaaagacagugacuggcgccgucaacuuugguuccgcguacuuccggcaccgcgugucucugacgcgagaucgugacuuguuuaccgcucauauggauaucagaggguuaacacagggagacacugccaccuauuucugugcaaggcaaaaauuugaaucgcgguacacaggcggccaggggugguauuucgaucuguggggacgcgguacccacauuguugugucaagcgccaguacuaagggcccauccgucuuuccgcaugaccuaaga

SEQ ID NO: 25858 - RNA, 408 nt, Artificial Sequence
  derived and/or modified sequence opt3 from anti-HIV-1_HeavyChain
caggugcaacugguccacagcggcgccgagguuaagaaacccggggcuuccaugaaggugucuugcaaaaccucaggauacaguuucacagguuauuacaugcauuggguaagacaggcaccuggccaggggcucgaauggaugggauggaucaacccaagcuccaaugacacuaacuaugcccagaaguuucaaggcagggugacgaugacccgggauacaucuauuaauacugcguacauggagcuuucgcgccugcgaucaggugacaccgcuauauauuucugugcccgucagaaauuuuacgcagggggacagggcugguauuucgauuuguggggcagagggacauuaaucgucgugagcagugccuccaccaagggaccgucuguuuuucccacuauuugc

SEQ ID NO: 25859 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucucuuacgcaaggcgguuccagggccgcgugucauuuuauaugacccgagaacuugguauggccuacauggaucugcguaacuugagauucgacgauacagcuguuuauuuuugugcaaggaagacugccggggacgugaguggagauaaucggggcuacuucuuugacuuauggggccgcgggagcagagucaucguguccucu

SEQ ID NO: 25860 - RNA, 414 nt, Artificial Sequence
  derived and/or modified sequence opt3 from anti-HIV-1_HeavyChain
cagggcacccuggagcaaagcugguccgaagugaagaaacucggggccucugucagaguuucaugcuggacaagugaggacaucuucaagacugaacuuauucacugggugaggcaggcucccggacagggucuggaguggauaggcgggaugaaagcaguaagcggagccgugaacuacggcuccuuggauuuucggcaucgcgucucuuuaacgccugaccgagaucugucgaccgcgcacauggacauccguggucuaacacaggaugacacugcuaccuauuucugugccagacaaaaguuugcaaggggagaucaggggugguucuuugaccucuggggccggggcacacugauugugguuucaagcgccaguaccaaagggccauccguguucccgcaugaucuucgc

SEQ ID NO: 25861 - RNA, 423 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuugcgucccuggauuuccggaaucgcaucucuuugucgcgagaccgugauuuaucaacggcuuacauggacauuagaggccugacccaggaugacacagccacuuauuuuugugcaaggcaaaaguucgccagccgguacaguggugaucagggguccuauuuugaccuauggggacgcggcacccucaucugcgugucuagcgcuuccacaagagcacacaggcugccaccgcggucagcc

SEQ ID NO: 25862 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugcacgcggagaucagggcugguucuuugaccuguggggcagagggacccuaauuguugugucuucggccucaccgagggcucaccggagcaguccccgcuccgca

SEQ ID NO: 25863 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuguugugucaagcgccaguaccaaagguccauccgucuuuccgcaugauucugcu

SEQ ID NO: 25864 - RNA, 414 nt, Artificial Sequence
  derived and/or modified sequence opt3 from anti-HIV-1_HeavyChain
caggcccaccuggugcaaagcggcuccggggucaagaaacccggagcuucuguuagagugucaugcuggaccagugaggacaucuucaagagcgaacucauucauuggguaaggcaggcaccuggucagggccuugaguggauagggugggugaaaacagucacuggagccgugaacuuuggcuccucugauuuccggcagcgcguuucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuguggucucaagcgccaguaccaaagguccauccguguuuccgcaugaucuccgc

SEQ ID NO: 25865 - RNA, 414 nt, Artificial Sequence
  derived and/or modified sequence opt3 from anti-HIV-1_HeavyChain
caggcccaacuggagcagagcggcuccggggugaagaaacccggagcuucugucagaguuucaugcuggaccagugaagacaucuucaagacagagcucauucacugggugaggcaggcaccuggucagggccuugaauggauaggguggguaaaaacugugacgggagccgucaacuuuggcagcccaaauuuccggcaucgcgugucccugacccgagaucgugacuuguuuacagcgcacauggauaucagagguuuaacucaaggggacaccgcuacauacuucugugccaggcagaaguuugagcggggaggccagggcugguauuucgaucugugggggcgcggaacccuaauuguugugucuucggcaucaacuaaagguccgagcgucuuuccccaugaccucaga

SEQ ID NO: 25866 - RNA, 417 nt, Artificial Sequence
  derived and/or modified sequence opt3 from anti-HIV-1_HeavyChain
caggcccaccuggagcaaagcggcagagaagugaagaaacccggggcuuccgucaggguuucuugcuggaccucagaggacaucuucgaaaagagugagcucauucauugggugcggcaggcaccuggacagggucuugaauggauaggcuggguaaaaacagugacuggggccgucaacuuuggaagcuccgauuuccgccagcgagugucucugacgcgugacagagauuuguuuaccgcgcacauggacaucaggggcuuaacacaaggugauacugcuaccuacuucugugcccggcagaaguuuuaugcagggggacagggcugguacuucgaccuguggggccgcgggacacuaauuguugugucgucagccagcaccaaaggaccaagugucuuuccgcaugaucucaga

SEQ ID NO: 25867 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgaaucucucugacgcgugauagagacuuguuuaccgcgcauauggauauuagggguuuaacacagggggacacugcuaccuacuauugugcccggcaaaaauucgaaucgcgcuacacaggaggccagggcugguauuuugaucugugggggagaggaacccacaucgugguuucaagc

SEQ ID NO: 25868 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguagcgaacucauucauugggugaggcaggcaccuggccaggggcuugaguggauaggauggguaaagacagugacuggcgccgucaacuuugguuccgcguacuuccggcaccgcgugucucugacgcgagaucgugacuuguuuaccgcucauauggauaucagaggguuaacacagggagacacugccaccuauuacugugcaaggcaaaaauucuauaagggcggccaggggugguacuuugaucuguggggacgggguacacuaauuguugugucguca

SEQ ID NO: 25869 - RNA, 381 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacagacuauuaccuccacugggugagacaggccccuggucagggccuugauugggucggguggaucaacccaaauaguggaggcacuaacuaugcgcaaaaguuucaggguaggguggcuaugacgcgggacaccagccuguccucuguuuacuuggauuuaaauucgcugacaucagccgacagcgggacuuauuucugugcacgccagaccuuuaaaccggauuucuacuuugccgaccagggauggaguuucaaccuauggggccgaggcgcucauuuuauuguguccucu

SEQ ID NO: 25870 - RNA, 414 nt, Artificial Sequence
  derived and/or modified sequence opt3 from anti-HIV-1_HeavyChain
caggccgaccuggagcaaagcggcuccggggugaagaaacccggagcuucugucagaguuucaugcuggaccagugaagauaucuucgagaggacaaacuacgugcacuggguacggcaggcaccuggucgcggccucgaauggauuggguggagcaagacugugacgggagccgucaauuuuggcuccccaaacuuccgacaucgugugucucuuaccagagacagggaucuguuuacagcgcacauggacauacgggguuugacucagggggauaccgcuacauauuucugugcccgccagaaauuugagagaggaggccaaggcugguacuucgacuuaugggggaggggaacccugaucguugugucgucagcaagcacuaaggguccgagugucuuuccccaugaucua

SEQ ID NO: 25871 - RNA, 381 nt, Artificial Sequence
  derived and/or modified sequence opt3 from anti-HIV-1_HeavyChain
cagguguacauggagcaagccggcgggggaaugaagaaacccggugcuagcaugaccgucuccugcaagacagcagacgaagauaucuucgacgccgcguauaugcacuggguuagacaggcuccuggccagacuuuugaguggcugggguggaugaaaccagugacgggagccguaaacuacgcaaggcaguuccaaggccgggugucuuuuuaucgcacccgagaacucgguauugccuacauggaucuucgugaccugaaguucgaugacacagcugucuauuuuugugcaagaaaaacuaagggggaugugucaggagacgauaggggcuucuuuuucgacuuguggggccgggggacccgcguuauagugaguagc

SEQ ID NO: 25872 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaauucgaaagucuguacuccgaugaccaagguucuuauuuugaucuaugggggagaggaacccucaucauugucagcucc

SEQ ID NO: 25873 - RNA, 414 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacaaaccuuauucauugggugcggcaggcacccggucagggccuggaauggauaggguggguaaaggccgugagcggagcggucaauuacggcuccuuggauuuucgccaccgagugucuuuaacucgugacagagaucugucgacggcucauauggacaucaggggucuaacccaggaugacacagccacuuauuucugugcacggcaaaaauuugcccgcggggaucagggaugguucuuugaccucuggggcagaggcacccugauuguugugucaagcgcuaguacaaaggggccuuccgucuucccacacgaucuu

SEQ ID NO: 25874 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcaggcgaagacguguucgaugccgcguauaugcacuggguaagacaggcuccugggcagacuuuugaguggcucggauggaugaaaccagugacgggcgccgucaacuacgcaaggaaguuccagggucgggugucuuuuuaucgcacccgagaacuugggaucgccuacauggaccugcguaauuugagauucgaugacacagcuguuuauuuuugugcaaggaaaacugccggagaugugucaggcgacaagcggggcuucuuuuucgauuuaugggggcgcggaaguagagucauugugagcucc

SEQ ID NO: 25875 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaauucgaaagucuguacuccgaugaccaagguucuuauuuugaucuaugggggagaggaacccucaucacugucagcucc

SEQ ID NO: 25876 - RNA, 429 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaaucgcgcuauacaggaggccagggcugguacuucgaccuaugggggagaggaacccacaucgugguuucaagcgcaaguacuaaggguccauccggccucccgcccacaauuugcagg

SEQ ID NO: 25877 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugcacggggagaccagggcugguucuuugaucuguggggccgcgggacacuaauuguugugucaagcgccaguaccaaaggaccauccgucuucccgcaugaccucaga

SEQ ID NO: 25878 - RNA, 417 nt, Artificial Sequence
  derived and/or modified sequence opt3 from anti-HIV-1_HeavyChain
caggcccaccuggagcaaagcggcuccggggugaagaaacccggaaccucugucagaguuucaugcuggacaagugaagacaucuucgagaggacugaacucauucauugggugcggcaggcuccuggucagggccuugaguggauaggguggguaaagacggugaccggagcagucaacuuuggcagcccaaauuuccgccaccgagugucccugacacgugauagagacuuguuuacugcccauauggauaucagggguuuaacccagggggacacagcgaccuacuucugugcucggcaaaaauuugaacgcggaggccagggcugguauuucgaucugugggggagaggaacucuaauuguugugucuucggccucaacaaaggguccgagcgucuuuccccacgaccucagg

SEQ ID NO: 25879 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugguagagauuuguuuacagcgcauauggacaucaggggguuaacucagggagauaccgcuacauacuauugugcccggcaaaaauucgaacgcggcggccaggggugguacuuugaccuguggggaagagguacccuaauuguugugucuucggcaucaacuaagggcccgagcgucuucccccacgaucucagg

SEQ ID NO: 25880 - RNA, 411 nt, Artificial Sequence
  derived and/or modified sequence opt3 from anti-HIV-1_HeavyChain
caggcccaccugggcgcuaacuggagcggggugaagaaacucggagcauccgucagaguuucuugcuggaccucagaggacaucuucgaaaggacagagcuuauucauugggugcggcaagcccccggucagggccuggaauggauaggguggguaaaggcggugaguggagcugucaauuacggcagcuuggauuuucgccaccgaguguccuuaacucgugacagagaucugucuacggcccauauggacaucaggggucuaacccaggaugacacagcaacuuauuucugugcccggcagaaauuugcucgcggggaucaaggaugguucuuugaccucuggggcagaggcacccugauuguugugucgucagcaagcacaaaggggccuagugucuucccacagauc

SEQ ID NO: 25881 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuguugugucaagc

SEQ ID NO: 25882 - RNA, 423 nt, Artificial Sequence
  derived and/or modified sequence opt3 from anti-HIV-1_HeavyChain
caggcccaacuggagcagagcggcgugggggucaagaaacccggagcuuccguuagagugucuugccucgcaucagaagacaucuucaagaccgagcuuauucacuggguaaggcaggccccuggucagggccuggaauggauagggugggugaaaacagucacuggagcggugaacuuuggcagucaaaucuuccggcaucgcauuagcuugacgcgagaucgugacuuauuuaccgcucacauggauaucagaggucugacacagggggacacugccaccuacuucugugcaaggcagaaguuugagucccgguauacaggaggccagggcugguacuucgaucuaugggggcgcggaacccauauuguugugucuucggccucaacuaaagguccaagcgucuuuccgcacgaccucaga

SEQ ID NO: 25883 - RNA, 411 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuugcgcaccagaucuccgaucgggugucucugacgcgcgaccgagauuuguucaccgcucauauggacauucguggcuuaacacaaggugauacugccaccuacuuuugugcaagacagaaguucuaugccgggggacagggcugguacuuugaccuguggggcagggggacacuaaucguugugucgucagcuagcaccaaaggaccaagugucuucccgacuauuugc

SEQ ID NO: 25884 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggagcgaacucauucauugggugcggcaggcaccuggucagggccuugaguggauaggguggguaaagacagugacuggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauauuacgcaggaggccagggcugguauuuugaucugugggggcgcggaacacuaauuugcguuucguca

SEQ ID NO: 25885 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugaacgcggaggccagggcugguauuucgaucugugggggagaggaacacuaauuguugugucguca

SEQ ID NO: 25886 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucgcggccuggaguggauaggguggguaaaggccgugagcggagcggucaacuacggcuccuuggauuuucgacaccgugugucuuuaacuagagacagggaucuguucacggcucauauggacauccggggucuaacccaggaugacacagccacuuauuuuugugcacgccagaaauucgccagaggggaucaaggaugguuuuucgaccucuggggcaggggcacccugauuguugugucguca

SEQ ID NO: 25887 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaaggcguguucgaugccgcguauaugcacuggguaagacaggcuccugggcagacuuuugaguggcucggauggaugaaaccagugacgggcgccgucaacuacgcaaggaaguuccagggucgggugucuuuuuaucgcacccgagaacuugggaucgccuacauggaccugcguaauuugagauucgaugacacagcuguuuauuuuugugcaaggaaaacugccggagaugugucaggcgacaagcggggcuucuuuuucgauuuaugggggcgcggaaguagagucauugugagcucc

SEQ ID NO: 25888 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguagcgaacucauucauugggugaggcaggcaccuggccaggggcuugaguggauaggauggguaaagacagugacuggcgccgucaacuuugguuccgcguacuuccggcaccgcgugucucugacgcgagaucgugacuuguuuaccgcucauauggauaucagaggguuaacacagggagacacugccaccuauuucugugcaaggcaaaaauacuaugccggcggccaggggugguacuuugaucuguggggacgggguacacuaauuguugugucguca

SEQ ID NO: 25889 - RNA, 378 nt, Artificial Sequence
  derived and/or modified sequence opt3 from anti-HIV-1_HeavyChain
cagguguacauggagcaacccggcgucgaaguuaccaagccuggggccagcgugacacuguccugcaaaacugcugaggacguauucgaugcagccuauaugcacugggugagacaggcgccaggacagacguuugaauggcucgguuggaucaagccggucaccggcgcugugaacuacgccaggaaauuccaggggcggguuucuuuuuaucgcacacgagagcuuggaauugcauacauggaccugcguaauuugagauucgaugacacugccguguauuuuugugcuaggaagaccgcaggcgaugucucaggugacaaacggggguucuuuuucgauuuauggggacgcggcaguagagugauaguaagcucc

SEQ ID NO: 25890 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugaacggggaggccagggcuggauuuucgaccugugggggcgcggaacacuaaucauuguuucaagc

SEQ ID NO: 25891 - RNA, 384 nt, Artificial Sequence
  derived and/or modified sequence opt3 from anti-HIV-1_HeavyChain
caggcccaccuggugcaaagcggcuccgaggucaagaaacccggggcuuucguuagagugucuugcuggaccucagaagacaucuuugaggaaacagagcucauucauuggguaaggcaggcaccuggacagggucuugaauggauaggcugggugaagacugucacgggggccgugaacuucggaagucuggauuuucggcaccgcaucagcuugacccgagaccgugauuuauucacagcgcauauggacauuagaggccugacucagggugauaccgcuacauacuuuugugccaggcaaaaauucgagucccgguauaccgggggacagggcugguacuuugaccuauggggccgcgggacucacaucguugugucuucg

SEQ ID NO: 25892 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcaaggcaagugaagacaucuucgagaggaccgaacucauucauugggugcggcaggccccuggucagggccuugaguggauaggguggguaaaaacagugacuggagcggucaacuuuggcagcccaaauuuccgccaccgagugucccugacgcgugauagagacuuguuuaccgcucauauggauaucagggguuuaacacagggggacacugccaccuacuucugugcacggcaaaaguuugaacgcggaggccagggcugguauuucgaucugugggggagaggaacacuaauuguugugucuucg

SEQ ID NO: 25893 - RNA, 375 nt, Artificial Sequence
  derived and/or modified sequence opt3 from anti-HIV-1_HeavyChain
caggcccaccuggagcaaagcggcuccgaagugaagaaacccggggcuucugucagaguuucaugcuggaccagugaggacaucuucgaaaggacagagcucauucauugggugcggcaggcaccuggacagggucuugaauggauaggcuggguaaagacugugagcggggccgucaacuuuggauccccaaauuuccgccaccgagugucucugacgcgugauagagacuuguuuaccgcgcauauggauaucaggggcuuaacacagggugacacugcuaccuacuucugugcccggcaaaaauuugagcgcgggggacagggcugguauuucgaucuguggggcagagggacacuaauuguugugucguca

SEQ ID NO: 25894 - RNA, 375 nt, Artificial Sequence
  derived and/or modified sequence opt3 from anti-HIV-1_HeavyChain
caggcccaccuggugcaaagcggcuccggggucaagaaacccggagcuucuguuagagugucaugcuggaccagugaggacaucuucgaaaagagcgagcucauucauuggguaaggcaggcaccuggucagggccuugaauggauagggugggugaaaacagucacuggagccgugaacuuuggcuccucugauuuccggcagcgcguuucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuguggucucaagc

SEQ ID NO: 25895 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugaacgcgggggacagggcugguacuucgaucucuggggcagagggacccugauuugcguuucaagc

SEQ ID NO: 25896 - RNA, 375 nt, Artificial Sequence
  derived and/or modified sequence opt3 from anti-HIV-1_HeavyChain
caggcccaccuggagcaaagcggcuccggggugaagaaacccagagcuucugucaggguuucaugcuggaccagugaagacaucuucgaaaagagcgagcucauucauugggugcggcaggcaccuggacagggucuugaguggauaggcuggguaaaaacagugacuggggccgucaacuuuggauccucugauuuccgccagcgagugucgcugacgcgugacagagauuuguuuaccgcgcacauggacaucaggggcuuaacacaaggugauacugcuaccuacuucugugcccggcagaaguuuuaugcagggggacagggcugguacuucgaccuguggggccgcgggacacuaauuguugugucaagc

SEQ ID NO: 25897 - RNA, 381 nt, Artificial Sequence
  derived and/or modified sequence opt3 from anti-HIV-1_HeavyChain
caggugcaacuggagcaggccggcgcuggggucaagaaacccggaccuagcguuacccucuccugcaagacagcagacgaagauguguucgacgccgcguacaugcacuggguaagacaggcuccaggucagacuuuugaguggcuuggcuggaugaaaccggugacgggggccgucucuuaugcaaggaaguuccaaggacgggugucauuuuacaugacccgcgaacugggcauggccuauauggauuugcgaaacuuacguuucgacgauacagcuguuuacuuuugugcaagaaaaacugccggugacgugaguggggauaauaggggauauuucuuugaccuguggggccggggcagccgcgucaucguguccucu

SEQ ID NO: 25898 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccagcgagugucucugacgcgugauagagacuuguuuaccgcgcacauggauaucagggguuuaacacaaggggacacugcuaccuacuucugugcccggcagaaauuuuaugcaggaggccagggcugguacuucgaucugugggggcgcggaacacuaauuguugugucguca

SEQ ID NO: 25899 - RNA, 381 nt, Artificial Sequence
  derived and/or modified sequence opt3 from anti-HIV-1_HeavyChain
cagguguucauggagcaagccggcgcugggaugaagaaacccggagcaagcaugaccgucuccugcaagacagccgacgaagauguuuuugacgcggcuuacaugcacugggugagacaggccccuggucagacuuucgaguggcugggcuggaugaaaccaguaacgggggcagugaacuaugccaggaaguuucagggacgggucucuuucuaccgcacccgagaacucggcaucgcuuauauggaucuucguaaucugagauuugacgauacagcaguguacuucugugccaggaaaacugcuggugacguuucaggggauaagcggggauuuuucuuugacuuguggggccgcggcaguagagugauugucagcucc

SEQ ID NO: 25900 - RNA, 375 nt, Artificial Sequence
  derived and/or modified sequence opt3 from anti-HIV-1_HeavyChain
caggcccaccuggagcaaagcggcuccggggugaagaaacccggagcuucugucagagcaucaugcuggaccagugaagacaucuucgagaggacagaacucauucauuggguucggcaggccccuggucagggccuugaguggauagggugggugaagaucguaagcggagcggugaacuuuggcuccccaaauuuccgccagcgagucucucugacucgugauagagacuuguuuacggcucacauggauauuagggguuuaacccaaggggacacagccacuuacuucugugcacggcagaaauuugaacgcggaggccagggcuggaucuucgaucugugggggagaggaacccuaauugccgugucguca

SEQ ID NO: 25901 - RNA, 381 nt, Artificial Sequence
  derived and/or modified sequence opt3 from anti-HIV-1_HeavyChain
cagguguacauggagcaagccggcgggggaaugaagaaacccggugcuagcaugaccgucuccugcaagacagcagacgaagauaucuucgacgccgcguauaugcacuggguuagacaggcuaggggccagacuuuugaguggcugggguggaugaaaccugugacgggagccguaaacuacgcacggcaguuccaaggccgcgugucuuuuuaucgaacccgugaacucgguauugccuacauggaucuuagagaccugaaguucgaugacacagcugucuauuuuugugcaaggaaaacuaagggggaugugucaggagacgaucggggcuucuuuuucgacuuguggggccgcgggaccagaguuauagugaguagc

SEQ ID NO: 25902 - RNA, 384 nt, Artificial Sequence
  derived and/or modified sequence opt3 from anti-HIV-1_HeavyChain
caggcccaccuggagcaaagcggcgcuggggugaaggaacccggagcauccgucagaguuucuugcuggucaagugaggacaucuucgaaaggaccgagcucauucauugggugcggcaggccccuggucagggccuugaauggauaggguggguaaaaacagugacuggagcggucaacuuuggcagccuggauuuccgccaccgaaucuccuugacgcgugacagagauuuacugaccgcucauauggacauuaggggucuaacacagggggauacugccaccuacuuuugugcacggcaaaaguucgagucucgcuauacaggaggccagggcugguacuuugaccucugggggagaggaacccacaucgugguuucguca

SEQ ID NO: 25903 - RNA, 384 nt, Artificial Sequence
  derived and/or modified sequence opt3 from anti-HIV-1_HeavyChain
caggugcaacugguccagagcggcuccgccaugaagaaacccggggcuucuguuagagugucaugcuggaccagugaggacaucuucgaaaggacagagcucauuuacuggguacggcaggcaccuggacgcggucuugaauggauaggcugggugaagacugucagcgggacggugaacuuuggauccucugauuuccgaaaucguaucucgcugaccagagacagggauuugucaacagcccacauggacauucggggcuuaacucaggaugacaccgcgacauauuuuugugcucgccaaaaauucgagagccuguacagugaugaccaggguuccuauuuugaucuaugggggagaggaacccucaucauuguuucuagc

SEQ ID NO: 25904 - RNA, 384 nt, Artificial Sequence
  derived and/or modified sequence opt3 from anti-HIV-1_HeavyChain
caggcccaccuggugcaaagcgcuuccggcgucaagagacccggggcaucuguuagggugucaugcuggaccagugaggacaucuucgaacggacagagcucauuuacuggguacgccaggccccuggacagggucuugaauggauaggcugggugaaaacugucagcggggcggugaacuuuggaucccaggauuuccgacaucguaucucucugacgagagacagggauuuguuuaccgcucacauggacauucggggcuuaacacaaggugauacugccaccuauuucugugcacgccagaaguuugagucgagauacacagggggacagggcugguauuucgaccuguggggcagggggacccauaucguugugucaagc

SEQ ID NO: 25905 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucucuuacgcaaggaaguuccagggccgggugucauuuuauaugacccgcgaacuugguauggccuacauggaucugcgaaacuugcguuucgacgauacagcuguuuauuuuugugcaagaaaaacugccggggacgugaguggagauaagaggggcuucuuuuucgacuuauggggccgggggagccgcgucaucguguccucu

SEQ ID NO: 25906 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguuacaugauucauugggugaggcaggcaccuggccaggggcucgaauggauaggauggguaaagacagugacuggcgccgucaacuuugguagcgcguauuuccggcaccgcgugucccuuacgcgagaucgugaccuguuuaccgcucauauggauaucagaggguugacacagggagacacugccaccuacuucugugcaaggcaaaaauuuuauaagggcggccaggggugguacuucgauuuauggggacgggguacacugauuguugugucuucg

SEQ ID NO: 25907 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucgcggccuggaguggauaggguggguaaaggccgugagcggagcggucaacuacggcuccuuggauuuucgacaccgugugucuuuaacuagagacagggaucuguucacggcucauauggacauccggggucuaacccaggaugacacagccacuuauuuuugugcacgccagaaauucgccagaggggaucaaggaugguuuuucgaccucuggggcaggggcacccugauuugcguuucguca

SEQ ID NO: 25908 - RNA, 375 nt, Artificial Sequence
  derived and/or modified sequence opt3 from anti-HIV-1_HeavyChain
caggcccaccuggugcaaagcggcuccggggucaagaaaucuggagcuucaguuagagugaguugcuggaccagcgaggacaucuucgaaaaguccgagcucauucauuggguaaggcaggcacccggucagggccuugaauggauagggugggugaaaacagucacuggagccgugaacuuugguucuucggauuuccggcagcgcguuucacugacgcgagaccgugauuuguuuaccgcgcacauggacaucagaggcuuaacacaaggggauacugcuaccuacuucugugccaggcagaaguuuuaugcaggaggccagggcugguacuucgaccugugggggcggggaacacuaauuguggucagcagu

SEQ ID NO: 25909 - RNA, 378 nt, Artificial Sequence
  derived and/or modified sequence opt3 from anti-HIV-1_HeavyChain
cagguguacauggagagagccggcgcuggggucaagaaacccggagcaagcguuacccuguccugcaagacagccgacgaagauguguucggugcguauaugcacuggguaaggcaagcuccuggccagacuuuugaguggcucggguggaugaaaccagugacgggagccgucucuuacgcacggaaguuccagggccgcgugucauuuuauaugacccgagaacuugguauggccuacauggaccugcguaacuugagauucgaugacacagcuguuuauuuuugugcaaggaaaacugccggggaugugaguggagacaaucggggcuacuucuuugauuuauggggccgcgggagcagagucaucguguccucu

SEQ ID NO: 25910 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguagcgaacucauucauugggugaggcaggcaccuggccaggggcuugaguggauaggauggguaaagacagugacuggcgccgucaacuuugguuccgcguacuuccggcaccgcgugucucugacgcgagaucgugacuuguuuaccgcucauauggauaucagaggguuaacacagggagacacugccaccuauuucugugcaaggcaaaaauuuuacaagggcggccaggggugguauuucgaucuguggggacgggguacacuaauuguugugucguca

SEQ ID NO: 25911 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucgugucucacugaccagagacagggauuuguuuacagcccauauggacauccggggcuuaacucaggaugacaccgcgacauauuucugugcucgccagaaauuugccagaggugaucaagggugguucuuugaccuguggggaaggggcacccuaauugugguuagcagu

SEQ ID NO: 25912 - RNA, 384 nt, Artificial Sequence
  derived and/or modified sequence opt3 from anti-HIV-1_HeavyChain
caggcccaccuggugcaaagcggcuccggggucaagaaacccggagcuucuguuagagugucaugcuggaccagugaggacaucuucgaaaggacagagcucauucauuggguacggcaggcaccuggucagggccuugaauggauagggugggugaagacugucgccggagcggugaacuuuagcucccuggauuuccgccaccgaaucucuuugacgcgugacagagauuuauuuaccgcucauauggacauuaggggccugacacagggugauacugccaccuacuucugugcacggcaaaaauuugagucgcgcuauacagggggacagggcugguacuucgaccuauggggcagagggacccacaucguugugucaagc

SEQ ID NO: 25913 - RNA, 384 nt, Artificial Sequence
  derived and/or modified sequence opt3 from anti-HIV-1_HeavyChain
caggcccaccuggagcaaagcggcuccggggugaagaaaucuggagcuucagcaagagucaguugcuggagcuccgaagacaucuucgagaggaccgaacucauucauuggguucggcaggcccccggucagggccuugaguggauagggugggugaagacaguaacuggagcggugaacuuuggcucucuggauuuccgccaccgaaucucguugacgcgugacagagauuuauuuaccgcucauauggacauuaggggucugacacagggggauacugccaccuacuucugugcacggcaaaaauuugaaucacgcuauacaggaggccagggcugguacuucgaccuaugggggagaggaacccacaucgucgugagcagu

SEQ ID NO: 25914 - RNA, 369 nt, Artificial Sequence
  derived and/or modified sequence opt3 from anti-HIV-1_HeavyChain
cugcuccagcuugugcaaagcggcgccgaggucaagaaacccggggcuuccguuaaggugaccugcaaagcaucuggauacacauucacugguuauauccacuggguaagacaggccccuggccaggggcuggaauggauuggaugggugaaggcggucucaggcgcugugaacuacgguaguuuggacuuuaggcaucggguuagcuuaacgcacgaucgcgaccuguccaccgcccauauggauauacgagggcuaacacaggacgauacugcaaccuauuucugugcccgucaaaaauuugcuagaggagaccagggcugguucuuugaucucuggggcagggggacacugaucguggucucuucg

SEQ ID NO: 25915 - RNA, 369 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauguaccuucacagguuacuauaugcacugggugagacaggccccuggccaggggcucgaauggaugggauggaucaacccaaauaguggcgguacuaacuacgcgcaaaaguuucaggggagggucacgaugacccgggacacaagcauuuccacugcuuauauggagcuuucucgccugcgaucggaugacaccgccguguacuauugcgcacgucagaaauucgccagaggagaucagggcugguuuuucgacuuguggggcagggggacauuaauaguugugucaagc

SEQ ID NO: 25916 - RNA, 369 nt, Artificial Sequence
  derived and/or modified sequence opt3 from anti-HIV-1_HeavyChain
caggugcaacugguccagagcggcaccgagcucagaaagcccggggccuccguuaaagugucuugcaaggcuucaggauacacauucagugguagcuauauccacuggguaaggcaggcaccuggccaggggcuugaaugggugggauggauuaacccauccucuggcgccacucaaugugcgaaaaaguuucaggacaaagucacgaugacccgggauacaacuaauaacaccguguacauggagguuaaucgccugauaucggacgauacagcuaccuauuucugcgcccgacagaaguuugcacguggugaccaggggugguucuuugauuuguggggaagaggcacuuuaaucguggucucaagc

SEQ ID NO: 25917 - RNA, 372 nt, Artificial Sequence
  derived and/or modified sequence opt3 from anti-HIV-1_HeavyChain
caggugcugcucguccaaagcggcgccgagguuaagaaacccggguccucugugaagguaucaugcaaaaccaguggagacagccuuacaaaguacgcucugcacugggcaagacaggccccuggucagggcuuggaauggaucgggugggugaaaacugucacgggagcggugaacuucggcuccucugauuuuaggcagcggguuucguuaacccgcgaccgagaucuguucacagcucauauggacauucguggucuaacucaaggggauaccgccacauauuuuugugcaagacagaaguucuacgccggaggccagggcugguauuuugaccucugggggaggggaacccugauaguggucucaagc

SEQ ID NO: 25918 - RNA, 372 nt, Artificial Sequence
  derived and/or modified sequence opt3 from anti-HIV-1_HeavyChain
caggugcaacugguccagagcggcaccgagguuaagacacccggggccuccgugaaaguaucuugcaaggcuucaggauacacuuucacgaacuaugacaucaauugggugagacaggcaccuggucagggccucgaauggauugggugggucaaaaccgugacaggagccguuaacuuuggcaguagcgauuucaggcaacgggugucccuuacucgcgaccgagaucuguuuaccgcgcacauggacauacgugguuugacacagggggauaccgcuacuuacuucugugccagacagaaguuuuaugcaggaggccagggcugguacuucgacuuaugggggaggggaacacugaucgucgugucuucg

SEQ ID NO: 25919 - RNA, 372 nt, Artificial Sequence
  derived and/or modified sequence opt3 from anti-HIV-1_HeavyChain
caggugcaacugguccagagcggcgacgagguuaagaaacccggggccuccgugaagguaucuugcaaggcuucaggaaaagguuucccuaccagucucgugacaugggucagacaggcaccaggccaggggcuugaauggaucggaugggugaaagccguuagcggcgcggugaacuacgguucccuggauuuuaggcaccgggucucuuugacucgcgaccgagauuuauucacggcucauauggacauucgugggcugacccaagaugacacagccacuuauuuuugugcaagacagaaguucgccaggggagaucagggcugguuuuucgaccuauggggccgggggacccucauagugguaucguca

SEQ ID NO: 25920 - RNA, 372 nt, Artificial Sequence
  derived and/or modified sequence opt3 from anti-HIV-1_HeavyChain
caggugcaacugguccagagcggcgccgagguuaagaaacccggguccucugugaagguaucaugcaaaaccaguggagacauccucacaaacuacggucuuaauugggugagacaggcuccuggccaggggcuggaauggauuggaugggucaaggcagugagcggcgccguuaacuaugguuccuuggauuucaggcaccgggugucuuuaacucgcgaccgagaucugucgacggcgcauauggacauacgugggcuaacccaagaugacacagcuacuuacuuuugugccagacagaaauucgcaaggggagaucagggcugguuuuucgaccucuggggccgggggacccugaucgucgugucaagc

SEQ ID NO: 25921 - RNA, 372 nt, Artificial Sequence
  derived and/or modified sequence opt3 from anti-HIV-1_HeavyChain
caggugcaacugguccagagcggcgccgagguuaagaaacccggggcuuccgugagaguaucuugcaagaccucaggauacccuuucaguagguaugguaucagcugggugcggcaggcaccaggccaggggcucgucuggauggccugggugaaagcgguuuccggagcugugaacuacggcucucuugacuuucgccaccgagucucgcugacacgugauagagacuugucaacugcccauauggauauuagggguuuaacgcaagacgauaccgcaacauauuucugugcccggcagaaguuugcucgcggggaccagggaugguucuuugaucuguggggcagaggcacucuaauagugguaagcagu

SEQ ID NO: 25922 - RNA, 372 nt, Artificial Sequence
  derived and/or modified sequence opt3 from anti-HIV-1_HeavyChain
agagagcagcuggugcaaagcggcgccgaagucaagaaacccggggcuuccguuaaggugucuugcaaaaccucaggaaacacauucgguaguuacgacuuuaauuggguaaggcaggcaccuggccaggggcucgaguggaucggaugggugaagauugucagcggcgccgugaacuucgguuccccaaauuuucggcagcgcguuucucuuacucgagaucgugaccuguucacggcgcacauggauauaagaggguugacccaaggagacacagcuacuuauuuuugugccaggcagaaauucgaacggggcggccagggguggaucuuugauuuauggggacgcgguacccugauugcagugucguca

SEQ ID NO: 25923 - RNA, 372 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacaaguuauuacaugcacugggugagacaggccccuggucagggccucgaauggaucgggugggucaagacugugacgggagcgguuaacuuuggcagcccaaauuucaggcaucgggugucccuuacccgcgaccgagaucuguuuacagcucacauggacauucgugguuugacucaaggggauaccgccacauauuucugugcaagacagaaauacuaugccggaggccagggcugguacuuugacuuaugggggaggggaacccugauagucgugucuucg

SEQ ID NO: 25924 - RNA, 372 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacaaguuauuacaugcacugggugagacaggccccuggucagggccucgaauggaucgggugggucaagacugugacgggaaccguuaacuuuggcagccuuaauuucaggcaacgggugucccugacacgcgaccgagauuuguuuacugcgcauauggacauucgugguuuaacccagggggauacagcuaccuauuucugugccagacagaaauuugagaggggaggccagggcugguacuucgaccugugggggcggggaacucuaauagucgugucuucg

SEQ ID NO: 25925 - RNA, 372 nt, Artificial Sequence
  derived and/or modified sequence opt3 from anti-HIV-1_HeavyChain
caggugcaacugggccagagcggggccgagaugaagaaacccggauccucugucaagguuucaugcaaagcuagugguggcaccuucagacacagcccuaucuccugggugaggcaggcaccagggcagggacucgaauggauuggcuggguaaaggccgugucuggugcggucaacuacgggucgcuugacuuucggcaucgcgugucacugacacgagaucgugacuugagcacugcucacauggauauaagaggauuaacgcaagacgauaccgccacauauuucugugcaaggcagaaauuugcccggggcgaccagggcugguucuuugaucugugggggcgcggaacucuaaucguugugaguucc

SEQ ID NO: 25926 - RNA, 369 nt, Artificial Sequence
  derived and/or modified sequence opt3 from anti-HIV-1_HeavyChain
caggugcaacugguccagagcggcgccgagguuagaacccccggggcuuccgugaagguaucuugcaaagcaucaggauacaacuucaucgccuaucacgugcauugggucaggcaggcgccuggucagggccucacauggaugggguggauuaauccagacaguggagauacuguguacgcucaaaacuuuguugaccgggugaugaugacgcgcaauaccagcauacagacagucuaucuugaacugaacguguugacuuuagaggauaccgccacauacuucugugcacgacagaaguuugcccguggcgaccaggguugguucuuugaucugugggggagaggaacccuaaucguaguuuccucu

SEQ ID NO: 25927 - RNA, 372 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacaguguauuacaugcacugggucagacaggccccugguaggggccucgaauggaucgggugggugaaggcgguuaguggagcugugaacuauggcagccuugacuuucggcaucgcgucucccugacucgagaucgugacuuguucacggcccacauggauauuagagguuuaacccaggacgauacagcaacuuacuuuugugccaggcaaaaauucgcucgcggggaccagggaugguuuuucgaucuguggggccggggcacccuaauagugguaucuucg

SEQ ID NO: 25928 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccagggggauacagccacuuauuuuugugcacggcaaaaauucgaacgcggaggccagggcugguacuuugaccucugggggagaggaacccugauuguugugucguca

SEQ ID NO: 25929 - RNA, 372 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucaucgguuauuacaugcacugggugagacaggccccuggccaggggcucgaauggaugggaugggucaagacagugacuggcgcgguuaacuuugguaguccaaauuucaggcaucgggugagccuuacgcgcgaccgagaucuguuuaccgcucacauggacauucguggguugacacaaggagauacugccaccuauuucugugcaagacagaaauuugagaggggcggccaggggugguacuucgacuuauggggacgggguacacugauagucguguccucu

SEQ ID NO: 25930 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcucccugaauuuccgccaccgagugucuuugacgcgugauagagacuuauuuaccgcgcauauggauaucaggggucugacacagggggacacugcuaccuacuucugugcccggcaaaaauuugcacgcggagaucagggcugguucuuugaccuauggggcagagggacacucauuguugugucguca

SEQ ID NO: 25931 - RNA, 372 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucaaggauaggauugaccauugggugcggcaggcacccggucagggccuugaguggauaggguggguaaaagccgugagcggagcggucaacuacggcucccuggauuuucgccaccgagugucuuugacacgugacagagauuuauucacugcucauauggacaucaggggucugacgcaggaugacaccgccacauauuuuugugcacggcaaaaguucgcccgcggggaucagggaugguuuuucgaccuauggggcagaggcacucucauuguugugucguca

SEQ ID NO: 25932 - RNA, 375 nt, Artificial Sequence
  derived and/or modified sequence opt3 from anti-HIV-1_HeavyChain
caggugcaacuggcccagagcggcgcugaggucaagaaacucggggcauccguuagagugucuugcuggaccucagaagacaucuucgagaggacagaacuuauucacuggguacggcaggcccccggacagggucuggaguggauaggcugggugaaggcggucaguggggcugugaacuacggcagcuuggauuuucgccaucgaguuuccuuaacucgugacagagaucuguucacggcccacauggacaucaggggacuaacccaagaugacacagcaauuuauuuuugugcccggcagaaauucgcucgcggugaucaggggugguuuuucgaccucuggggaagaggcacucugaucguggucucuucg

SEQ ID NO: 25933 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucagcaaggcagagcucauucauugggugaggcaggccccuggucagggccuugaauggauaggguggguaaaaacaguguccggagcggucaacuucggcucuccaaauuuucggcaccgcgugucgcugacucgagaucgugacuuguucacggcucauauggauaucagagguuuaacccagggggacacagccacuuacuuuugugcaaggcaaaaguucgagcggggaggccagggcugguauuuugaucugugggggcgcggaacccuaauuguugugucaagc

SEQ ID NO: 25934 - RNA, 372 nt, Artificial Sequence
  derived and/or modified sequence opt3 from anti-HIV-1_HeavyChain
accgcccaccuggagcagagcggcuccggggugagaaggcccggagcuucuguccggguuucaugcuggacaaguggugacaucuucaagagcgaacucauucauugggugcgccaagcaccuggccaggggcuugaguggauaggauggguaaaaacugugacgggcgccgucaacuuugguuccucugauuuccgacagcgugugucgcugaccagagacagggauuuguuuacagcgcacauggacauccggggguuaacucagggagauaccgcuacauacuucugugcccgccaaaaguuuuaugcaggcggccaggggugguacuucgaccuguggggaagagguacccuaauuguugugucaagc

SEQ ID NO: 25935 - RNA, 372 nt, Artificial Sequence
  derived and/or modified sequence opt3 from anti-HIV-1_HeavyChain
caggcccaccuggagcaaagcggcuccggggugaagagacccggagcuucugucaggguuucaugcuggaccagugaagacaucuucaacacagagcucauucauugggugcggcaggcaccuggucagggccuugaauggauaggguggguaaaaacugugagcggagccgucaauuuuggcucccugaacuuccgccaccgagugucuuugacgcgugauagagacuuauuuaccgcgcauauggauaucaggggucugacacagggggacacugcuaccuacuucugugcccggcaaaaguuugcacgcggagaucagggcugguucuuugaccuauggggcagagggacacucauuguugugucguca

SEQ ID NO: 25936 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucaagacagagcucauucauugggugaggcaggcaccuggucagggccuugaauggauaggguggguaaaagccgugagcggagcggucaacuacggcucccuggauuuucggcaccgcgugucuuugacucgagaccgugauuuaucgacggcucauauggacaucagaggucugacccaggaugacacagccacuuauuucugugcaaggcaaaaguuugcccgcggggaucagggaugguucuuugaccuauggggccggggcacccucauuguugugucaagc

SEQ ID NO: 25937 - RNA, 372 nt, Artificial Sequence
  derived and/or modified sequence opt3 from anti-HIV-1_HeavyChain
caggugcaacugguccagagcggcgccgagguuaagaaacccggggcuuccgugagaguaucuugcaaggcaucaggauacaccuucacagccuauuacauccacugggugaggcaggcgccuggucagggccucgaauggauugggugggucaaaacugugaguggagcuguuaacuuuggcagcccaaauuuccggcaucgcgugucccuuacgcgagaccgugaucuguuuaccgcccacauggacauaagagguuugacacaaggggauacugcaaccuauuucugugccaggcagaaguuugagcggggaggccagggcugguacuucgacuuaugggggcgcggaacacugaucgucgugucuucg

SEQ ID NO: 25938 - RNA, 372 nt, Artificial Sequence
  derived and/or modified sequence opt3 from anti-HIV-1_HeavyChain
caggcccaccuggagcaaagcggcuccgaaucuaagaaacccggggcuucagugagagucaguugcuggagcuccgaggacaucuucaagaccgaacucauucauuggguuaggcaggcaccuggacagggucuugaguggauaggcugggugaaaaucguaucuggggccgugaacuuuggaucgccaaauuuccggcagcgcgucucacugacacgagaucgugacuuguuuacugcgcacauggauauuagaggcuuaacgcaaggugacaccgcuacauacuucugugccaggcagaaguuugaacgcgggggacagggcuggaucuucgaucuguggggccgggggacucuaauugcagugagcagu

SEQ ID NO: 25939 - RNA, 375 nt, Artificial Sequence
  derived and/or modified sequence opt3 from anti-HIV-1_HeavyChain
caggcccaccuggagcaaagcggcuccgaagugaagaaacccggggcuucugucagaguuucaugcuggaccagugaggacaucuucgaaaagagcgagcucauucauugggugaggcaggcaccuggacagggucuugaauggauaggcuggguaaaaacagugacuggggccgucaacuuuggauccucugauuuccggcagcgcgugucgcugacgcgagaccgugauuuguuuaccgcgcacauggacaucagaggcuuaacacaaggugauacugcuaccuacuucugugccaggcagaaguuuuaugcagggggacagggcugguacuucgaccuguggggccgggggacacuaauuguugugucaagc

SEQ ID NO: 25940 - RNA, 372 nt, Artificial Sequence
  derived and/or modified sequence opt3 from anti-HIV-1_HeavyChain
caggcccaccuggagcaagugugggcuggcgucaagaaacucggggcaagcguuagaguguccugcuggaccucugaagacaucuucaagacagagcuuauucauuggguaaggcaggcccccggacagggucuggaauggauaggcugggugaaagcggucucaggggcugugaacuacggaaguuuggauuuucggcaccgcguuagcuuaacucgagaccgugaucuguccacggcccauauggacaucagaggccuaacccaggaugacacagcaacuuauuucugugccaggcaaaaguuugcucggggugaucaggggugguucuuugaccucuggggacgcggcacccugauuguggucucuucg

SEQ ID NO: 25941 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggagcgaacucauucauugggugcggcaggcaccuggucagggccuugaguggauaggguggguaaagacagugacuggagccgucaacuuuggcuccaauuuccgccagcgagugucucugacgcgugauagagacuuguuuaccgcgcacauggauaucagggguuuaacacaaggggacacugcuaccuacuucugugcccggcagaaauuuuaugcaggaggccagggcugguacuucgaucugugggggcgcggaacacuaauuguugugucguca

SEQ ID NO: 25942 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggcaucgcgucucguugacccgagaucgugacuuaucaacagcgcacauggauauuagaggacugacucaggacgauaccgcuacauauuuuugugccaggcaaaaauucgcacggggcgaccaggguugguuuuucgaucuaugggggcgcggaacccucaucgugguuagcagu

SEQ ID NO: 25943 - RNA, 375 nt, Artificial Sequence
  derived and/or modified sequence opt3 from anti-HIV-1_HeavyChain
caggcccaccuggagcaaagcggcuccggggugaagaaacccggaaccucugucagaguuucaugcuggacaagugaagacaucuucgagaggacugaacucauucauugggugcggcaggcuccuggucagggccuugaguggauaggguggguaaagacggugaccggagcagucaacuuuggcagcccaaauuuccgccaccgagugucccugacacgugauagagacuuguuuacugcccauauggauaucagggguuuaacccagggggacacagcgaccuacuucugugcucggcaaaaauuugcccgcggagaucagggcugguucuuugaccuguggggcagagggacucuaauuguugugucuucg

SEQ ID NO: 25944 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugguggcaucuucgaaaggacagagcucauucauugggugcggcaggcaccugggcagggacuugaauggauaggcuggguaaagacugugacgggugccgucaacuuugggagcccaaauuuccgccaccgagugucccugacccgugacagagauuuguuuacagcgcauauggacaucaggggauuaacucagggcgauaccgcuacauacuucugugcccggcaaaaauuugagcgcggcgggcagggaugguauuucgaccugugggguagaggcacccuaauuguugugucuucg

SEQ ID NO: 25945 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacaggaugacacugcuaccuacuucugugcccggcaaaaauuugcacgcggggaucagggaugguucuuugaccuauggggcagaggcacacucaucgugguuucguca

SEQ ID NO: 25946 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucaagagcgagcucauucauugggugaggcaggcaccuggucagggccuugaauggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugagcggggaggccagggcuggauuuucgaccugugggggcgcggaacacuaaucgcaguuucaagc

SEQ ID NO: 25947 - RNA, 375 nt, Artificial Sequence
  derived and/or modified sequence opt3 from anti-HIV-1_HeavyChain
caggcccaccuggagcaaagcggcuccggggugaagagacccggagcuucugucaggguuucaugcuggaccagugaagacaucuucgagacaacugaacucauucauugggugcggcaggcaccuggucagggccuugaguggauaggguggguaaaaacggugagcggagccgucaacuuuggcucccugaauuuccgccaccgagugucuuugacccgugauagagacuuauuuacagcgcauauggauaucaggggucugacucagggggacaccgcuacauacuucugugcccggcaaaaguuugcacgcggagaucagggcugguucuuugaccuauggggcagagggacccucauuguugugucguca

SEQ ID NO: 25948 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccagcgagugucuuuaacucgugacagagaucuguucacggcucacauggacaucaggggucuaacccaaggggauacagccacuuauuuuugugcacggcagaaauucuacgccggaggccagggcugguauuuugaccucugggggcgcggaacccugauuguugugucguca

SEQ ID NO: 25949 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaaccuggugcaccagaucuccgaucggguuucuuugacgcgcgaccgagauuuauuuaccgcgcauauggacauucguggccugacacaaggugauacugcuaccuacuucugugccagacagaaguuuuaugcagggggacagggcugguacuucgaccuauggggcagggggacacucaucguggucucguca

SEQ ID NO: 25950 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgaggucgugacuuguuuaccgcgcacauggauaucagaggguuaacacaaggagacacugcuaccuacuucugugccaggcagaaguuuuaugcaggcggccaggggugguacuucgaucuguggggacgggguacacuaauuguugugucaagc

SEQ ID NO: 25951 - RNA, 375 nt, Artificial Sequence
  derived and/or modified sequence opt3 from anti-HIV-1_HeavyChain
caggcccaccuggagcaaagcggcgcuggggugaagaaacccggagcauccgucagaguuucuugcuggaccucagaagacaucuucgagaggacagaacucauucauugggugcggcaggccccuggucagggccuugaguggauaggguggguaaagacugugacgggagcggucaacuuuggcaguccaaauuuccgccaccgagugagccugacccgugauagagacuuguuuacagcucauauggauaucagggguuuaacucagggggacaccgccacauacuucugugcacggcaaaaauuugaacgcggaggccagggcugguauuucgaucugugggggagaggaacccuaauuguuguguccucu

SEQ ID NO: 25952 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauucauuggguuaggcaggcaccuggacagggucuugaauggauaggcugggugaaggccguauccggggcggugaacuacggaucucuggacuuucggcaccgcgucucguugacgcgagaucgugacuuaucaaccgcucauauggauaucagaggccugacacaggacgauacugccaccuauuucugugcaaggcaaaaauuugcccggggugaccaggggugguucuuugaucuauggggacgcggcacacucauugugguuagcagu

SEQ ID NO: 25953 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucaagacagagcucauucauugggugaggcaggcaccuggucagggccuugaauggauaggguggguaaaaacugugagcggagccgucaacuuuggcuccccaaauuuccggcaccgcgugucucugacgcgagaucgugacuuguuuaccgcgcauauggauaucagagguuuaacacagggggacacugcuaccuacuucugugccaggcaaaaguuugagcggggaggccagggcugguauuucgaucugugggggcgcggaacacuaauuguugugucguca

SEQ ID NO: 25954 - RNA, 375 nt, Artificial Sequence
  derived and/or modified sequence opt3 from anti-HIV-1_HeavyChain
caggugcaccuggagcaaagcggcuccggggucaagaaacucggagccucuguuagagugucaugcuggaccagugaagacaucuucgagaggacagaacuuauucauuggguacggcaggcucccggucagggccuggaguggauagggugggugaaggcagucagcggagccgugaacuacggcuccuuggauuuucgccaccgaguuucuuuaacucgugacagagaucuguucacggcgcauauggacaucaggggucuaacccaggaugacacagcuacuuauuuuugugcccggcaaaaauucgcacgcggggaucagggaugguuuuucgaccucuggggcagaggcacccugauuguggucucguca

SEQ ID NO: 25955 - RNA, 372 nt, Artificial Sequence
  derived and/or modified sequence opt3 from anti-HIV-1_HeavyChain
caggcccaccuggagcaaagcgcuuccggcgugaagagacccggggcaucugucaggguuucaugcuggaccagugaagacaucuucgagcggagcgaacucauuuacugggugcgccaggccccuggacagggucuugaguggauaggcuggguaaaaacaguguccggggcggucaaccuggcuccaaauuuucgacagcgugugucuuugacuagagauagggacuuauucacggcccauauggauauccggggacugacccaaggcgacacagcaacuuauuuuugugcccgccagaaguucgaaagaggugggcagggauggauuuuugaucuauggggcaggggcacccucaucgcuguuucguca

SEQ ID NO: 25956 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucaagagcgagcucauucauugggugaggcaggcaccuggucagggccuugaauggauaggguggguaaaaacagugacuggagccgucaacuuuggcuccucugauuuccggcagcgcgugucgcugacgcgagacggugauuuguuuaccgcgcacauggacauccguggguuaacacaaggagauacugcuaccuacuucugugccagacagaaguuuuaugcaggcggccaggggugguacuucgaccuguggggaagggguacacuaauuaucguuucaagc

SEQ ID NO: 25957 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacuucggaccgugaucugucaacggcucauauggacaucagaggucuaacccaggaugacacagccacuuauuucugugcaaggcaaaaauuugcccgcggggaucagggaugguucuuugaccucuggggccggggcacccugauuguugugagcagu

SEQ ID NO: 25958 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuugucaaccgcgcacauggacaucagagguuuaacacaagaugacacugcuaccuacuuuugugccaggcagaaguucgcacgcggggaucagggaugguuuuucgaccuguggggccggggcacacuaauuguugugagcagu

SEQ ID NO: 25959 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucaagagcgagcucauucauugggugaggcaggcaccuggucagggccuugaauggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugagcggggaggccagggcugguauuucgaccugugggggcgcggaacacuaauuguugugucaagc

SEQ ID NO: 25960 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggccaccagaucuccgaucgggugucucugacgcgcgaccgagauuuguucaccgcgcauauggacauucgugguuuaacacaaggggauacugcuaccuacuuuugugccagacagaaguucuaugcaggaggccagggcugguacuuugaccugugggggaggggaacacuaaucguugugucguca

SEQ ID NO: 25961 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaagaugacacugcuaccuacuucugugccaggcagaaguuugcacgcggggaucagggaugguucuuugaccuguggggccggggcacacuaauuguugugucaagc

SEQ ID NO: 25962 - RNA, 372 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacauccuuaagacagagcugauucauugggugaggcaggcacccggucagggcuuggaauggauaggguggguaaaagccgugagcggagcggucaacuacggcuccuuagauuuccggcaccgcgugucucugacucgagaccgugaucuauuuacggcucauauggacaucagaggucucacccaggaugacacagccacuuauuucugugcaaggcaaaaguuugcccgcggggaucagggaugguucuuugaccuguggggccggggcacccuuauuguugugucguca

SEQ ID NO: 25963 - RNA, 372 nt, Artificial Sequence
  derived and/or modified sequence opt3 from anti-HIV-1_HeavyChain
gugagaagcgucguucagugcgaggccggcgugaagaaacccggggcuuccguaaagaucucuugugcaaccucaggauacgccuucacacuguauuaccuccacugggugaggcaagcgccuggucagggccuugaauggauugggugggucaaaacugugacgggagcuguuaacuuuggcagugccuauuuccggcaucgcgugagccugaccccagaccgagauuuguuuacagcacacauggacauacgugguuuaacucagggggauaccgccacauacuucugcgcuagacagaaguuuuauaaaggaggccaaggcugguacuucgaccugugggggaggggaacccuaaucgucguguccucu

SEQ ID NO: 25964 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugccuugacagugaagauaucuucgagaggaccgaacugauucauugggugcggcaggcacccggucagggcuuggaguggauaggguggguaaaggccgugagcggagcggucaacuacggcuccuuagacuuucgccaccgagugucucugacacgugauagagaccuauucacugcucauauggauaucaggggucucacgcaggacgauaccgccacauauuuuugugcacggcaaaaauucgcccgcggggaccagggaugguuuuucgaucuguggggcagaggcacucuuauuguugugucguca

SEQ ID NO: 25965 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgcacggggcgaccaggguugguuuuucgaucuaugggggcgcggaacacucauugucgugaguucc

SEQ ID NO: 25966 - RNA, 375 nt, Artificial Sequence
  derived and/or modified sequence opt3 from anti-HIV-1_HeavyChain
caggcccaccuggagcaaagcggcuccggggugaagaaacucggagcuucugucaagucaaguugcuggaccagcgaagacaucuucgagagaacagaacuuauucauuggguuaggcaggcacccggucagggccuggaguggauagggugggugaaagccguauccggagcggugaacuacggcucuuuggauuuucggcaccgcgucucguuaacucgagaccgugaucugucaacggcucauauggacaucagaggucuaacccaggaugacacagccacuuauuucugugcaaggcaaaaguuugcccgcggggaucagggaugguucuuugaccucuggggccggggcacccugauugugguuagcagu

SEQ ID NO: 25967 - RNA, 375 nt, Artificial Sequence
  derived and/or modified sequence opt3 from anti-HIV-1_HeavyChain
caggcccaccuggagcaaagcggcgcuggggugaagaaacccggagcauccgucagaguuucuugcuggaccucagaagacaucuucgagaggacagaacucauucauugggugcggcaggccccuggucagggccuugaguggauaggguggguaaagaucgugaguggagcggucaacuuuggcagcccaaauuuccgccagcgagugucccugacucgugauagagacuuguuuacggcucacauggauauuagggguuuaacccaaggggacacagccacuuacuucugugcacggcagaaauuugaacgcggaggccagggcuggaucuucgaucugugggggagaggaacccuaauugccguuucuucg

SEQ ID NO: 25968 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggaugaagacuguaacgggagccgugaacuuuggcagcccaaauuuccgccaccgagucucccugacccgugauagagacuuguuuacagcgcauauggauaucagggguuuaacucagggggacaccgcuacauacuucugugcccggcaaaaauuugaacgcggaggccagggcugguauuucgaucugugggggagaggaacccuaauugugguuucuucg

SEQ ID NO: 25969 - RNA, 375 nt, Artificial Sequence
  derived and/or modified sequence opt3 from anti-HIV-1_HeavyChain
caggcccaccuggagcaaagcggcuccgaagugaagaaacccggggcuucugucagaguuucaugcuggaccagugaggacaucuucgaaaggacagagcucauucauugggugcggcaggcaccuggacagggucuugaauggauaggcuggguaaagacugugacgggggccgucaacuuuggaagcccaaauuuccgccaccgagugucccugacccgugauagagacuuguuuacagcgcauauggauaucaggggcuuaacucagggugacaccgcuacauacuucugugcccggcaaaaauuugagcgcgggggacagggcugguauuucgaucuguggggcagagggacccuaauuguugugucuucg

SEQ ID NO: 25970 - RNA, 375 nt, Artificial Sequence
  derived and/or modified sequence opt3 from anti-HIV-1_HeavyChain
caggcccaccuggagcaaagcggcgcuggggugaagaaacucggagcauccgucagaguuucuugcuggaccucaggugacaucuucgaaaggacagagcuuauucauugggugcggcaggcccccggccaggggcuggaauggauaggauggguaaaggcggugaguggcgcugucaacuacgguagcuuggauuuucgccagcgaguguccuuaacucgugacagagaucuguucacggcccacaucgacauuagggggcuaacccaaggagauacagcaacuuauuuuugugcccggcagaaauucgagcgcggcggccagggguggaucuuugaccucuggggaagagguacccugauugcuguuucuucg

SEQ ID NO: 25971 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcugggcaagugaagacaucuucgagaggaccgaacuuauucauugggugcggcaggcccccggucagggccuggaguggauaggguggguaaaggcggugagcggagcugucaacuacggcuccuuggauuuucgccaccgagugucuuuaacacgugacagagaucugucgacugcccauauggacaucaggggucuaacgcaggaugacaccgcaacauauuucugugcccggcaaaaauuugcucgcggggaucagggaugguucuuugaccucuggggcagaggcacucugauuguugugucaagc

SEQ ID NO: 25972 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggaaccgucaacuuuggcagccagaauuuccgccaacgagugucccugacacgugauagagacuuguuuacugcccacauggauaucagggguuuaacccagggggacacagcgaccuacuucugugcucggcagaaauuugaacgcggaggccagggcuggauuuucgaucugugggggagaggaacucuaaucgccguuucuucg

SEQ ID NO: 25973 - RNA, 375 nt, Artificial Sequence
  derived and/or modified sequence opt3 from anti-HIV-1_HeavyChain
caggcccaccuggagcaaagcggcuccggggugaagagacccggagcuucugucaggguuucaugcuggaccagugaagacaucuucgagacaacugaacucauucauugggugcggcaggcaccuggucagggccuugaguggauaggguggguaaaaacggugaccggagccgucaacuuuggcagcccaaauuuccgccaccgagugucccugacacgugauagagacuuguuuacugcgcauauggauaucagggguuuaacccagggggacacagcuaccuacuucugugcccggcaaaaguuugaacgcggaggccagggcugguauuucgaucugugggggagaggaacucuaauuguugugucuucg

SEQ ID NO: 25974 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacauccucaggaaaagcgagcuuauucauugggugcggcaggcaccuggucagggccuggaauggauaggguggguaaagacagugacuggagccgucaacuucggcuccucugauuuucgccagcgagugucguugacgcgugacagagauuuauucaccgcgcacauggacaucaggggucugacacaaggggauacugcuaccuacuuuugugcccggcagaaguucuaugcaggaggccagggcugguacuuugaccuaugggggcgcggaacacucauuguugugucaagc

SEQ ID NO: 25975 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucaagacagagcucauucauugggugaggcaggcaccuggucagggccuugaauggauaggguggguaaaaacugugacgggaaccgucaacuuuggcagccugaauuuccggcagcgcguguccuugacacgagaucgugacuuauuuacugcccacauggauaucagaggucugacccaaggggacacagcgaccuacuucugugcuaggcagaaguuuuaugccggaggccagggcugguacuucgaucuaugggggcggggaacucucauuguugugucuucg

SEQ ID NO: 25976 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccacuuauuuuugugcacggcaaaaauucgcccgcggggaucagggaugguuuuucgaccucuggggcagaggcacccugauuguugugucguca

SEQ ID NO: 25977 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcuccgauuuccgccagcgagugucucugacccgugacagagauuuguuuacagcgcacauggacaucagggguuuaacucaaggggauaccgcuacauacuucugugcccggcagaaauuuuaugcaggaggccagggcugguacuucgaccugugggggcgcggaacccuaauuguugugucguca

SEQ ID NO: 25978 - RNA, 375 nt, Artificial Sequence
  derived and/or modified sequence opt3 from anti-HIV-1_HeavyChain
caggugcaacugguccagagcggcgccgagguuaagaaacccggggcuuccgugagaguaucuugcuggaccucagaagacaucuucgagaggagugaacucauuuacugggugcggcaggcaccuggacgcggucuugaguggauaggcuggaucaagcuggucagcggggccgugaacuuuggauccguugauuuccgagaccgugugucuuugacaagagauagggacuuauuuacugcgcacauggauauucggggccugacgcaggacgauaccgcuacauauuucugugcccgccaaaaauuugcaagaggugaccaggggugguucuuugaucuauggggaaggggcacucucaucgucgugucguca

SEQ ID NO: 25979 - RNA, 375 nt, Artificial Sequence
  derived and/or modified sequence opt3 from anti-HIV-1_HeavyChain
caggcccaccuggagcaaagcagauccggcgugaagaaacccggggcuucugucaggguuucaugcuggaccagugaagacaucuucgagcggacagaacucauucauugggugcgccaggcaccuggacagggucuugaguggauaggcuggguaaaggccgugagcggggcggucaacuuuggauccccaaauuuccgacaccgugugucucugacuagagauagggacuugucgacggcucauauggauauccggggcuuaacccaggacgauacagccacuuacuuuugugcacgccaaaaauucgccagaggugaccaggggugguuuuucgaucuguggggaaggggcacccuaauuguugugucaagc

SEQ ID NO: 25980 - RNA, 375 nt, Artificial Sequence
  derived and/or modified sequence opt3 from anti-HIV-1_HeavyChain
cagagcuaccuggagcaauccggcucugcaaugaagaaacccggggcuucagugagagucaguugcuggaccagcgaagacaucuucgauacaacugagcucauuuauuggguuaggcaggcaccuggacagggucuugaauggauaggcugggugaagaucguauccgggacggugaacuuugccucucuggacuuccggaaucgcauuucguugucacgagaucgugacuuauuuaccgcgcacauggauaucagaggacugacacagggcgacacugcuaccuacuucugugccaggcaaaaauuuuaugccggugggcagggaugguacuucgaucuauggggccggggcacacucauugucgugagcagu

SEQ ID NO: 25981 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaagacagaacucauucauugggugaggcaggcaccuggucagggccuugaguggauaggguggguaaaagccgugagcggagcggucaacuacggcucccuggauuuucggcaccgcgugucuuugacucgagaccgugauuuauucacggcucauauggacaucagaggucugacccaggaugacacagccacuuauuuuugugcaaggcaaaaguucgcccgcggggaucagggaugguuuuucgaccuauggggccggggcacccucauuguugugucguca

SEQ ID NO: 25982 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucaagagcgagcucauucauugggugaggcaggcaccuggucagggccuugaauggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuguugugucaagc

SEQ ID NO: 25983 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacaggacgauacugcuaccuacuucugugcccggcaaaaauuugcacgcggggaccagggaugguucuuugaucuguggggcagaggcacacuaauuguugugucguca

SEQ ID NO: 25984 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuugcacgcggagaucagggcugguucuuugaccuguggggcagagggacccuaaucguugugucguca

SEQ ID NO: 25985 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccagggggauacagccacuuauuuuugugcacggcaaaaauucuacgccggaggccagggcugguauuuugaccucugggggcgcggaacccugauuguugugucguca

SEQ ID NO: 25986 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacagggcgacacugcuaccuauuuuugugccaggcaaaaauucgagcggggugggcagggaugguacuuugaucuauggggccgcggcacacucauugucgugaguucc

SEQ ID NO: 25987 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggcagcgcgucucguugacccgagaucgugacuuauuuacagcgcauauggauauuagaggacugacucaaggcgacaccgcuacauauuucugugccaggcagaaauuugagcggggugggcagggauggaucuucgaucuauggggccgcggcacccucauugcagugucaagc

SEQ ID NO: 25988 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggaaccgucaacuuuggcagccugaauuuccgccagcgaguguccuugacacgugauagagacuuauuuacugcccacauggauaucaggggucugacccaaggggacacagcgaccuacuucugugcucggcagaaauuugaacgcggaggccagggcuggauuuucgaucuaugggggagaggaacucucaucgccguuucuucg

SEQ ID NO: 25989 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugaacgcggaggccagggcugguauuucgaucugugggggagaggaacccuaauuguugugucuucg

SEQ ID NO: 25990 - RNA, 375 nt, Artificial Sequence
  derived and/or modified sequence opt3 from anti-HIV-1_HeavyChain
agacacaccguggagcagagcggcuccggggucaagaaacccggagccucuguuagggugucaugcuggacaagugaagacaucuucgagcggacugaacugauucauuggguacgccaagcuccuggucagggccucgaguggauagggugggugaagacggucagcggagcagugaacuuuggcuccccaaauuuccgacaccguguuucucuuaccagagauagggaccuguuuacagcccauauggauauccgggguuugacucagggggacaccgcgacauacuucugugcucgccagaaauuugaaagaggaggccaaggcugguauuucgauuuaugggggaggggaacccugauuguggucucguca

SEQ ID NO: 25991 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugaacggggaggccagggcugguauuucgaccugugggggcgcggaacacuaauuguugugucaagc

SEQ ID NO: 25992 - RNA, 375 nt, Artificial Sequence
  derived and/or modified sequence opt3 from anti-HIV-1_HeavyChain
agacacaccugggagcagagcggcuccggggugaagaaacugggagccucugucaggguuucaugcuggacaagugaagacaucuucgagcggacugaacucauucauugggugcgccaagcucccggucagggccuugaguggauaggguggaugaaggcaguaagcggagccgugaacuacggcucccuggauuuucgacaccgugucucuuugacgagagacagggauuuaucgaccgcgcauaucgacauucggggucugacacaggaugacacugcuaccuauuucugugcccgccagaaauuugcaagaggggaucaaggaugguucuuugaccuauggggcaggggcacacucaucgugguuucaagc

SEQ ID NO: 25993 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaagacugugacgggagccgucaacuuuggcagcccuaauuuccgccaccgaguguccuugacccgugauagagacuuauuuacagcgcauauggauaucaggggucugacucagggggacaccgcuacauacuucugugcccggcaaaaauuugaacgcggaggccagggcugguauuucgaucuaugggggagaggaacccucauuguugugucuucg

SEQ ID NO: 25994 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugaacgcggaggccagggcuggauuuucgaucugugggggagaggaacccuaaucgcaguuucuucg

SEQ ID NO: 25995 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcaccgcgugucgcugacgcgagaccgugauuuguuuaccgcgcauauggacaucagagguuuaacacagggggauacugcuaccuacuucugugccaggcaaaaguauuacgcaggaggccagggcugguauuuugaccugugggggcggggaacacuaauuguugugucaagc

SEQ ID NO: 25996 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggguaucagaggguuaacacaaggagacacugcuaccuacuucugugccaggcagaaguuuuaugcaggcggccaggggugguacuucgaucuguggggacgggguacacuaauuguugugucaagc

SEQ ID NO: 25997 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcguguuucugacgcgagaccgugauuuguucaccgcgcacauggacaucagagguuuaacacaaggggauacugcuaccuacuuuugugccaggcagaaguucuaugcaggaggccagggcugguacuuugaccugugggggcggggaacacuaauuguugugucguca

SEQ ID NO: 25998 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaaggccgugagcggagcggucaacuacggcucccuggauuuucgccaccgagugucuuugacucgugacagagauuuaucgacggcucauauggacaucaggggucugacccaggaugacacagccacuuauuucugugcacggcaaaaauuugcccgcggggaucagggaugguucuuugaccuauggggcagaggcacccucauuguugugucaagc

SEQ ID NO: 25999 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcucccaggauuuccgggaccgcuuuucucugacgcgagaucgugacuuguucaccgcgcacauggauaucagagguuuaacacaaggggacacugcuaccuacuuuugugccaggcagaaguucuaugcaggaggccagggcugguacuuugaucugugggggcggggaacacuaauugugguuucguca

SEQ ID NO: 26000 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgaugcaacaggacucauuuacuggguuaggcaggccccuggucagggccuugaguggauagggugggugaagaucguauccggaacugugaacuuugcgucucuggacuuccggcagcgcgucucguugacgcgagaucgugacuuauuuaccgcucauauggauauuagaggccugacacaaggugacacugccaccuauuucugugcaaggcagaaauuuuacgccgggggacagggcugguauuucgaucuauggggccgggggacacucaucgugguuucaagc

SEQ ID NO: 26001 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcuuauauggacaucaggggucuaacccaggaugacacagccacuuacuucugugcacggcaaaaauuugcccgcggggaucagggaugguucuuugaccucuggggcagaggcacccugauuguugugucaagc

SEQ ID NO: 26002 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccauuuaucucugugcacggcaaaaauuugcccgcggggaucagggaugguucuuugaccuguggggcagaggcacucuuaucguugugucguca

SEQ ID NO: 26003 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacagggcgacacugcuaccuauuuuugugccaggcaaaaauucgagcggggugggcagggauggauuuuugaucuauggggccgcggcacacucaucgcagucaguucc

SEQ ID NO: 26004 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccccaaauuuccggcaccgcgugucucugacgcgagaucgugacuuguuuaccgcgcauauggauaucagagguuuaacacagggggacacugcuaccuacuucugugccaggcaaaaguuugaacggggaggccagggcugguauuucgaucugugggggcgcggaacacuaauuguugugucguca

SEQ ID NO: 26005 - RNA, 375 nt, Artificial Sequence
  derived and/or modified sequence opt3 from anti-HIV-1_HeavyChain
caggcccaccccgagcaaagcggcuccggggugaagaaaccuggagcuucugucagaguuucaugcuggaccagugaagacaucuucgaaaagagcgagcugauucauugggugaggcaggcaccaggucagggccucgaguggauaggguggguaaaaacagugacuggagccgucaacuuuggcuccucugauuuccggcagcgcgugucgcuuacgcgagaccgugaucuguuuaccgcgcacauggacaucagagguuugacacaaggggauacugcuaccuacuucugugccaggcagaaguuuuaugcaggaggccagggcugguacuucgacuuaugggggcggggaacacugauuguugugucaagc

SEQ ID NO: 26006 - RNA, 375 nt, Artificial Sequence
  derived and/or modified sequence opt3 from anti-HIV-1_HeavyChain
agagcccaccuggagcagagcggcuccggggugaggaagcccggagcuucuguccggguuucaugcuggaccagugaagacaucuucgagaaaagcgaacucauucauugggugcgccaagcaccuggucagggccuugaguggauaggguggguaaagacagugacuggagccgucaacuuuggcuccucugauuuccgacagcgugugucgcugacgagagacagggauuuguuuaccgcgcacauggacauccgggguuuaacacagggggauacugcuaccuacuucugugcccgccaaaaauuuuaugcaggaggccagggcugguacuucgaccugugggggagaggaacacuaauuguugugucaagc

SEQ ID NO: 26007 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugaacgcggaggccagggcuggauuuucgaucugugggggagaggaacacuaaucgcaguuucguca

SEQ ID NO: 26008 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaaguccgaacucauucauuggguuaggcaggcaccuggacagggucuugaguggauaggcugggugaaaacaguaacuggggccgugaacuuuggaucuucggauuuccggcagcgcgucucacugacgcgagaccgugauuuguuuaccgcgcacauggacaucagaggcuuaacacaaggugauacugcuaccuacuucugugccaggcagaaguuuuaugcagggggacagggcugguacuucgaccuguggggccgggggacacuaauugugguuagcagu

SEQ ID NO: 26009 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacauauuguugugucaagc

SEQ ID NO: 26010 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuugaacgcggaggccagggcuggaucuucgaucugugggggagaggaacccuaauugcaguuucguca

SEQ ID NO: 26011 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucuucggacuuccggcaucgcgucucacugacccgagaucgugacuugagcacagcgcacauggauauuagaggauuaacucaggacgauaccgcuacauauuuuugugccaggcaaaaauucgcacggggcgaccaggguugguuuuucgaucugugggggcgcggaacccuaaucgugguuaguucc

SEQ ID NO: 26012 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuuuaugcaggaggccagggcugguacuucgaucugugggggcgcggaacccuaaucguugugucguca

SEQ ID NO: 26013 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggagcgaacucauucauugggugcggcaggcaccuggucagggccuugaguggauaggguggguaaagacagugacuggagccgucaacuuuggcuccccaaauuuccgccagcgagugucucugacgcgugauagagacuuguuuaccgcgcacauggauaucagggguuuaacagaaggggacacugcuaccuacuucugugcccggcaaaaauuuuaugcaggaggccagggcugguacuucgaucugugggggcgcggaacacuaauuguugugucguca

SEQ ID NO: 26014 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggcuaacuacggcuccuuggauuuucgccaccgagucucuuuaacucgugacagagaucuguucacggcccauauggacaucaggggucuaacccaggaugacacagcaacuuauuuuugugcccggcaaaaauucgcucgcggggaucagggaugguuuuucgaccucuggggcagaggcacccugauugugguuucguca

SEQ ID NO: 26015 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacaguguccggagccgucaacuuuggcucuccaaauuuccggcaccgcgugucgcugacucgagaucgugacuuguuuacggcgcauauggauaucagagguuuaacccagggggacacagcuacuuacuucugugccaggcaaaaguuugaacggggaggccagggcugguauuucgaucugugggggcgcggaacccuaauuguugugucaagc

SEQ ID NO: 26016 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuuuggcuccccuaauuuccgccaccgagugucuuugacucgugauagagacuuauuuacggcucauauggauaucaggggucugacccagggggacacagccacuuacuucugugcacggcaaaaauuugaacgcggaggccagggcugguauuucgaucuaugggggagaggaacccucauuguugugucguca

SEQ ID NO: 26017 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuaccugugugcccggcagaaauucgaacgcggaggccagggcuggaucuuugaucuaugggggagaggaacccucauugcaguuucguca

SEQ ID NO: 26018 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacaguguccggagccgucaacuuuggcucuccaaauuuccgccaccgagugucgcugacucgugauagagacuuguuuacggcgcauauggauaucagggguuuaacccagggggacacagcuacuuacuucugugcccggcaaaaauuugaacgcggaggccagggcugguauuucgaucugugggggagaggaacccuaauuguugugucaagc

SEQ ID NO: 26019 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggaaccgucaacuuuggcagccugaauuuccgccagcgaguguccuugacacgugauagagacuuauuuacugcccacauggauaucaggggucugacccaaggggacacagcgaccuacuucugugcucggcagaaauuuuaugccggaggccagggcugguacuucgaucuaugggggcgcggaacucucauuguugugucuucg

SEQ ID NO: 26020 - RNA, 375 nt, Artificial Sequence
  derived and/or modified sequence opt3 from anti-HIV-1_HeavyChain
caggcccaccuggagcaaagcgcuuccggcgugaagagacccggggcaucugucaggguuucaugcuggaccagugaagacaucuucgagcggagcgaacucauuuacugggugcgccaggccccuggacagggucuugaguggauaggcuggguaaaaacaguguccggggcggucaacuuuggaucuacugauuuccgagaacgugugucgcugacgagagacagggauuuguuuaccgcucauauggacauccggggcuuaacacagggugauacugccaccuauuucugugcacgccaaaaguuugccagaggggaccagggaugguucuuugaucuguggggcaggggcacacuaauuguugugucaagc

SEQ ID NO: 26021 - RNA, 375 nt, Artificial Sequence
  derived and/or modified sequence opt3 from anti-HIV-1_HeavyChain
caggugcaccuggagcaaagcggcuccggggucaagaaacccggagccucuguuagagugucaugcuggaccagugaagacaucuucgagaggagcgaacucauucauuggguacggcaggcuccuggucagggccuugaguggauagggugggugaagacagucacuggagcagugaacuuuggcuccccaaauuuccgccaccgaguuucucugacgcgugauagagacuuguuuaccgcccauauggauaucagggguuuaacacagggggacacugcgaccuacuucugugcucggcaaaaauauuacgccggaggccagggcugguauuuugaucugugggggcgcggaacacuaauuguggucucguca

SEQ ID NO: 26022 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucugugguuuaacacaaggggauacugcuaccuacuucugcgccagacagaaguuuuaugcaggaggccagggcugguacuucgaccugugggggaggggaacacuaauuguugugucaagc

SEQ ID NO: 26023 - RNA, 375 nt, Artificial Sequence
  derived and/or modified sequence opt3 from anti-HIV-1_HeavyChain
caggcccaccuggagcaaagcggcuccggggugaagaaacccgaggcuucugucagaguuucaugcuggaccagugaagacaucuucgaaaagagcgagcucauucauugggugaggcaggcaccuggacagggucuugaauggauaggcuggguaaaaacagugacuggggccgucaacuuuggauccucugauuuccggcagcgcgugucgcugacgcgagaccgugauuuguuuaccgcgcacauggacaucagaggcuuaacacaaggugauacugcuaccuacuucugugccaggcagaaguuuuaugcagggggacagggcugguacuucgaccuguggggccgggggacacuaauuguugugucaagc

SEQ ID NO: 26024 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccagcgagugucccugacccgugauagagacuuguuuacagcgcacauggauaucagggguuuaacucaaggggacaccgcuacauacuucugugcccggcagaaauuugaacgcggaggccagggcuggauuuucgaucugugggggagaggaacccuaaucgcaguuucuucg

SEQ ID NO: 26025 - RNA, 375 nt, Artificial Sequence
  derived and/or modified sequence opt3 from anti-HIV-1_HeavyChain
caggcccaccuggagcaaagcgcuuccggcgugaagagacccggggcaucugucaggguuucaugcuggaccagugaagacaucuucgagcggacagaacucauuuacugggugcgccaggccccuggacagggucuugaguggauaggcuggguaaaaacugugagcggggcggucaacuuuggaucccaggauuuccgagaccguuuuucucugacgagagauagggacuuguucaccgcucauauggauauccggggcuuaacacaaggugacacugccaccuauuuuugugcacgccagaaguucgaaagagggggacagggcugguacuuugaucuguggggcagggggacacuaauugugguuucguca

SEQ ID NO: 26026 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaaucguguccggagccgucaacuuuggcucuccaaauuuccggcagcgcgugucgcugacacgagaucgugacuuguuuacugcgcacauggauauuagagguuuaacgcaaggggacaccgcuacauacuucugugccaggcagaaguuugaacggggaggccagggcuggaucuucgaucugugggggcgcggaacucuaauugcaguuucaagc

SEQ ID NO: 26027 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacccguuuacagcgcauauggauaucagggguuugacucagggggacaccgcuacauacuucugugcccggcaaaaauuugaacgcggaggccagggcugguauuucgauuuaugggggagaggaacccugauuguugugucuucg

SEQ ID NO: 26028 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcggucucauucauugggugaggcaggcaccuggccaggggcuugaguggauaggauggguaaaaacagugacuggcgccgucaacuuugguuccucugauuuccggcagcgcgugucgcugacgcgagaccgugauuuguuuaccgcgcacauggacaucagaggguuaacacaaggagauacugcuaccuacuucugugccaggcagaaguuuuaugcaggcggccaggggugguacuucgaccuguggggacgggguacacuaauuguugugucaagc

SEQ ID NO: 26029 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaagccguguccggaacagucaacuacggcucucuggauuuucggcaccgcgugucguugacucgagaccgugauuuauucacggcgcauauggacaucagaggucugacccaggaugacacagcuacuuauuuuugugccaggcaaaaguucgcacgcggggaucagggaugguuuuucgaccuauggggccggggcacccucauuguugugucaagc

SEQ ID NO: 26030 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguagcgaacucauucauugggugaggcaggcaccuggccaggggcuugaguggauaggauggguaaagacagugacuggcgccgucaacuuugguuccgcguacuuccggcaccgcgugucucugacgcgagaucgugacuuguuuaccgcucauauggauaucagaggguuaacacagggagacacugccaccuauuucugugcaaggcaaaaauuuuacgccggcggccaggggugguauuucgaucuguggggacgggguacacuaauuguugugucguca

SEQ ID NO: 26031 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuuuaugcaggaggccagggcugguacuucgaccuaugggggcgcggaacacucaucgugguuucguca

SEQ ID NO: 26032 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaaggccguguccggagcggucaacuacggcucucuggauuuucgccaccgagugucguugacacgugacagagauuuaucaacugcucauauggacaucaggggucugacgcaggaugacaccgccacacacuucugugcacggcaaaaauuugcccgcggggaucagggaugguucuuugaccuauggggcagaggcacucucauuguugugagcagu

SEQ ID NO: 26033 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguacagaacucauucauugggugaggcaggcaccuggccaggggcuugaguggauaggauggguaaagaucgugagcggcgccgucaacuuugguuccccaaauuuccggcagcgcgugucucugacucgagaucgugacuuguuuacggcgcacauggauauuagaggguuaacccaaggagacacagcuacuuacuucugugccaggcagaaauuugaacggggcggccagggguggaucuucgaucuguggggacgcgguacccuaauugcaguuucguca

SEQ ID NO: 26034 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccagcgagugucccugacccgugauagagacuuguuuacagcgcacauggauaucagggguuuaacucaaggggacaccgcuacauacuucugugcccggcagaaauuuuaugcaggaggccagggcugguacuucgaucugugggggcgcggaacccuaauuguugugucuucg

SEQ ID NO: 26035 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguagcgaacucauucauugggugaggcaggcaccuggccaggggcuugaguggauaggauggguaaagacagugacuggcgccgucaacuuugguuccccaaauuuccggcaccgcgugucucugacgcgagaucgugacuuguuuaccgcgcauauggauaucagaggguuaacacagggagacacugcuaccuacuucugugccaggcaaaaauuugaacggggcggccaggggugguauuucgaucuguggggacgcgguacacuaauuguugugucguca

SEQ ID NO: 26036 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugcacgcggagaucagggcugguucuuugaccuguggggcagagggacacuaauuguugugucguca

SEQ ID NO: 26037 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagguaucuucgagaggacagaacucauucauugggugcggcaggcaccuggccaggggcuugaguggauaggauggguaaagaucgugagcggcgccgucaacuuugguuccccaaauuuccgccagcgagugucucugacucgugacagagauuuguuugcggcucacauggacauuaggggguuaacgcaaggagauaccgccacauacuucugugcacggcagaaauuugaacgcggcggccagggguggaucuucgaccuguggggaagagguacucuaauugccguuucguca

SEQ ID NO: 26038 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagagggcagaacuuauucauugggugcggcaggcccccggucagggccuggaguggauaggguggguaaaggcggugagcggagcugucaacuacggcuccuuggauuuucgccaccgagugucuuuaacacgugacagagaucuguucacugcccauauggacaucaggggucuaacgcaggaugacaccgcaauuuauuuuugugcccggcaaaaauucuacgcugggggacagggcugguauuuugaucucuggggccgcgggacacugaucguugugucguca

SEQ ID NO: 26039 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccccuaauuuucgccagcgagugucuuugacucgugauagagacuuauucacggcucacauggauaucaggggucugacccaaggggacacagccacuuauuuuugugcacggcagaaauucgaacgcggaggccagggcuggauuuuugaucuaugggggagaggaacccucaucgccguuucguca

SEQ ID NO: 26040 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuacggcagccugaauuuucgcucccgaaucucuuugacccgugauagagacuuauucacagcgcacauggauauuaggggucugacugaaggggacaccgcuacauauuuuugugcccggcagaaauucuacgcaggaggccaaggcugguauuuugaucuaugggggcgcggaacccucaucgugguuucguca

SEQ ID NO: 26041 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacaguguccggagccgucaacuuuggcucuccaaauuuccggcagcgcgugucgcugacucgagaucgugacuuguuuacggcgcacauggauaucagagguuuaacccaaggggacacagcuacuuacuucugugccaggcagaaguuugaacggggaggccagggcuggauuuucgaucugugggggcgcggaacccuaaucgcaguuucaagc

SEQ ID NO: 26042 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauacgcuggguaaaggccgugagcggggcggucaacuacggauccuuggauuuucgacaccgugugucuuuaacuagagacagggaucugucgacggcucauauggacauccggggccuaacccaggaugacacagccacuuauuucugugcacgccaaaaauuugccagaggugaucaggggugguucuuugaccucuggggaaggggcacccugauuguugugucaagc

SEQ ID NO: 26043 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaagacugugacgggagccgucaacuuuggcagcuccgauuuccgccagcgagugucuuugacccgugacagagauuuauuuacagcgcaaauggacaucaggggucugacucagggggauaccgcuacauacuucugugcccggcagaaauuuuaugcaggaggccagggcugguacuucgaccuaugggggcgcggaacccucauuguugugucguca

SEQ ID NO: 26044 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuugcgcaccagaucuccgaucgggugucucugacgcgcgaccgagauuuguucaccgcucauauggacauucguggcuuaacacaaggugauacugccaccuacuuuugugcaagacagaaguucuaugccgggggacagggcugguacuuugaccuguggggcagggggacacuaaucguugugucguca

SEQ ID NO: 26045 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagguggucagcggagccgugaacuuuggcuccccaaauuuccgccagcgaguuucucugacucgugauagagacuuguuuacggcgcacauggauaucagggguuuaacccaaggggacacagcuacuuacuucugugcccggcagaaauuugaacgcggaggccagggcuggauuuucgaucugugggggagaggaacccuaaucgcagugucguca

SEQ ID NO: 26046 - RNA, 375 nt, Artificial Sequence
  derived and/or modified sequence opt3 from anti-HIV-1_HeavyChain
caggugcaccuggagcaaagcggcuccggggucaagaaacccggagccucuguuagagugucaugcuggaccagugaagacaucuucgaaaagagcgagcucauucauuggguaaggcaggcuccuggucagggccuugaguggauagggugggugaaaacagucacuggagcagugaacuuuggcuccucugauuuccggcagcgcguuucgcugacgcgagaccgugauuuguuuaccgcccacauggacaucagagguuuaacacaaggggauacugcgaccuacuucugugcuaggcagaaguuuuaugccggaggccagggcugguacuucgaccugugggggcggggaacacuaauuguggucucaagc

SEQ ID NO: 26047 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaacgcggaggccagggcuggaucuucgaccuaugggggagaggaacacucauugcagugucguca

SEQ ID NO: 26048 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcguauauggauaucagaggacugacacaggacgauacugcuaccuacuuuugugccaggcaaaaauucgcacggggcgaccaggguugguuuuucgaucuaugggggcgcggaacacucauugucgugaguucc

SEQ ID NO: 26049 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauaccugugugcccggcaaaaauucgaacgcggaggccagggcugguauuuugaucuaugggggagaggaacccucauuguugugucuucg

SEQ ID NO: 26050 - RNA, 372 nt, Artificial Sequence
  derived and/or modified sequence opt3 from anti-HIV-1_HeavyChain
agacacaccugggagcagagcggcuccggggugaagaaacccggagccucugucaggguuucaugcuggacaagugaagacaucuucaagagcgagcugauucauugggugcggcaagcuccuggucagggccucgaauggauaggguggguaaaaacugugacgggagcagucaacuuuggcuccucugauuuccgccagcgagugucgcuuacccgugacagagaucuguuuacagcccacauggacaucagggguuugacucagggggauaccgcgacauacuucugugcucggcaaaaguuuuaugccggaggccagggcugguacuucgacuuaugggggcgcggaacccugauuguugugucaagc

SEQ ID NO: 26051 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacugaaggggacaccgcuacauacuucugugcccggcagaaauuuuaugcaggaggccaaggcugguacuucgaucugugggggcgcggaacccuaauuguugugucuucg

SEQ ID NO: 26052 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcgcguacuuccgccaccgagugucccugacccgugauagagacuuguuuacagcucauauggauaucagggguuuaacucagggggacaccgccacauauuucugugcacggcaaaaauuuuacaagggaggccagggcugguauuucgaucugugggggcgcggaacccuaauuguugugucuucg

SEQ ID NO: 26053 - RNA, 375 nt, Artificial Sequence
  derived and/or modified sequence opt3 from anti-HIV-1_HeavyChain
caggcccaccuggagcaaagcggccccggggugaagaaacucggagcuuccgucagaguuucuugcuggaccucagaagacaucuucgagaggacagaacuuauucauugggugcggcaggcaccuggucagggccuggaguggauaggguggguaaaggccgugaguggagcggucaacuacggcagcuuggauuuucgccaccgaguguccuuaacucgugacagagaucuguucacggcucauauggacaucaggggucuaacccaggaugacacagccacuuauuuuugugcacggcaaaaauucgcccgcggggaucagggaugguuuuucgaccucuggggcagaggcacccugauuguugugucuucg

SEQ ID NO: 26054 - RNA, 375 nt, Artificial Sequence
  derived and/or modified sequence opt3 from anti-HIV-1_HeavyChain
agagcccaccuggagcagagcggcuccggggugaagaaacccggagcuucugucaggguuucaugcuggaccagugaagacaucuucgagcggacagaacucauucauugggugcgccaagcaccuggucagggccuugaguggauaggguggguaaagaucgugagcggagccgucaacuuuggcuccccaaauuuccgacagcgugugucucugacuagagauagggacuuguuuacggcgcacauggauauucgggguuuaacccagggggacacagcuacuuacuucugugcccgccaaaaauuugaaagaggaggccagggcuggaucuucgaucugugggggaggggaacccuaauugcaguuucguca

SEQ ID NO: 26055 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaagacugugacgggagccgucaacuuuggcagcuccgauuuccgccagcgagugucuuugacccgugacagagauuuauuuacagcgcacauggacaucaggggucugacucaaggggauaccgcuacauacuucugugcccggcagaaauuuuaugcaggaggccagggcugguacuucgaccuaugggggcgcggaacccucauuguugugucguca

SEQ ID NO: 26056 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaaggccguguccggagcggucaacuacggcucucuggauuuucgccaccgagugucguugacacgugacagagauuuauucacugcucauauggacaucaggggucugacgcaggaugacaccgccauuuauuuuugugcacggcaaaaauucgcccgcggggaucagggaugguuuuucgaccuauggggcagaggcacacucaucguugugucaagc

SEQ ID NO: 26057 - RNA, 375 nt, Artificial Sequence
  derived and/or modified sequence opt3 from anti-HIV-1_HeavyChain
caggcccaccuggagcaaagcggcuccggggugaagaaagucggagcuucuguuagagugucaugcuggaccagugaagacaucuucgagaggacagaacucauucauuggguacggcaggcacccggucagggccuugaguggauagggugggugaaggccgucagcggagcggugaacuacggcucccuggauuuucgccaccgaguuucuuugacucgugacagagauuuauucacggcucauauggacaucaggggucugacccaggaugacacagccauuuauuuuugugcacggcaaaaauucgcccgcggggaucagggaugguuuuucgaccuauggggcagaggcacucucaucguggucucguca

SEQ ID NO: 26058 - RNA, 375 nt, Artificial Sequence
  derived and/or modified sequence opt3 from anti-HIV-1_HeavyChain
caggugcaacugguccagagcggcgccgagcucaagaaacccggguccucuguuagagugucaugcuggaccagugaagacaucuucgagggaagcgaacuuauucacuggguaaggcaggcuccuggucagggccuggaguggauagggugggugaagacagucacuggagcagugaacuuuggcuccgccuacuuccggcaucgcguuucuuugacgcgagaucgugacuuauuuaccgcgcacauggauaucagaggucugacacaaggggacacugcuaccuauuucugugccaggcagaaauuuuacaagggaggccagggcugguauuucgaucuaugggggcggggaacacucauuguggucucguca

SEQ ID NO: 26059 - RNA, 375 nt, Artificial Sequence
  derived and/or modified sequence opt3 from anti-HIV-1_HeavyChain
caggcccaccuggagcaaagcggcuccggggugaagaaacccggagucucuguuagagugucaugcuggaccagugaagacaucuucgagaggacagaacucauucauuggguacggcaggcuccuggucagggccuugaguggauagggugggugaagaucgucagcggagcagugaacuuuggcuccccaaauuuccgccagcgaguuucucugacucgugauagagacuuguuuacggcccacauggauauuagggguuuaacccaaggggacacagcgacuuacuucugugcucggcagaaauuugaacgcggaggccagggcuggaucuucgaucugugggggagaggaacccuaauugccgugucguca

SEQ ID NO: 26060 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaagguggucagcggagccgugaacuacggcuccuuggauuuucgccaccgaguuucuuuaacucgugacagagaucuguucacggcgcauauggacaucaggggucuaacccaggaugacacagcuacuuauuuuugugcccggcaaaaauucgcacgcggggaucagggaugguuuuucgaccucuggggcagaggcacccugauuguggucucguca

SEQ ID NO: 26061 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccgcauauuuuugugcccggcaaaaauucgcucgcggggaucagggaugguuuuucgaccucuggggcagaggcacucugauuguugugucguca

SEQ ID NO: 26062 - RNA, 375 nt, Artificial Sequence
  derived and/or modified sequence opt3 from anti-HIV-1_HeavyChain
caggcccaccuggagcaaagcggcuccggggugagaaagcccggagcuucugucaggguuucaugcuggaccagugaagacaucuucgagaaaagcgaacucauucauugggugcggcaggcaccuggucagggccuugaguggauaggguggguaaagacagugacuggagccgucaacuuuggcuccucugauuuccgccagcgagugucgcugacgcgugacagagauuuguuuaccgcgcacauggacaucagggguuuaacacaaggggauacugcuaccuacuucugugcccggcagaaauuuuaugcaggaggccagggcugguacuucgaccugugggggcgcggaacacuaauuguugugucaagc

SEQ ID NO: 26063 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggaaccgucaacuuuggcagccugaauuuccgccagcgaguguccuugacacgugauagagacuuauuuacugcccacauggauaucaggggucugacccaaggggacacagcgaccuacuucugugcucggcagaaauuuuauaagggaggccagggcugguacuucgaucuaugggggcgcggaacucucauuguugugucuucg

SEQ ID NO: 26064 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauucauuggguucggcaggcaccuggacagggucuugaguggauaggcugggugaaggccguauccggggcggugaacuacggaucucuggauuuucgccaccgagucucguugacucgugacagagauuuauucacggcucauauggacaucaggggccugacccaggaugacacagccacuuauuuuugugcacggcaaaaauucgcccgcggugaucaggggugguuuuucgaccuauggggaagaggcacccucauugugguuucaagc

SEQ ID NO: 26065 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgagugucuuugacgcgugacagagauuuauuuaccgcgcauauggacaucaggggucugacacagggggauacugcuaccuacuucugugcccggcaaaaauuugcacgcggagaccagggcugguucuuugaucuauggggcagagggacacucauuguugugucguca

SEQ ID NO: 26066 - RNA, 375 nt, Artificial Sequence
  derived and/or modified sequence opt3 from anti-HIV-1_HeavyChain
caggcccaccuggagcaaagcggcuccggggugaagagacccggagcuucugucaggguuucaugcuggaccagugaagacaucuucgagacaacugaacucauucauugggugcggcaggcaccuggucagggccuugaguggauaggguggguaaaaacggugagcggagccgucaacuuuggcucccugaauuuccgccaccgagugucuuugacccgugauagagacuuauuuacagcgcauauggauaucaggggucugacucagggggacaccgcuacauacuucugugcccggcaaaaguuuuauaaaggaggccagggcugguacuucgaucuaugggggcgcggaacccucauuguugugucguca

SEQ ID NO: 26067 - RNA, 375 nt, Artificial Sequence
  derived and/or modified sequence opt3 from anti-HIV-1_HeavyChain
caggcccaccuggagcaaagcgcuuccggcgugagaaggcccggggcaucuguccggguuucaugcuggaccagugaagacaucuucgagcgcagcgaacucauuuacugggugcgacaggccccuggacguggucuugaguggauaggcuggaucaagcugguauccggggcggugaacuuuggaucugucgauuucagagacagggugucguugacacgggaucgcgacuuauuuacugcucauauggauauuagaggccugacgcagggugacaccgccacauauuucugugcaaggcagaaauuuuacgccgggggacaaggcugguauuucgaucuauggggccgggggacucucaucguugugucaagc

SEQ ID NO: 26068 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagaucguguccggagccgucaacuuuggcucuccaaauuuccgccagcgagugucgcugacacgugauagagacuuguuuacugcgcacauggauauuagggguuuaacgcaaggggacaccgcuacauacuucugugcccggcagaaauuugaacgcggaggccagggcuggaucuucgaucugugggggagaggaacucuaauugcaguuucaagc

SEQ ID NO: 26069 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaagacugugagcggagccgucaacuuuggcuccccuaauuuccgccaccgagugucuuugacgcgugauagagacuuauuuaccgcgcauauggauaucaggggucugacacagggggacacugcuaccuacuucugugcccggcaaaaauuugaacgcggaggccagggcugguauuucgaucuaugggggagaggaacacucauuguugugucguca

SEQ ID NO: 26070 - RNA, 375 nt, Artificial Sequence
  derived and/or modified sequence opt3 from anti-HIV-1_HeavyChain
caggcccaccuggagcaaagcggcuccggggugaagagacccggagcuucugucaggguuucaugcuggaccagugaagacaucuucgagaaaagcgaacucauucauugggugcggcaggcaccuggucagggccuugaguggauaggguggguaaagacagugacuggagccgucaacuuuggcuccucugauuuccgccagcgagugucgcugacgcgugacagagauuuguuuaccgcgcacauggguaucaggggguuaacacaaggagacacugcuaccuacuucugugcccggcagaaauuuuaugcaggcggccaggggugguacuucgaucuguggggacgcgguacacuaauuguugugucaagc

SEQ ID NO: 26071 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaaggccgugagcggagcggucaacuacggcucccuggauuuucgccaccgagugucuuugacucgugacagagauuuauucacggcucauauggacaucaggggucugacccaggaugacacagccauuuauuuuugugcacggcaaaaauucgcccgcggggaucagggaugguuuuucgaccuauggggcagaggcacucucaucguugugucguca

SEQ ID NO: 26072 - RNA, 375 nt, Artificial Sequence
  derived and/or modified sequence opt3 from anti-HIV-1_HeavyChain
cagagccaccuggagcaauccggcucugccaugaagaaacucggggcuucagugagaguccccugcuggaccagugaagacaucuucgagaggacagaacuuauucauuggguucggcaggcaccuggacagggucuggaguggauaggcugggugaaggccguaagcggggcggugaacuacggauccuuggauuuucgccaccgagucucuuuaacucgugacagagaucuguucacggcucauauggacaucaggggccuaacccaggaugacacagccacuuauuuuugugcacggcaaaaauucgcccgcggugaucaggggugguuuuucgaccucuggggaagaggcacccugauugugguuucguca

SEQ ID NO: 26073 - RNA, 375 nt, Artificial Sequence
  derived and/or modified sequence opt3 from anti-HIV-1_HeavyChain
caggugcaccuggagcaaagcggcuccggggucaagaaacccggagccucuguuagagugucaugcuggaccagugaagacaucuucgagaggacagaacucauucauuggguacggcaggcuccuggucagggccuugaguggauagggugggugaagaucgucagcggagcagugaacuuuggcuccccaaauuuccgccagcgaguuucucugacucgugauagagacuuguuuacggcccacauggauauuagggguuuaacccaaggggacacagcgacuuacuucugugcucggcagaaauuugaacgcggaggccagggcuggaucuucgaucugugggggagaggaacccuaauugccgugucguca

SEQ ID NO: 26074 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaaggccgugagcggagcggucaacuacggcucccuggauuuucgccaccgagugucuuugacucgugacagagauuuauucacggcucauauggacaucaggggucugacccaggaugacacagccacuuauuuuugugcacggcaaaaauucgcccgcggggaucagggaugguuuuucgaccuauggggcagaggcacccucauuguugugucguca

SEQ ID NO: 26075 - RNA, 375 nt, Artificial Sequence
  derived and/or modified sequence opt3 from anti-HIV-1_HeavyChain
caggcccaccuggagcaaagcgcuuccggcgugagaaggcccggggcaucuguccggguuucaugcuggaccagugaagacaucuucgagcgcagcgaacucauuuacugggugcgacaggccccuggacguggucuugaguggauaggcuggguaaagacaguguccggggcggucaacuuuggaucuccaaauuucagacauagggugucgcugacucgggaucgcgacuuguuuacggcucacauggauaucagaggcuuaacccagggugacacagccacuuauuucugugcaaggcagaaauuugaacgcgggggacaaggcugguacuucgaucuguggggccgggggacccuaauuguugugucaagc

SEQ ID NO: 26076 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccagcgagugucccugacccgugauagagacuuguuuacagcgcacauggauaucagggguuuaacucaaggggacaccgcuacauacuucugugcccggcagaaauuugaacgcggaggccagggcugguauuucgaucugugggggagaggaacccuaauuguugugucuucg

SEQ ID NO: 26077 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaauucuacgccggugggcaaggaugguauuuugaucuguggggcagaggcacccuaaucgucgugaguucc

SEQ ID NO: 26078 - RNA, 375 nt, Artificial Sequence
  derived and/or modified sequence opt3 from anti-HIV-1_HeavyChain
caggugcaacuggagcagagcggcuccggggucaagaaacccggagccucuguuagagugucaugcuggaccagugaagacaucuucgaaaagagcgagcucauucacuggguaaggcaggcuccuggucagggccuugaguggauagggugggugaaaacagucacuggagcagugaacuuuggcuccucugauuuccggcaacgcguuucgcugacgcgagaccgugauuuguuuaccgcccauauggacaucagagguuuaacacagggggauacugcgaccuacuucugugcuaggcagaaguuuuaugccggaggccagggcugguacuucgaccugugggggcggggaacacuaauuguggucucaagc

SEQ ID NO: 26079 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucgcggccuugaguggauaggguggguaaaggccgugagcggagcggucaacuacggcucccuggauuuucgacaccgugugucuuugacuagagacagggauuuauucacggcucauauggacauccggggucugacccaggaugacacagccacuuauuuuugugcacgccagaaauucgccagaggggaucaaggaugguuuuucgaccuauggggcaggggcacccucauuguugugucguca

SEQ ID NO: 26080 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauucauuggguucggcaggcaccuggacagggucuugaguggauaggcugggugaagacuguaacgggggccgugaacuuuggauccccaaauuuccgccaccgagucucucugacccgugauagagacuuguuuacagcgcauauggauaucaggggcuuaacucagggugacaccgcuacauacuucugugcccggcaaaaauuugaacgcgggggacagggcugguauuucgaucuguggggcagagggacccuaauugugguuucguca

SEQ ID NO: 26081 - RNA, 375 nt, Artificial Sequence
  derived and/or modified sequence opt3 from anti-HIV-1_HeavyChain
caggcccaccuggagcaaagcgcuuccggcgugaagagacccggggcaucugucaggguuucaugcuggaccagugaagacaucuucgagcggagcgaacucauuuacugggugcgccaggccccuggacagggucuugaguggacaggcuggguaaaaacuguguccggggcggucaacuuuggaucuacggauuuccgagaacgugugucgcugaccagagacagggauuuguuuacagcucauauggacauacggggcuuaacucagggugauaccgccacauauuucugugcacgccaaaaguuugccagaggggaccagggaugguucuuugaucuguggggcaggggcacccuaaucguugugucaagc

SEQ ID NO: 26082 - RNA, 375 nt, Artificial Sequence
  derived and/or modified sequence opt3 from anti-HIV-1_HeavyChain
caggugcaccuggagcaaagcggcuccggggucaagaaacucggagccucuguuagagugucaugcuggaccagugaagacaucuucgagaggacagaacuuauucauuggguacggcaggcucccggucgcggccuggaguggauagggugggugaaggcagucagcggagccgugaacuacggcuccuuggauuuucgacaccguguuucuuuaacuagagacagggaucuguucacggcgcauauggacauccggggucuaacccaggaugacacagcuacuuauuuuugugcccgccagaaauucgcaagaggggaucaaggaugguuuuucgaccucuggggcaggggcacccugauuguggucucguca

SEQ ID NO: 26083 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggagcgaacucauucauugggugcggcaggcaccuggucagggccuugaguggauaggguggguaaagacagugacuggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauauuacgcaggaggccagggcugguauuuugaucugugggggcgcggaacacuaauuguugugucguca

SEQ ID NO: 26084 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuuuaugcaggaggccagggcugguacuucgaucugugggggcgcggaacccuaauuguugugucuucg

SEQ ID NO: 26085 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaagggggaacugcuaccuacuucugugccaggcagaaguuuuaugcaggcggccaggggugguacuucgaucuguggggacgggguacacuaauuguugugucaagc

SEQ ID NO: 26086 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucugugguuuaacacagggggacacugcuaccuacuucugcgccaggcaaaaauuugaacggggaggccagggcugguauuucgaucugugggggcgcggaacacuaauuguugugucguca

SEQ ID NO: 26087 - RNA, 375 nt, Artificial Sequence
  derived and/or modified sequence opt3 from anti-HIV-1_HeavyChain
caggcccaccuggagcaaagcggcuccggggugagaaaggucggagcuucuguuagggugucaugcuggaccagugaagacaucuucgagcggacagaacucauucauuggguacgccaggcacccggucagggccuugaguggauagggugggugaaagccgucagcggagcggugaacuacggcucccuggauuuucgacaccguguuucuuugacuagagacagggauuuauucacggcucauauggacauccggggucugacccaggaugacacagccauuuauuuuugugcacgccaaaaguucgccagaggggaucagggaugguuuuucgaccuauggggcaggggcacucucaucguggucucguca

SEQ ID NO: 26088 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauauuacgcaggaggccagggcugguauuuugaucugugggggcgcggaacccuaauuguugugucuucg

SEQ ID NO: 26089 - RNA, 375 nt, Artificial Sequence
  derived and/or modified sequence opt3 from anti-HIV-1_HeavyChain
caggugcaacugguccagagcggcgccgagguuaagaaacccggggcuuccgugagaguaucuugcuggaccucagaagacaucuucgagaggacagaacucauucacugggugcggcaggcaccuggacagggucuugaguggauaggcugggucaagacugugacgggggccguuaacuuuggaaguccaaauuuccgccaucgagugagccugacccgugauagagacuuguuuacagcgcacauggauaucaggggcuuaacucaaggugacaccgcuacauacuucugugcccggcagaaauuugaacgcgggggacagggcugguauuucgaucuguggggcagagggacccuaauugucguguccucu

SEQ ID NO: 26090 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggccuguccgauuuccggcagcgcgugucuuugacgcgagaccgugguuuauuuaccgcgcacauggauaucagagggcugacacaaggagacacugcuaccuacuucugugccaggcagaaguuuuaugcaggcggccaggggugguacuucgaucuauggggacgggguacacucauuguugugucguca

SEQ ID NO: 26091 - RNA, 375 nt, Artificial Sequence
  derived and/or modified sequence opt3 from anti-HIV-1_HeavyChain
caggcccaccuggagcaaagcggcuccggggugaagaaacccggaaccucugucagaguuucaugcuggacaagugaagacaucuucgagaggacugaacucauucauugggugcggcaggcuccuggucagggccuugaguggauaggguggguaaagacggugaccggagcagucaacuuuggcagcccaaauuuccgccagcgagugucccugacacgugauagagacuuguuuacugcccacauggauaucagggguuuaacccaaggggacacagcgaccuacuucugugcucggcagaaauuugaacgcggaggccagggcuggauuuucgaucugugggggagaggaacucuaaucgccguuucuucg

SEQ ID NO: 26092 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgagcggggcggucaggggugguacuuugaccuauggggacgcggcacacucauugucgugaguucc

SEQ ID NO: 26093 - RNA, 375 nt, Artificial Sequence
  derived and/or modified sequence opt3 from anti-HIV-1_HeavyChain
caggugcaacugguccagagcggcgccgagguuaagaaacccggggcuuccgugagaguaucuugcuggaccucagaagacaucuucgagggaagugaacucauucacugggugaggcaggcaccuggucagggccuugaguggauagggugggucaagacagugacuggagccguuaacuuuggcagcgcguacuuccggcaucgcgugucccugacgcgagaucgugacuuguuuaccgcucacauggauaucagagguuuaacacaaggggacacugccaccuauuucugugcaaggcagaaauuuuacaagggaggccagggcugguauuucgaucugugggggcggggaacacuaauugucgugucuucg

SEQ ID NO: 26094 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucuucggacuuccggaaucgcauuucacugagccgagaucgugacuugaguaccgcgcauauggauaucagaggauuaacacaggacgauacugcuaccuauuuuugugccaggcaaaaauucgagcggggcggucagggguggauuuuugaccuguggggacgcggcacacuaaucgcagucuccucu

SEQ ID NO: 26095 - RNA, 375 nt, Artificial Sequence
  derived and/or modified sequence opt3 from anti-HIV-1_HeavyChain
caggugcaacugguccagagcggcaccgagguuaagaaacccggggccuccgugagaguaucuugcaaggcuucaggauacacauucgagaaaagugaacucauccacugggugaggcaggcaccuggucagggccuugaauggauugggugggucaagacugugacgggagccguuaacuuuggcagcuccgacuuccggcaacgcgugucucugacccgagaucgugacuuguuuacagcgcauauggauauaagagguuuaacucagggggacaccgcuacauauuucugugccaggcagaaauuuuacgcaggaggccagggcugguauuucgaucugugggggcggggaacccuaaucgucgugucguca

SEQ ID NO: 26096 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaauucgaaagaggugggcaaggauggaucuuugaucuguggggcaggggcacccuaauugccgucaguucc

SEQ ID NO: 26097 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaaggccguguccggagcggucaacuacggcucucuggauuuucgccaccgagugucguugacacgugacagagauuuaucaacugcucauauggacaucaggggucugacgcaggaugacaccgccacauauuucugugcacggcaaaaauuugcccgcggggaucagggaugguucuuugaccuauggggcagaggcacucucauuguugugagcagu

SEQ ID NO: 26098 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaagaugacacugcuauuuacuucugugccaggcagaaguuugcacgcggggaucagggaugguucuuugaccuguggggccggggcacccuaaucguugugucaagc

SEQ ID NO: 26099 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagccuggauuuccgccaccgaaucuccuugacccgugacagagauuuauuuacagcgcauauggacauuaggggucugacucagggggauaccgcuacauacuucugugcccggcaaaaauuuuaugcaggaggccagggcugguacuucgaccuaugggggcgcggaacccucaucgugguuucuucg

SEQ ID NO: 26100 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucgugcauuggguaaggcaggcaccuggucagggccuugaguggauugggugggugaaaacagucacuggagccgugaacuuuggcuccucugauuuccggcagcgcguuucgcugacgcgagaccgugauuuguuuaccgcgcacauggacauaagagguuuaacacaaggggauacugcuaccuacuucugugccaggcagaaguuugaacggggaggccagggcuggaucuucgaccugugggggcgcggaacacuaauugcagugucaagc

SEQ ID NO: 26101 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccagggggauacagccacuuauuuuugugcacggcaaaaauucgcccgcggagaccagggcugguuuuucgaucucuggggcagagggacccugauuguugugucguca

SEQ ID NO: 26102 - RNA, 375 nt, Artificial Sequence
  derived and/or modified sequence opt3 from anti-HIV-1_HeavyChain
caggcccacagagagcaaagcggcuccggggugaagaaacccggagcuucugucaggguuucaugcuggaccagugaagacaucuucgagcggacagaacugauucauugggugcgccaggcaccuggucagggccucgaguggauaggguggguaaagacugugacgggagccgucaacuuuggcagcuccgauuuccgacagcgugugucucuuaccagagacagggaucuguuuacagcgcacauggacauccgggguuugacucaaggggauaccgcuacauacuucugugcccgccagaaauuuuaugcaggaggccagggcugguacuucgacuuaugggggagaggaacccugauuguugugucguca

SEQ ID NO: 26103 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugccucgcaagugaagacaucuucaagaccgagcuuauucauugggugaggcaggccccuggucagggccuggaauggauaggguggguaaaaaucgugagcggagcggucaacuuuggcuccccaaauuuccggcagcgcgugucuuugacacgagaucgugacuuauuuacugcucacauggauauuagaggucugacgcaaggggacaccgccacauacuucugugcaaggcagaaguuugagcggggaggccagggcuggaucuucgaucuaugggggcgcggaacucucauugccguuucguca

SEQ ID NO: 26104 - RNA, 375 nt, Artificial Sequence
  derived and/or modified sequence opt3 from anti-HIV-1_HeavyChain
caggcccaccuggagcaaagcggcuccggggugaagaaagucggagcuucuguuagagugucaugcuggaccagugaagacaucuucgagaggacagaacucauucauuggguacggcaggcacccggucagggccuugaguggauagggugggugaaggccgucagcggagcggugaacuacggcucccuggauuuucgccaccgaguuucuuugacucgugacagagauuuauucacggcucauauggacaucaggggucugacccaggaugacacagccauuuauuuuugugcacggcaaaaauucgaacgcgggggacagggcuggaucuuugaucuauggggcagagggacucucauugccgugucguca

SEQ ID NO: 26105 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugcacggggagaccagggcugguucuuugaucuguggggccgcgggacacuaauuguugugucaagc

SEQ ID NO: 26106 - RNA, 375 nt, Artificial Sequence
  derived and/or modified sequence opt3 from anti-HIV-1_HeavyChain
caggcccaccuggagcaaagcgcuuccggcgugaagagacccggggcaucugucaggguuucaugcuggaccagugaagacaucuucgagcggagcgaacucauuuacugggugcgccaggccccuggacagggucuugaguggauaggcuggguaaaaacagugacuggggcggucaacuuuggauccucugauuuccgacagcgugugucgcugacgagagacagggauuuguuuaccgcucauauggacauccggggcuuaacacaaggugauacugccaccuauuucugugcacgccagaaguuuuacgccgggggacagggcugguauuucgaccuguggggcagagggacacuaauuguugugucaagc

SEQ ID NO: 26107 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaagacugugacgggagccgucaacuuuggcagcccuaauuuccgccaccgaguguccuugacccgugauagagacuuauuuacagcgcauauggauaucaggggucugacucagggggacaccgcuacauacuucugugcccggcaaaaauauuacgcaggaggccagggcugguauuuugaucuaugggggcgcggaacccucauuguugugucuucg

SEQ ID NO: 26108 - RNA, 375 nt, Artificial Sequence
  derived and/or modified sequence opt3 from anti-HIV-1_HeavyChain
caggugcaacugguccagagcggcuccgggguuaagaaacccggagccucugugagaguaucaugcuggaccagugaggacaucuucgaaaggacagagcucauucacugggugcggcaggcuccuggucagggccuugaauggauagggugggucaagaucgugagcggagcaguuaacuuuggcuccccaaauuuccgccaacgagugucucugacucgugauagagacuuguuuacggcccauauggauauuagggguuuaacccagggggacacagcgacuuacuucugugcucggcagaaauuugagcgcggaggccagggcuggaucuucgaucugugggggagaggaacccuaauugccgucucguca

SEQ ID NO: 26109 - RNA, 375 nt, Artificial Sequence
  derived and/or modified sequence opt3 from anti-HIV-1_HeavyChain
agacacaccugggagcagagcggcuccggggugaagaaacccggagccucugucaggguuucaugcuggacaagugaagacaucuucgagcggacugaacugauucauugggugcgccaagcuccuggucagggccucgaguggauaggguggguaaagaucgugagcggagcagucaacuuuggcuccccaaauuuccgacagcgugugucucuuacgagagauagggaccuguuuaccgcccacauggauauucgggguuugacacagggggacacugcgaccuacuucugugcucgccaaaaauuugaaagaggaggccagggcuggaucuucgauuuaugggggaggggaacacugauugccguuucguca

SEQ ID NO: 26110 - RNA, 372 nt, Artificial Sequence
  derived and/or modified sequence opt3 from anti-HIV-1_HeavyChain
agacacaccugggagcagagcggcuccggggugaagaaacccggagccucugucaggguuucaugcuggacaagugaagacaucuucgagcggacugaacugauucauugggugcgccaagcuccuggucagggccucgaguggauaggguggguaaagacggugaccggagcagucaaccuugccccaaauuuucgacaccgugugagccugacaagagauagggacuuguucacugcgcauauggauauccggggcuuaacccagggugacacagcuaccuacuuuugugcccgccagaaauucgaaagagggggacaaggcugguauuuugaucuguggggcagggggacucuaauuguuguguccucu

SEQ ID NO: 26111 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguagcgaacucauucauugggugaggcaggcaccuggccaggggcuugaguggauaggauggguaaagacagugacuggcgccgucaacuuugguuccucugauuuccggcagcgcgugucgcugacgcgagaccgugauuuguuuaccgcgcacauggacaucagaggguuaacacaaggagauacugcuaccuacuucugugccaggcagaaauuuuaugcaggcggccaggggugguacuucgaccuguggggacgggguacacuaauuguugugucaagc

SEQ ID NO: 26112 - RNA, 375 nt, Artificial Sequence
  derived and/or modified sequence opt3 from anti-HIV-1_HeavyChain
cagagccaccuggagcaauccggcucugcaaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucuucggacuuccggaaucgcauuucacugagccgagaucgugacuugaguaccgcgcauauggauaucagaggauuaacacagggcgacacugcuaccuauuuuugugccaggcaaaaauacuaugccggugggcagggaugguacuucgaucuguggggccggggcacacuaauugucguguccucu

SEQ ID NO: 26113 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaagaucgugagcggagccgucaacuuuggcuccccuaauuuccgccagcgagugucuuugacucgugauagagacuuauuuacggcgcacauggauauuaggggucugacccaaggggacacagcuacuuacuucugugcccggcagaaauuugaacgcggaggccagggcuggaucuucgaucuaugggggagaggaacccucauugcaguuucguca

SEQ ID NO: 26114 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuauaaaggaggccagggcugguacuucgaccugugggggcggggaacacuaauuguugugucaagc

SEQ ID NO: 26115 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugcacgcggagaucagggcugguucuuugaccuguggggcagagggacccuaauuguugugucuucg

SEQ ID NO: 26116 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucgcggccuggaguggauaggguggguaaaggccgugagcggagcggucaacuacggcuccuuggauuuucgacaccgugugucuuuaacuagagacagggaucuguucacggcucauauggacauccggggucuaacccagggggauacagccacuuauuuuugugcacgccagaaauucgaaagaggaggccaaggcugguacuuugaccucugggggaggggaacccugauuguugugucguca

SEQ ID NO: 26117 - RNA, 375 nt, Artificial Sequence
  derived and/or modified sequence opt3 from anti-HIV-1_HeavyChain
caggccagacccggcaccagcggguccggagugaagaaaccuggugcuucugucaggguuucaugcuggaguagcgaggacaucuucgaacggacagagcugauucacugggugcgccaagcaccaggccaggggcucgaauggauaggauggguaaagacugugacgggcgccgucaacuuugguucccuugauuuccgacagcgugugucucugaccagagacagggauuuguuuacagcgcauauggacauccggggguuaacucagggagauaccgcuacauacuucugugcccgccaaaaauuugagagaggcggccagggguggauuuucgaccuguggggaagggguacccuaaucgcaguuucguca

SEQ ID NO: 26118 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacugaaggggacaccgcuacauacuucugugcccggcagaaauuugagcgcggaggccaaggcuggauuuucgaucugugggggagaggaacccuaaucgcaguuucuucg

SEQ ID NO: 26119 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaaggccaucagcggagcggugaacuacggcucccuggauuuucgccaccgagucucuuugacucgugacagagauuuauucacggcucauauggacauuaggggucugacccaggaugacacagccacuuauuuuugugcacggcaaaaauucgcccgcggggaucagggaugguuuuucgaccuauggggcagaggcacccucaucgugguuucguca

SEQ ID NO: 26120 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuccggcucuccaaauuuucggcaccgcgugucgcugacgcgagaucgugacuuguucaccgcgcauauggauaucagagguuuaacacagggggacacugcuaccuacuuuugugccaggcaaaaguucgaacggggaggccagggcugguauuuugaucugugggggcgcggaacacuaauuguugugucaagc

SEQ ID NO: 26121 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagagggcagaacucauucauugggugcggcaggccccuggucagggccuugaguggauaggguggguaaagacagugagcggagcggucaacuuuggcucccugaauuuccgccaccgagugucuuugacucgugauagagacuuauuuacggcucauauggauaucaggggucugacccagggggacacagccacuuacuucugugcacggcaaaaauuugcccgcggagaucagggcugguucuuugaccuauggggcagagggacccucauuguugugucguca

SEQ ID NO: 26122 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugcccgcggggaucagggaugguucuuugaccucuggggcagaggcacccugguuacagugucaagc

SEQ ID NO: 26123 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagccugaauuuccgccaccgaguguccuugacccgugauagagacuuauuuacagcgcauauggauaucaggggucugacucagggggacaccgcuacauacuucugugcccggcaaaaauuugaacgcggaggccagggcugguauuucgaucuaugggggagaggaacccucauuguugugucuucg

SEQ ID NO: 26124 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuugucuacagcgcauauggauaucagggguuuaacucaggacgauaccgcuacauacuuuugugcccggcaaaaauucgcacgcggggaccagggaugguuuuucgaucuguggggcagaggcacccuaauuguugugucguca

SEQ ID NO: 26125 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagacgguaaccggggccgugaacuuuggauccccaaauuuccggcaucgcgucucucugacacgagaccgugauuuguuuacugcgcacauggacaucagaggcuuaacccagggugauacagcuaccuauuucugugccaggcaaaaauacuaugcagggggacagggcugguacuuugaccuguggggccgggggacucuaauugugguuucguca

SEQ ID NO: 26126 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugccagcggagcggugaacuuuggcuccccaaauuuccgccaccgagucucucugacgcgugauagagacuuguuuaccgcucauauggauaucagggguuuaacacagggggacacugccaccuacuucugugcacggcaaaaauuugaacgcggaggccagggcugguauuucgaucugugggggagaggaacacuaauugugguuucguca

SEQ ID NO: 26127 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccacuuauuuuugugcacggcaaaaauucgaacgcgggggacagggcugguacuuugaucucuggggcagagggacccugauuguugugucguca

SEQ ID NO: 26128 - RNA, 375 nt, Artificial Sequence
  derived and/or modified sequence opt3 from anti-HIV-1_HeavyChain
caggcccaccuggagcaaagcgcuuccggcgugaagagacccggggcaucugucaggguuucaugcuggaccagugaagacaucuucgagcggagcgaacucauuuacugggugcgccaggccccuggacagggucuugaguggauaggcuggguaaaaacaguguccggggcggucaacuuuggaucuacugauuuccgagaacgugugucgcugacgagagacagggauuuguuuaccgcucauauggacauccggggcuuaacacagggugauacugccaccuauuucugugcacgccaaaaguuugagagagggggacagggcugguacuucgaccuguggggcagggggacacuaauuguugugucaagc

SEQ ID NO: 26129 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagucgugaacuacggcuccuuggauuuucgccaccgaguuucuuuaacucgugacagagaucugucgacggcgcauauggacaucaggggucuaacccaggaugacacagcuacuuauuucugugcccggcaaaaauuugcacgcggggaucagggaugguucuuugaccucuggggcagaggcacccugauuguggucucaagc

SEQ ID NO: 26130 - RNA, 375 nt, Artificial Sequence
  derived and/or modified sequence opt3 from anti-HIV-1_HeavyChain
caggcccaccuggagcaaagcggcuccggggugaagaaagucggagcuucuguuagagugucaugcuggaccagugaagacaucuucgagaggacagaacucauucauuggguacggcaggcacccggucagggccuugaguggauagggugggugaagacugucagcggagccgugaacuuuggcuccccuaauuuccgccaccgaguuucucugacgcgugauagagacuuguuuaccgcgcauauggauaucagggguuuaacacagggggacacugcuaccuacuucugugcccggcaaaaauuugaacgcggaggccagggcugguauuucgaucugugggggagaggaacacuaauuguggucucguca

SEQ ID NO: 26131 - RNA, 375 nt, Artificial Sequence
  derived and/or modified sequence opt3 from anti-HIV-1_HeavyChain
caggccuaccuggagcaaagcggcuccaucaugaagaaacccggggcuucugugagagucucaugcuggaccagugaagacauuuucgauaggacagagcucauacacuggguucggcaggcaccuggacagggucuugaauggaucggcugggugaagacuguaacgggggccgugaacuuuggaagcuccgacuuccgccagcgagucucucugacccgugauagagacuuguuuacagcgcauauggauauuaggggcuuaacucaaggugacaccgcuacauauuucugugcccggcagaaauuuuacgcagggggacagggcugguauuucgaucuguggggccgcgggacccuaaucgugguuucguca

SEQ ID NO: 26132 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcuugcaccuggucagggccuggaguggauaggguggguaaaaacagugacuggagccgucaacuuuggcuccucugauuuccggcagcgcgugucguugacgcgagaccgugauuuauuuaccgcgcacauggacaucagaggucugacacagggggauacugcuaccuacuucugugccaggcaaaaguuuuaugcaggaggccagggcugguacuucgaccuaugggggcggggaacacucauuguugugucaagc

SEQ ID NO: 26133 - RNA, 375 nt, Artificial Sequence
  derived and/or modified sequence opt3 from anti-HIV-1_HeavyChain
gaggcccaccuggaacagagcggcuccggggugaagaaacccggagcuucugucagaguuucaugcuggaccagugaggacaucuucgaaaggacagagcucacucauugggugcggcaagcaccuggucagggccuugaauggauuggguggguaaagacggugaccggagccgucaacuuuggcagcccaaauuuccgccagcgagugucccugacacgugauagagacuuguuuacugcgcacauggauauaagggguuuaacccagggggacacagcuaccuacuucugugcccggcaaaaauuugagcgcggaggccagggcuggaucuucgaucugugggggagaggaacucuaauugcaguuucuucg

SEQ ID NO: 26134 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuacgagaggacagaacucauucauugggugcggcaggcaccuggucagggccuugaguggauaggguggguaaaggccgugagcggagcggucaacuauggcucccuggauuuccgccaccgagugucuuugacucgugacagagauuuauuuacggcucauauggacaucaggggucugacccaggaugacacagccauuuacuucugugcacggcaaaaauuugcccgcggggaucagggaugguucuuugaccuauggggcagaggcacucucaucguugugucguca

SEQ ID NO: 26135 - RNA, 375 nt, Artificial Sequence
  derived and/or modified sequence opt3 from anti-HIV-1_HeavyChain
caggugcaccuggagcaaagcggcuccggggucaagaaacccggagccucuguuagagugucaugcuggaccagugaagacaucuucgagaggacagaacucauucauuggguacggcaggcuccuggucagggccuugaguggauagggugggugaagacugucacgggagcagugaacuuuggcagcccaaauuuccgccaccgaguuucccugacccgugauagagacuuguuuacagcccauauggauaucagggguuuaacucagggggacaccgcgacauacuucugugcucggcaaaaauuugaacgcggaggccagggcugguauuucgaucugugggggagaggaacccuaauuguggucucuucg

SEQ ID NO: 26136 - RNA, 375 nt, Artificial Sequence
  derived and/or modified sequence opt3 from anti-HIV-1_HeavyChain
caggcccaccuggagcaaagcggcuccggggugaagaaagucggagcuucuguuagagugucaugcuggaccagugaagacaucuucgagaggacagaacucauucauuggguacggcaggcacccggucagggccuugaguggauagggugggugaaggccgucagcggagcggugaacuacggcucccuggauuuucgccaccgaguuucuuugacucgugacagagauuuaucgacggcucauauggacaucaggggucugacccaggaugacacagccacuuauuucugugcacggcaaaaauuugcccgcggggaucagggaugguucuuugaccuauggggcagaggcacccucauuguggucucaagc

SEQ ID NO: 26137 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcccaccgaauuuccgccaccgagugucccugacgcgugauagagacuuguuuaccgcgcauauggauaucagggguuuaacacagggggacacugcuaccuacuucugugcccggcaaaaauuugaacgcggaggccagggcugguauuucgaucugugggggagaggaacacuaauuguugugucuucg

SEQ ID NO: 26138 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugaacgcgggggacagggcuggauuuucgaucucuggggcagagggacccugaucgccguuucaagc

SEQ ID NO: 26139 - RNA, 375 nt, Artificial Sequence
  derived and/or modified sequence opt3 from anti-HIV-1_HeavyChain
caggcccaccuggagcaaagcggcuccggggugagaaagcccggagcuucugucaggguuucaugcuggaccagugaagacaucuucgagcggacagaacucauucauugggugcgccaggcaccuggucagggccuugaguggauaggguggguaaaaacugugacgggagccgucaacuuuggcagcuccgauuuccgacagcgugugucucugaccagagacagggauuuguuuacagcgcacauggacauccgggguuuaacucaaggggauaccgcuacauacuucugugcccgccagaaguuuuaugcaggaggccagggcugguacuucgaccugugggggagaggaacccuaauuguugugucguca

SEQ ID NO: 26140 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucgcggccuggaguggauaggguggguaaaggccgugagcggagcggucaacuacggcuccccuaauuuucgacaccgugugucuuugacuagagauagggacuuauucacggcucauauggauauccggggucugacccagggggacacagccacuuauuuuugugcacgccagaaauucgaaagaggaggccaaggcugguacuuugaucuaugggggaggggaacccucauuguugugucguca

SEQ ID NO: 26141 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugaacgcggaggccagggcugguauuucgaucugugggggagaggagcacuaauuguugugucguca

SEQ ID NO: 26142 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccgcguacuuccggcaccgcgugucucugacgcgagaucgugacuuguuuaccgcucauauggauaucagagguuuaacacagggggacacugccaccuauuucugugcaaggcaaaaguuuuacaaaggaggccagggcugguauuucgaucugugggggcggggaacacuaauuguugugucguca

SEQ ID NO: 26143 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucucuggauuuccgacaucgugucucguugaccagagacagggauuuaucaacagcccacauggacauccggggccugacucaggaugacaccgcgacauauuuuugugcucgccagaaauucgccagaggugaucaagggugguuuuucgaccuauggggaaggggcacccucauugugguuagcagu

SEQ ID NO: 26144 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucuucggacuuccggaaucgcauuucacugagccgagaucgugacuugaguaccgcgcauauggauaucagaggauuaacacaggacgauacugcuaccuauuuuugugccaggcaaaaauucuacgcaggcggucaggggugguauuuugaccuguggggacggggcacacuaauugucguguccucu

SEQ ID NO: 26145 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugacuggagcggucaacuuuggcagcuccgauuuccgccagcgagugucuuugacgcgugacagagauuuauuuaccgcucacauggacaucaggggucugacacaaggggauacugccaccuacuucugugcacggcagaaauuuuaugccggaggccagggcugguacuucgaccuaugggggcgcggaacacucauuguugugucguca

SEQ ID NO: 26146 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccggggccgugaacuuuggaucuucggauuuccgacagcgugucucacugacgagagacagggauuuguuuaccgcgcauauggacauccggggcuuaacacagggugauacugcuaccuauuucugugcccgccaaaaauuuuacgcagggggacagggcugguauuucgaccuguggggcagagggacacuaauugugguuagcagu

SEQ ID NO: 26147 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacgcugccaccuacuucugugcacggcaaaaauuugaacgcggaggccagggcugguauuucgaucugugggggagaggaacacuaauuguugugucuucg

SEQ ID NO: 26148 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucgcggccuggaguggauaggguggguaaaggccgugagcggagcggucaacuacggcuccuuggauuuucgacaccgugugucuuuaacuagagacagggaucuguucacggcucauauggacauccggggucuaacccaggaugacacagccacuuauuuuugugcacgccagaaauucuacgccgggggacaaggcugguauuuugaucucuggggcagagggacccugauuguugugucguca

SEQ ID NO: 26149 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuugcggcucacauggauauuagggguuuaacgcaaggggacaccgccacauacuucugugcacggcagaaauuugaacgcggaggccagggcuggaucuucgaucugugggggagaggaacucuaauugccguuucguca

SEQ ID NO: 26150 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuagcucagggggacacugccaccuacuucugugcacggcaaaaauuugaacgcggaggccagggcugguauuucgaucugugggggagaggaacacuaauuguugugucuucg

SEQ ID NO: 26151 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucuucggacuuccggaaucgcauuucacugagccgagaucgugacuugaguaccgcgcauauggauaucagaggauuaacacaggacgauacugcuaccuauuuuugugccaggcaaaaauucgagcggggcggucaggggugguacuuugaccuguggggacgcggcacacuaauugucguguccucu

SEQ ID NO: 26152 - RNA, 375 nt, Artificial Sequence
  derived and/or modified sequence opt3 from anti-HIV-1_HeavyChain
cagagccaccuggagcaauccggcucugcaaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcgucucguugacccgagaucgugacuuauuuacagcgcauauggauauuagaggacugacucagggcgacaccgcuacauauuucugugccaggcaaaaauuuuacgccggugggcagggaugguauuucgaucuauggggccggggcacccucaucgugguuucaagc

SEQ ID NO: 26153 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccaccgagugucucugacucgugauagagacuuguuuacggcgcauauggauauuagggguuuaacccagggggacacagcuacuuacuucugugcccggcaaaaauuugaacgcggaggccagggcugguauuucgaucugugggggagaggaacccuaaucguugugucguca

SEQ ID NO: 26154 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcgggcaccuggucagggccuugaguggauaggguggguaaaaacagugacuggagccgucaacuuuggcuccucugauuuccgccagcgagugucgcugacgcgugacagagauuuguuuaccgcgcacauggacaucagggguuuaacacagggggauacugcuaccuacuucugugcccggcaaaaguuuuaugcaggaggccagggcugguacuucgaccugugggggcgcggaacacuaauuguugugucaagc

SEQ ID NO: 26155 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccagcgagugucuuuaacucgugacagagaucuguucacggcucacauggacaucaggggucuaacccaaggggauacagccacuuauuuuugugcacggcagaaauucgaacgcggaggccagggcuggauuuuugaccucugggggagaggaacccugaucgccguuucguca

SEQ ID NO: 26156 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuuuauaagggaggccagggcugguacuucgaccuaugggggcgcggaacacucaucgugguuucguca

SEQ ID NO: 26157 - RNA, 375 nt, Artificial Sequence
  derived and/or modified sequence opt3 from anti-HIV-1_HeavyChain
caggcccaccuggagcaaagcggcuccggggugaagaaacccggaaccucugucagaguuucaugcuggacaagugaagacaucuucgaaaagagcgagcucauucauugggugaggcaggcuccuggucagggccuugaguggauaggguggguaaaaacugugacgggagcagucaacuuuggcuccucugauuuccggcagcgcgugucgcugacccgagaccgugauuuguuuacagcccacauggacaucagagguuuaacucaaggggauaccgcgacauacuucugugcuaggcagaaguuuuaugccggaggccagggcugguacuucgaccugugggggcggggaacccuaauuguugugucaagc

SEQ ID NO: 26158 - RNA, 375 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucuacgcaggcggucaggggugguauuuugaccuauggggacggggcacacucauugucgugaguucc

SEQ ID NO: 26159 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacaggucuuauucauugggugcggcaggcacccggccaggggcuggaauggauaggauggguaaaggccgugagcggcgcggucaacuacgguuccuuggauuuucgccaccgagugucuuuaacucgugacagagaucuguucacggcucauauggacaucagggggcuaacccaggaugacacagccacuuauuuuugugcacggcaaaaauucgcccgcggagaucagggcugguuuuucgaccucuggggcagagggacccugauuguugugucguca

SEQ ID NO: 26160 - RNA, 375 nt, Artificial Sequence
  derived and/or modified sequence opt3 from anti-HIV-1_HeavyChain
caggcccaccuggagcaaagcggcuccggggugaagaaacccggaaccucugucagaguuucaugcuggacaagugaagacguguucgagaggacugaacucauccauuggguacggcaggcuccuggucagggccuugaguggauugggugggugaagacggucauaggagcagugaacuuuggcagcccaaauuuccgccaccgaguuucccugacccgugauagagacuuguuuacagcccauauggauaucagggguuuaacucagggggacaccgcgacauacuucugugcucggcaaaaauuugaacgcggaggccagggcugguauuucgaucugugggggagaggaacccuaauuguggucucuucg

SEQ ID NO: 26161 - RNA, 372 nt, Artificial Sequence
  derived and/or modified sequence opt3 from anti-HIV-1_HeavyChain
caggcccaccuggagcaaagcggcgcuggggugaagaaacccggagcauccgucagaguuucuugcuggaccucagaagacaucuucaagacagagcucauucauugggugaggcaggccccuggucagggccuugaauggauaggguggguaaaaaucgugaguggagcggucaacuuuggcagcccaaauuuccggcagcgcgugucccugacucgagaucgugacuuguuuacggcucacauggauauuagagguuuaacccaaggggacacagccacuuacuucugugcaaggcagaaguuugagcggggaggccagggcuggaucuucgaucugugggggcgcggaacccuaauugccguuucuucg

SEQ ID NO: 26162 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccagauuuccgccaccgagugucucugacgcgugacagagauuuguuuaccgcgcauauggacaucagggguuuaacacagggggauacugcuaccuacuucugugcccggcaaaaauuugcacgcggagaccagggcugguucuuugaucuguggggcagagggacacuaauuguugugucguca

SEQ ID NO: 26163 - RNA, 375 nt, Artificial Sequence
  derived and/or modified sequence opt3 from anti-HIV-1_HeavyChain
caggcccaccuggagcaaagcggcuccggggugaagagacccggagcuucugucaggguuucaugcuggaccagugaagacaucuucgagacaacugaacucauucauugggugcggcaggcaccuggucagggccuugaguggauaggguggguaaaaacggugagcggagccgucaacuuuggcucccugaauuuccgccaccgaaucucuuugacccgugauagagacuuauuuacagcgcauauggauauuaggggucugacucagggggacaccgcuacauacuucugugcccggcaaaaguuugcacgcggagaucagggcugguucuuugaccuauggggcagagggacccucaucgugguuucguca

SEQ ID NO: 26164 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccauuuauuucugugcacggcaaaaauuugcccgcggggaucagggaugguucuuugaccucuggggcagaggcacucugaucguugugucaagc

SEQ ID NO: 26165 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggacuggguggguaaaggccgugagcggagcggucaacuacggcuccuuggauuuucgccaccgagugucuuuaacgcgugacagagaucugucgaccgcucauauggacauaaggggucuaacacaggaugacacugccaccuauuucugugcacggcaaaaauuugcccgcggggaucagggaugguucuuugaccucuggggcagaggcacacugaucguugugucaagc

SEQ ID NO: 26166 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucagggguccuacccaggaugacacagccacuuauuuuugugcacggcaaaaauucgcccgcggggaucagggaugguuuuucgaccuauggggcagaggcacccucauuguugugucguca

SEQ ID NO: 26167 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccagggggauacagccacuuauuucugugcacggcaaaaauuugaacgcggaggccagggcugguacuucgaccucugggggagaggaacccugauuguugugucaagc

SEQ ID NO: 26168 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugaacgcggaggccagggcugguauuucgaucugugggggagaggaacacuaauuguugugucguca

SEQ ID NO: 26169 - RNA, 375 nt, Artificial Sequence
  derived and/or modified sequence opt3 from anti-HIV-1_HeavyChain
agacacaccuggaacgagagcggcuccggggugaagaaacccggagccucugucaggguuucaugcuggacaagugaagacaucuucgagcggacugaacugauucauugggugcgccaggcuccuggucaaggccucgaguggauaggguggguaaagacggugaccggaacagucaauuuuggcagccuuaacuuccgacagcgugugucccugacuagagauagggacuuguuuaccgcacacauggauauccgggguuuaacacagggggacaccgccacuuacuucugugcgcgccagaaauuuuaugcuggaggccaaggcugguacuucgaucugugggggagaggaacacuaauuguugugucuucg

SEQ ID NO: 26170 - RNA, 375 nt, Artificial Sequence
  derived and/or modified sequence opt3 from anti-HIV-1_HeavyChain
caggcccaccuggagcaaagcggcgcuggggugaagagacccggagcauccgucaggguuucuugcuggaccucagaagacaucuucgagacaacugaacucauucauugggugcggcaggccccuggucagggccuugaguggauaggguggguaaaaacggugaguggagcggucaacuuuggcagcccaaauuuccgccaccgagugucccugacccgugauagagacuuguuuacagcucauauggauaucagggguuuaacucagggggacaccgccacauacuucugugcacggcaaaaguuugaacgcggaggccagggcugguauuucgaucugugggggagaggaacccuaauuguugugucuucg

SEQ ID NO: 26171 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaaggccgugagcggagcggucaacuuuggcuccccaaauuuccgccaccgagugucucugacucgugauagagacuuguuuacggcucauauggauaucagggguuuaacccagggggacacagccacuuacuucugugcacggcaaaaauuugaacgcggaggccagggcugguauuucgaucugugggggagaggaacccuaauuguugugucguca

SEQ ID NO: 26172 - RNA, 375 nt, Artificial Sequence
  derived and/or modified sequence opt3 from anti-HIV-1_HeavyChain
caggcccaccugggcaccauccucgggcuugagagcaagaaacccggagcuuccgugagagucucuugcuggacaucagaagacauuuucgagaggacugaacugauacauuggguucggcaagcaccuggucagggcuuggaguggaucgggugggugaagacgguaaccggagccaguauuuuagcgccaaacuuucgccaccgagugagccugacacgugauagagaccuauucacugcucauauggauaucaggggccucacccagggugacacagccaccuacuuuugugcacggcagaaauucgaacgcgggggacaaggcugguauuuugaucuguggggcagagggacucuuauugucguguccucu

SEQ ID NO: 26173 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagcguuguuuacagcucauauggacaucagggguuuaacucagggggauaccgccacauacuucugugcacggcaaaaauuugcccgcggagaccagggcugguucuuugaucuguggggcagagggacccuaauuguugugucuucg

SEQ ID NO: 26174 - RNA, 375 nt, Artificial Sequence
  derived and/or modified sequence opt3 from anti-HIV-1_HeavyChain
agagugcaccuggagcagagcggcuccggggucaagaaacccggagccucuguuagggugucaugcuggaccagugaagacaucuucgagcggacagaacucauucauuggguacgccaagcuccuggucagggccuugaguggauagggugggugaagacugucacgggagcagugaacuuuggcagcccaaauuuccgacaccguguuucccugaccagagauagggacuuguuuacagcccauauggauauccgggguuuaacucagggggacaccgcgacauacuucugugcucgccagaaauuugaaagaggaggccaaggcugguauuucgaucugugggggaggggaacccuaauuguggucucuucg

SEQ ID NO: 26175 - RNA, 375 nt, Artificial Sequence
  derived and/or modified sequence opt3 from anti-HIV-1_HeavyChain
caggcccaccuggagcaaagcggcgcuggggugaagaaacccggagcauccgucagaguuucuugcuggaccucagaagacaucuucgagaggacagaacucauucauugggugcggcaggccccuggucagggccuugaguggauaggguggguaaagacugugacgggagcggucaacuuuggcaguccaaauuuccgccagcgagugagccugacccgugauagagacuuguccacagcucacauggauaucagggguuuaacucaagacgauaccgccacauacuuuugugcacggcagaaauucgcccgcggggaccagggaugguuuuucgaucuguggggcagaggcacccuaauuguugugucuucg

SEQ ID NO: 26176 - RNA, 375 nt, Artificial Sequence
  derived and/or modified sequence opt3 from anti-HIV-1_HeavyChain
caggugcaacugguccagagcggcgccgagguuaagagacccggggcuuccgugaaaguaucuugcuggaccucagaagacaucuucgagaggacagaacucauucacugggugcggcaggcaccuggacagggucuugaguggauaggcugggucaagacugugaguggggccguuaacuuuggaagcccaaauuuccgccaucgagugucccugacgcgugauagagacuuguuuaccgcgcacauggauaucaggggcuuaacacaaggugacacugcuaccuacuucugugcccggcagaaauuugaacgcgggggacagggcugguauuucgaucuguggggcagagggacacuaauugucgugucuucg

SEQ ID NO: 26177 - RNA, 375 nt, Artificial Sequence
  derived and/or modified sequence opt3 from anti-HIV-1_HeavyChain
agacacgaccuggagcagagcggcuccggggugaagaaacccggagccucugucaggguuucaugcuggaccagugaagauaucuucgagcggacagaacucauucauugggugcgccaagcuccuggucagggccuugaguggauaggguggguaaagaucgugagcggagcagucaacuuuggcuccccaaauuuccgacagcgugugucucugacuagagacagggauuuguuuacggcccacauggacauucgggguuuaacccagggggauacagcgacuuacuucugugcucgccaaaaauuugaaagaggaggccagggcuggaucuucgaccugugggggaggggaacccuaauugccguuucguca

SEQ ID NO: 26178 - RNA, 375 nt, Artificial Sequence
  derived and/or modified sequence opt3 from anti-HIV-1_HeavyChain
agacacaccugggaacagguguggagcggcgucaagaaacccggggccuccguuagggugucuugcuggacaucagaggacaucuucgagaagagugaacugauucauuggguacggcaagcuccuggacagggucucgaguggauaggcugggugaaaacugucacgggggcagugaacuuuggaagcuccgauuuccgccagcgaguuucucuuacccgugacagagaucuguuuacagcccacauggacaucaggggcuugacucagggugauaccgcgacauacuucugugcucggcaaaaguuuuaugccgggggacagggcugguacuucgacuuauggggccgcgggacccugauuguggucucguca

SEQ ID NO: 26179 - RNA, 375 nt, Artificial Sequence
  derived and/or modified sequence opt3 from anti-HIV-1_HeavyChain
agacacaccuggaacaagagcggcuccggggugaaaaagcccggagccucugucaggguuucaugcuggacaagugaggacaucuucgaacggacugagcugauucauugggugcgccaggcuccuggucaaggccucgaauggauaggguggguaaaagcagugagcggagccgucaauuacggcucccuugauuuucgacaccgugugucucugacgagagacagggauuugucgaccgcgcauauggacauccgggguuuaacacaggaugacacugcuaccuauuucugugcccgccagaaguuugcaagaggggaucagggaugguucuuugaccuguggggcaggggcacacuaauuguugugucaagc

SEQ ID NO: 26180 - RNA, 375 nt, Artificial Sequence
  derived and/or modified sequence opt3 from anti-HIV-1_HeavyChain
agacacaccugggagcagagcggcuccggggugaagaaacccggagccucugucaggguuucaugcuggacaagugaagacaucuucgaaaagagcgagcugauucauugggugcggcaagcuccuggucagggccucgaguggauaggguggguaaaaacugugacgggagcagucaacuuuggcuccucugauuuccgccagcgagugucgcuuacccgugacagagaucuguuuacagcccacauggacaucagggguuugacucagggggauaccgcgacauacuucugugcucggcaaaaguuugaacgcggaggccagggcuggauuuucgacuuaugggggagaggaacccugaucgccguuucaagc

SEQ ID NO: 26181 - RNA, 375 nt, Artificial Sequence
  derived and/or modified sequence opt3 from anti-HIV-1_HeavyChain
caggcccaccuggagcaaagcggcuccggggugaagagacccggagcuucugucaggguuucaugcuggaccagugaagacaucuucgagacaacugaacucauucauugggugcggcaggcaccuggucagggccuugaguggauaggguggguaaaagccgugagcggagcggucaacuacggcucccuggauuuucgccaccgagugucuuugacgcgugacagagauuuaucgaccgcucauauggacaucaggggucugacacaggaugacacugccaccuauuucugugcacggcaaaaguuugcccgcggggaucagggaugguucuuugaccuauggggcagaggcacacucauuguugugucaagc

SEQ ID NO: 26182 - RNA, 375 nt, Artificial Sequence
  derived and/or modified sequence opt3 from anti-HIV-1_HeavyChain
agacacgaccuggagcagagcggcuccggggugaagaaacccggagccucugucaggguuucaugcuggaccagugaagauaucuucgagcggacagaacucauucauugggugcgccaagcuccuggucagggccuugaguggauaggguggguaaagacugugacgggagcagucaacuuuggcagcccaaauuuccgacaccgugugucccugaccagagacagggauuuguuuacagcccauauggacauccgggguuuaacucagggggauaccgcgacauacuucugugcucgccagaaauuugaaagaggaggccaaggcugguauuucgaccugugggggaggggaacccuaauuguugugucuucg

SEQ ID NO: 26183 - RNA, 375 nt, Artificial Sequence
  derived and/or modified sequence opt3 from anti-HIV-1_HeavyChain
agacacaccugggagcagagcggcuccggggugaagaaacugggagccucugucaggguuucaugcuggacaagugaagacaucuucgagcggacugaacucauucauugggugcgccaagcucccggucagggccuugaguggauaggguggguaaaggcagugagcggagccgucaacuacggcucccuggauuuucgacaccgugugucuuugacgagagacagggauuuaucgaccgcgcauauggacauccggggucugacacaggaugacacugcuaccuauuucugugcccgccagaaauuugcaagaggggaucaaggaugguucuuugaccuauggggcaggggcacacucauuguugugucaagc

SEQ ID NO: 26184 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugccucgcaagugaagacaucuucgaaaagagcgagcuuauucauugggugaggcaggccccuggucagggccuggaguggauaggguggguaaaaaccgugacaggagcggucaacuuuggcuccucugauuuccggcagcgcgugucguugacucgagaccgugauuuauuuacggcucacauggacaucagaggucugacccaaggggauacagccacuuacuucugugcaaggcagaaguuuuaugccggaggccagggcugguacuucgaccuaugggggcggggaacccucauuguugugucaagc

SEQ ID NO: 26185 - RNA, 375 nt, Artificial Sequence
  derived and/or modified sequence opt3 from anti-HIV-1_HeavyChain
caggcccaccuggagcaaagcggcgcuggggugaagaaacccggagcauccgucagaguuucuugcuggaccucagaagacaucuucgagaagagugaacucauucauugggugaggcaggccccuggucagggccuugaguggauaggguggguaaaaacagugacuggagcggucaacuuuggcagcuccgauuuccggcagcgcgugucucugacgcgagaccgugauuuguuuaccgcucacauggacaucagagguuuaacacaaggggauacugccaccuacuucugugcaaggcagaaguuuuaugccggaggccagggcugguacuucgaccugugggggcggggaacacuaauuguugugucguca

SEQ ID NO: 26186 - RNA, 375 nt, Artificial Sequence
  derived and/or modified sequence opt3 from anti-HIV-1_HeavyChain
agacacaccugggagcagagcggcuccggggugaagaaacccggagccucugucaggguuucaugcuggacaagugaagacaucuucgaaaagagcgagcugauucauugggugcggcaagcuccuggucagggccucgaguggauaggguggguaaaaacugugacgggagcagucaacuuuggcuccucugauuuccgccagcgagugucgcuuacccgugacagagaucuguuuacagcccacauggacaucagggguuugacucagggggauaccgcgacauacuucugugcucggcaaaaguuuuaugccggaggccagggcugguacuucgacuuaugggggcgcggaacccugauuguugugucaagc

SEQ ID NO: 26187 - RNA, 375 nt, Artificial Sequence
  derived and/or modified sequence opt3 from anti-HIV-1_HeavyChain
agacacaccugggagcagagcggcuccggggugaagaaacccggagccucugucaggguuucaugcuggacaagugaagacaucuucgagcggacugaacugauucauugggugcgccaagcuccuggucagggccucgaguggauaggguggguaaagacggugaccggagcagucaacuuuggcagcccaaauuuccgacaccgugugucccuuacaagagauagggaccuguuuacugcccauauggauauccgggguuugacccacggggacacagcgaccuacuucugugcucgccagaaauuugaaagaggaggccagggcugguauuucgauuuaugggggaggggaacucugauuguugugucuucg

SEQ ID NO: 26188 - RNA, 375 nt, Artificial Sequence
  derived and/or modified sequence opt3 from anti-HIV-1_HeavyChain
agacacaccugggagcagagcggcuccggggugaagaaacugggagccucugucaggguuucaugcuggacaagugaagacaucuucgagcggacugaacucauucauugggugcgccaagcucccggucagggccuugaguggauaggguggguaaaggcagugagcggagccgucaacuacggcucccuggauuuucgacaccgugugucuuugacgagagacagggauuuauucaccgcgcauauggacauccggggucugacacagggggauacugcuaccuauuuuugugcccgccagaaauucuacgcaggaggccaaggcugguauuuugaccuaugggggagaggaacacucauuguugugucguca

SEQ ID NO: 26189 - RNA, 375 nt, Artificial Sequence
  derived and/or modified sequence opt3 from anti-HIV-1_HeavyChain
caggcccaccuggagcaaagcggcgcuggggugaagaaacucggagcauccgucagaguuucuugcuggaccucagaagacaucuucgagaggacagaacuuauucauugggugcggcaggcccccggucagggccuggaguggauaggguggguaaaggcggugaguggagcugucaacuacggcagcuuggauuuucgccaccgaguguccuuaacucgugacagagaucuguucacggcccauauggacaucaggggucuaacccaggaugacacagcaacuuauuuuugugcccggcaaaaauucgcucgcggggaucagggaugguuuuucgaccucuggggcagaggcacccugauuguugugucuucg

SEQ ID NO: 26190 - RNA, 375 nt, Artificial Sequence
  derived and/or modified sequence opt3 from anti-HIV-1_HeavyChain
caggcccaccuggagcaaagcggcuccggggugaagaaacccggagcuucugucgaaguuucaugcuggaccagugaggacaucuucgaaagaacagagcucauucauugggugaggcaggcaccuggucagggccuugaauggauaggguggguaaagacugugagcggagccgucaacuuuggcuccccaaauuuccggcaccgcgugucucugacgcgagaucgugacuuguuuaccgcgcauauggauaucagagguuuaacacagggggacacugcuaccuacuucugugccaggcaaaaauuugcacggggagaucagggcugguucuuugaccuguggggccgcgggacacuaauuguugugucguca

SEQ ID NO: 26191 - RNA, 372 nt, Artificial Sequence
  derived and/or modified sequence opt3 from anti-HIV-1_HeavyChain
caggcccaccuggagcaaagcggcgcuggggugaagaaacucggagcauccgucagaguuucuugcuggaccucagaagacaucuucaagacagagcuuauucauugggugaggcaggcccccggucagggccuggaauggauaggguggguaaaagcggugaguggagcugucaacuacggcagcuuggauuuucggcaccgcguguccuuaacucgagaccgugaucugucuacggcccauauggacaucagaggucuaacccaggaugacacagcaacuuauuucugugccaggcaaaaguuugcucgcggggaucagggaugguucuuugaccucuggggccggggcacccugauuguugugucguca

SEQ ID NO: 26192 - RNA, 375 nt, Artificial Sequence
  derived and/or modified sequence opt3 from anti-HIV-1_HeavyChain
agacacaccugggagcagagcggcuccggggugaagaaacccggagccucugucaggguuucaugcuggacaagugaagacaucuucgagcggacugaacugauucauugggugcgccaagcuccuggucagggccucgaguggauaggguggguaaagacggugaccggagcagucaacuuuggcagcccaaauuuccgacaccgugugucccuuacaagagauagggaccuguuuacugcccauauggauauccgggguuugacccagggggacacagcgaccuacuucugugcucgccagaaauuuuaugccggaggccaaggcugguacuucgauuuaugggggagaggaacucugauuguugugucuucg

SEQ ID NO: 26193 - RNA, 375 nt, Artificial Sequence
  derived and/or modified sequence opt3 from anti-HIV-1_HeavyChain
agacacaccugggagaggaucuggagcggcgugaagaaacccggggccuccguccggguuucuugcuggacaucagaagacauuuucgagcgcacugaacugauacauugggugcgacaggcuccuggacaaggucucgaguggaucggcuggguaaagauugugaguggggcagucaacuuuggaagcccaaauuuccgucagagagugucccuuacgagggaucgggaccuguuuaccgcccacauggauauccgcggcuugacacagggugacacugcgaccuacuucugugcuagacagaaauuugaaaggggagggcaaggcuggauuuucgauuuauggggccgggggacacugaucgccguuucuucg

SEQ ID NO: 26194 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggcggcuaacccaggaugacacagccacuuauuucugugcacgccaaaaauuugccagaggugaucaggggugguucuuugaccucuggggaaggggcacccugauuguugugucaagc

SEQ ID NO: 26195 - RNA, 375 nt, Artificial Sequence
  derived and/or modified sequence opt3 from anti-HIV-1_HeavyChain
agacacaccguggagcagagcggcuccggggucaagaaacccggagccucuguuagggugucaugcuggacaagugaagacaucuucgagcggacugaacugauucauuggguacgccaagcuccuggucagggccucgaguggauagggugggugaagacggucaccggagcagugaacuuuggcagcccaaauuuccgacaccguguuucccuuacaagagauagggaccuguuuacugcccauauggauauccgggguuugacccagggggacacagcgaccuacuucugugcucgccagaaauuugaaagaggaggccaaggcugguauuucgauuuaugggggaggggaacucugauuguggucucuucg

SEQ ID NO: 26196 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgccagaccgagauuuguuuaccgcgcacauggacauccgugguuuaacacaaggggauacugcuaccuacuucugugccagacagaaguuuuaugcaggaggccagggcugguacuucgaccugugggggaggggaacacuaauuguugugucaagc

SEQ ID NO: 26197 - RNA, 375 nt, Artificial Sequence
  derived and/or modified sequence opt3 from anti-HIV-1_HeavyChain
agacacaccguggagcagagcggcuccggggucaagaaaguuggagccucugugaggguaucaugcuggacaagugaagacaucuucgagcggacugaacugauucauugggugcgccaagcucccggucagggccucgaguggauagggugggucaaggcagugagcggagccguuaacuacggcucccuugauuuucgacaccgugugucucugacgagagacagggauuuguucaccgcgcauauggacauccgggguuuaacacaggaugacacugcuauuuauuuuugugcccgccagaaauucgcaagaggggaucaaggaugguuuuucgaccuguggggcaggggcacccuaaucgucgugucguca

SEQ ID NO: 26198 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcugggcaagugaagacaucuucgagaggaccgaacucauucauugggugcggcaggccccuggucagggccuugaguggauaggguggguaaagacagugagcggagcggucaacuuuggcuccccaaauuuccgccaccgagugucucugacucgugauagagacuuguuuacggcucauauggauaucagggguuuaacccagggggacacagccacuuacuucugugcacggcaaaaauuugaacgcggaggccagggcugguauuucgaucugugggggagaggaacccuaauuguugugucguca

SEQ ID NO: 26199 - RNA, 375 nt, Artificial Sequence
  derived and/or modified sequence opt3 from anti-HIV-1_HeavyChain
agacacaccugggaacagguguggagcggcgucaagaaacccggggccuccguuagggugucuugcuggacaucagaggacaucuucgagcggacugaacugauucauuggguacgccaagcuccuggacagggucucgaguggauaggcugggugaagacggucaccggggcagugaacuuuggaaguccaaauuuccgacaccguguuagccuuacaagagauagggaccuguuuacugcccauauggauauccggggcuugacccagggugacacagcgaccuacuucugugcucgccagaaauuugaaagagggggacaaggcugguauuucgauuuauggggcagggggacucugauuguggucuccucu

SEQ ID NO: 26200 - RNA, 375 nt, Artificial Sequence
  derived and/or modified sequence opt3 from anti-HIV-1_HeavyChain
agacacaccuggaggcagagcggcuccggggugaagaaacugggagccucuguccggguuucaugcuggacaagugaggacaucuucgaacgcacugagcucauucauugggugcgacaagcucccggucagggccuugaauggauaggguggguaaaggcagugagcggagucgugaacuacggcucccuggauuuucgucacagaguuucuuugacgagggaccgggauuuaucgaccgcccauauggacauccgcggucugacacaggaugacacugcgaccuauuucugugcuagacagaaauuugccaggggagaucaagggugguucuuugaccuauggggccggggcacacucauuguggucucaagc

SEQ ID NO: 26201 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccaguggugacaucuucgaaaggacagagcucauucauugggugcggcaggcaccuggccaggggcuugaauggauaggauggguaaagaucgugagcggcgccgucaacuuugguuccccaaauuuccgccagcgagugucucugacucgugauagagacuuguuuacggcgcacauggauauuaggggguuaacccaaggagacacagcuacuuacuucugugcccggcagaaauuugagcgcggcggccagggguggaucuucgaucuguggggaagagguacccuaauugcaguuucguca

SEQ ID NO: 26202 - RNA, 375 nt, Artificial Sequence
  derived and/or modified sequence opt3 from anti-HIV-1_HeavyChain
agacacaccguggagcagagcggcuccggggucaagaaacccggagccucuguuagggugucaugcuggacaagugaagacaucuucgaaaagagcgagcugauucauuggguacggcaagcuccuggucagggccucgaguggauagggugggugaaaacugucacgggagcagugaacuuuggcuccucugauuuccgccagcgaguuucgcuuacccgugacagagaucuguuuacagcccacauggacaucagggguuugacucagggggauaccgcgacauacuucugugcucggcaaaaguuuuaugccggaggccagggcugguacuucgacuuaugggggcgcggaacccugauuguggucucaagc

SEQ ID NO: 26203 - RNA, 375 nt, Artificial Sequence
  derived and/or modified sequence opt3 from anti-HIV-1_HeavyChain
caggcccaccuggagcaaagcggcuccggggugaagaaaagaugggcuucugucaggguuucaugcuggaccagugaagacaucuucgagcggacagaacucauucauugggugcgccaggcacccggacagggucuugaguggauaggcuggguaaaggccgugagcggggcggucaacuacggaucccuggauuuucgacaccgugugucuuugacuagagacagggauuuauucacggcucauauggacauccggggccugacccaggaugacacagccacuuauuuuugugcacgccaaaaauucgccagaggugaucaggggugguuuuucgaccuauggggaaggggcacccucauuguugugucguca

SEQ ID NO: 26204 - RNA, 375 nt, Artificial Sequence
  derived and/or modified sequence opt3 from anti-HIV-1_HeavyChain
agacacaccguggagcagagcggcuccggggucaagaggcccggagccucuguucgggugucaugcuggacaagugaagacaucuucgagacuacggaacugauucauuggguacgccaagcuccuggucagggccucgaguggauagggugggugaaaaccgucacaggagcagugaacuuuggcagcuccgauuuccgacagcguguuucucuuacuagagacagggaucuguuuaccgcccacauggacauccgggguuugacacagggggauaccgcgacuuacuucugugcucgccaaaaguuuuaugccggaggccagggcugguacuucgacuuaugggggagaggaacacugauuguggucucguca

SEQ ID NO: 26205 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagaggucuguucacggcucauauggauaucagggggcuaacccaggacgauacagccacuuauuuuugugcacggcaaaaauucgcccgcggagaccagggcugguuuuucgaucucuggggcagagggacccugauuguugugucguca

SEQ ID NO: 26206 - RNA, 375 nt, Artificial Sequence
  derived and/or modified sequence opt3 from anti-HIV-1_HeavyChain
caggugcaccuggagcaaagcggcuccggggucaagaaacccggagccucuguuagagugucaugcuggaccagugaagacaucuucgaaaagagcgagcucauucauuggguaaggcaggcuccuggucagggccuugaguggauagggugggugaaaacagucacuggagcagccaacuuuggcuccucugauuuccggcagcgcgugucgcugacgccagaccgagauuuguuuaccgcgcacauggacauccgugguuuaacacaaggggauacugcuaccuacuucugugccagacagaaguuuuauaaaggaggccagggcugguacuucgaccugugggggaggggaacacuaauuguugugucaagc

SEQ ID NO: 26207 - RNA, 375 nt, Artificial Sequence
  derived and/or modified sequence opt3 from anti-HIV-1_HeavyChain
caggcccaccuggagcaaagcggcgcuggggugaagaaacccggagcauccgucagaguuucuugcuggaccucagaagacaucuucgauacaacugagcucauucauugggugaggcaggccccuggucagggccuugaauggauaggguggguaaagaucgugaguggagcggucaacuuuggcagcccaaauuuccggcagcgcgugucccugacgcgagaccgugauuuguuuaccgcucacauggacauuagagguuuaacacaaggggauacugccaccuacuucugugcaaggcagaaauuugagcggggaggccagggcuggaucuucgaccugugggggcgcggaacacuaauugccguuucuucg

SEQ ID NO: 26208 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccaguagggacaucuucgaacggacagagcuuauucauugggugcgccaggcacccggucagggccuggaauggauaggguggguaaaggccgugagcggagcggucaacuacggcuccuuggauuuucgacaccgugugucuuuaacuagagacagggaucugucgacggcucauauggacauccggggucuaacccaggaugacacagccacuuauuucugugcacgccaaaaauuugccagaggggaucagggaugguucuuugaccucuggggcaggggcacccugauuguugugucaagc

SEQ ID NO: 26209 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugccuugcaagugaagacaucuucgagaggaccgaacugauucauugggugcggcaggcccccggucagggcuuggaguggauaggguggguaaaggcggugagcggagcugucaacuacggcuccuuagauuuucgccaccgagugucucugacacgugacagagaucuaucgacugcccauauggacaucaggggucucacgcaggaugacaccgcaacauauuucugugcccggcaaaaauuugcucgcggggaucagggaugguucuuugaccuguggggcagaggcacucuuauuguugugucaagc

SEQ ID NO: 26210 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggccuagugaagacaucuucgagaggaccgaacucauucauugggugcggcaggcaccaggucagggccuugaguggauaggguggguaaagacagugacuggaacggucaacuuuggcagccugaauuuccgccagcgaguguccuugacccgugauagagacuuauuuacagcccacauggauaucaggggucugacucaaggggacaccgcgacauacuucugugcucggcagaaauuugaacgcggaggccagggcugguauuucgaucuaugggggagaggaacccucauuguugugucuucg

SEQ ID NO: 26211 - RNA, 375 nt, Artificial Sequence
  derived and/or modified sequence opt3 from anti-HIV-1_HeavyChain
agagcccaccuggagcagagcggcuccgaauggaagaaacucggggcuucugugagggucucaugcuggaccaguggagacaucuucgagcggacagaacuuauucauuggguucgccaagcacccggucagggccuggaguggauagggugggugaaggccguaagcggagcggugaacuacggcuccuuggauuuucgacaccgugucucuuuaacuagagacagggaucuguucacggcucauauggacauccggggucuaacccaggaugacacagccacuuauuuuugugcacgccagaaauucgccagaggggaucaaggaugguuuuucgaccucuggggcaggggcacccugauugugguuucguca

SEQ ID NO: 26212 - RNA, 375 nt, Artificial Sequence
  derived and/or modified sequence opt3 from anti-HIV-1_HeavyChain
agacacaccguggagcagagcggcuccggggucaagaaacugggagccucuguuaacgugucaugcuggacaagugaagacaucuucgagaggacugaacucauucauuggguacggcaagcucccggucagggccuugaguggauagggugggugaaggcagucagcggagccgugaauuacggcucccuggauuuucgccaccgaguuucuuugacgcgugacagagauuuauucaccgcgcauauggacaucaggggucugacacaggaugacacugcuaccuauuuuugugcccggcagaaauucgcacgcggggaucaaggaugguuuuucgaccuauggggcagaggcacacucauuguggucucguca

SEQ ID NO: 26213 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaccagugacaggagccgucaacuuuggcuccucugauuuccggcagcgcgugucgcugacucgagaccgugauuuguuuacggcgcacauggacaucagagguuuaacccaaggggauacagcuacuuacuucugugccaggcagaaguuuuaugcaggaggccagggcugguacuucgaccugugggggcggggaacccuaauuguugugucaagc

SEQ ID NO: 26214 - RNA, 375 nt, Artificial Sequence
  derived and/or modified sequence opt3 from anti-HIV-1_HeavyChain
agacacaccuggaacaagagcggcuccggggugaaaaagcccggagccucugucaggguuucaugcuggacaagugaggacaucuucgaacggacugagcugauucauugggugcgccaggcuccuggucaaggccucgaauggauaggguggguaaaaacggugaccggagcagucaauuuuggcagcccaaacuuccgacaccgugugucccuuacaagagauagggaccuguuuacugcccauauggauauccgggguuugacccagggggacacagcgaccuacuucugugcucgccagaaguuugagagaggaggccagggcugguauuucgauuuaugggggaggggaacucugauuguugugucuucg

SEQ ID NO: 26215 - RNA, 375 nt, Artificial Sequence
  derived and/or modified sequence opt3 from anti-HIV-1_HeavyChain
caggcccacagcgagcaauccggcucuggggugaagaaacccggagcuucagucagaguuaguugcuggaccagcgaagacaucuucgagaggacagaacugauucauugggugcggcaggcaccuggucagggccucgaguggauaggguggguaaagaucguguccggagccgucaacuuuggcucuccaaauuuccgccagcgagugucgcuuacucgugauagagaccuguuuacggcgcacauggauauuagggguuugacccaaggggacacagcuacuuacuucugugcccggcagaaauuugaacgcggaggccagggcuggaucuucgauuuaugggggagaggaacccugauugcaguuucaagc

SEQ ID NO: 26216 - RNA, 375 nt, Artificial Sequence
  derived and/or modified sequence opt3 from anti-HIV-1_HeavyChain
caggcccaccuggagcaaagcggcgcuggggugaagagacccggagcauccgucaggguuucuugcuggaccucagaagacaucuucgagacaacugaacucauucauugggugcggcaggccccuggucagggccuugaguggauaggguggguaaaaacggugaccggagcggucaacuuuggcaguccaaauuuccgccaccgagugagccugacacgugauagagacuuguuuacugcucauauggauaucagggguuuaacccagggggacacagccaccuacuucugugcacggcaaaaguuugaacgcggaggccagggcugguauuucgaucugugggggagaggaacucuaauuguuguguccucu

SEQ ID NO: 26217 - RNA, 375 nt, Artificial Sequence
  derived and/or modified sequence opt3 from anti-HIV-1_HeavyChain
ggccacaccugggagcagagcggggccggagugaagaaacugggugcuuccgucagaguuucuugcuggacaucagaagacaucuucgagaggacugaacucauucauugggugcggcaagcacccggccaggggcuugaguggauaggauggguaaaggccgugaguggcgcggucaacuacgguagccuggauuuucgccaccgaguguccuugacgcgugacagagauuuauucaccgcucauauggacaucagggggcugacacaggaugacacugccauuuauuuuugugcacggcagaaauucgcccgcggagaucaaggcugguuuuucgaccuauggggcagagggacccucaucguugugucuucg

SEQ ID NO: 26218 - RNA, 375 nt, Artificial Sequence
  derived and/or modified sequence opt3 from anti-HIV-1_HeavyChain
ggcacccccgggagcgaguccggaucuggugugaagaaacugggcgccucagucagaguuaguugcuggacaagcgaagacaucuucgagaggacugaacucauucacugggugcggcaggcuccugggcaaggacuugaguggauaggcuggguaaaggcaguguccggugccgucaacuacgggucucuggauuuucgccaucgagugucguugacgcgugacagagauuuaucaaccgcgcacauggacaucaggggacugacacaggaugacacugcuaccuauuucugugcccggcagaaauuugcacgcggcgaucagggcugguucuuugaccuaugggggagaggaacacucauuguugugagcagu

SEQ ID NO: 26219 - RNA, 375 nt, Artificial Sequence
  derived and/or modified sequence opt3 from anti-HIV-1_HeavyChain
ggcacccccgggagcgaguccggaucuggugugaagaugccuggcgccucagucagaguuaguugcuggacaagcgaagacaucuucgagaggacugaacugauucacugggugcggcaggcuccagggcaaggacucgaguggauaggcuggguaaaaacgguguccggugcagucaacuuugggucuccgaauuuccgccaucgagugucgcuuacccgugauagagaccuguuuacagcccacauggauaucaggggauugacucagggcgacaccgcgacauacuucugugcucggcagaaguuugaacgcggcgggcagggaugguauuucgauuuaugggguagaggcacccugauuguugugucaagc

SEQ ID NO: 26220 - RNA, 375 nt, Artificial Sequence
  derived and/or modified sequence opt3 from anti-HIV-1_HeavyChain
agacacaccugggagcagagcggcgccggggugaagaaacccggagcuuccgucaggguuucuugcuggacaucagaagacaucuucgagcggacugaacugauucauugggugcgccaagcaccuggucagggccucgaguggauaggguggguaaagacggugaguggagccgucaacuuuggcagcccaaauuuccgacaccgugugucccuuaccagagauagggaccuguuuacagcgcauauggauauccgggguuugacucagggggacaccgcuacauacuucugugcccgccagaaauuugaaagaggaggccaaggcugguauuucgauuuaugggggaggggaacccugauuguugugucuucg

SEQ ID NO: 26221 - RNA, 375 nt, Artificial Sequence
  derived and/or modified sequence opt3 from anti-HIV-1_HeavyChain
ggcacccccgggaacaagagcggauccggugugaaaaagccuggcgccucugucagaguuucaugcuggacaagugaggacaucuucgagaaaagcgaacugauucacugggugaggcaggcuccagggcaaggacucgaauggauaggcuggguaaagacugugacgggugcagucaauuuuggguccucugauuuccggcagcgcgugucgcuuacccgagaccgugaucuguuuacagcccauauggacaucagaggauugacucagggcgauaccgcgacauacuucugugcuaggcagaaauuuuaugccggcgggcaaggaugguacuucgacuuauggggucggggcacccugauuguugugucaagc

SEQ ID NO: 26222 - RNA, 375 nt, Artificial Sequence
  derived and/or modified sequence opt3 from anti-HIV-1_HeavyChain
caggcccaccuggagcaaagcggcgcuggggugaagaaacccggagcauccgucagaguuucuugcuggucaagugaagacaucuucgagaggaccgaacucauucauugggugcggcaggccccuggucagggccuugaguggauaggguggguaaagacagugacuggagcggucaacuuuggcagcccaaauuuccgccaccgagugucccugacgcgugauagagacuuguuuaccgcucauauggauaucagggguuuaacacagggggacacugccaccuacuucugugcacggcaaaaauuugaacgcggaggccagggcugguauuucgaucugugggggagaggaacacuaauuguugugucuucg

SEQ ID NO: 26223 - RNA, 375 nt, Artificial Sequence
  derived and/or modified sequence opt3 from anti-HIV-1_HeavyChain
ggcacccccgggaacaagagcggauccggugugaaaaagccuggcgccucugucagaguuucaugcuggacaagugaggacaucuucgaaaggacugagcugauucacugggugcggcaggcuccagggcaaggacucgaauggauaggcuggguaaaaacggugaccggugcagucaauuuugggagcccgaacuuccgccaucgagugucccuuacacgugauagagaccuguuuacugcccacauggauaucaggggauugacccagggcgacacagcgaccuacuucugugcucggcagaaguuugagcgcggcgggcagggauggauuuucgauuuaugggguagaggcacucugaucgccguuucuucg

SEQ ID NO: 26224 - RNA, 375 nt, Artificial Sequence
  derived and/or modified sequence opt3 from anti-HIV-1_HeavyChain
ggcacccccgggaacaagagcggauccggugugaaaaagccuggcgccucugucagaguuucaugcuggaguagcgaggacaucuucgaaaggacagagcugauucacugggugcggcaggcuccagggcaaggacucgaauggauaggcuggguaaaaacugugacgggugcagucaauuuugggucccuugauuuccgccaucgaaucucucugacccgugacagagauuuguuuacagcccacauggacauuaggggauuaacucagggcgauaccgcgacauacuucugugcucggcagaaguuugagcgcggcgggcagggauggaucuucgaccugugggguagaggcacccuaauugccgugucguca

SEQ ID NO: 26225 - RNA, 375 nt, Artificial Sequence
  derived and/or modified sequence opt3 from anti-HIV-1_HeavyChain
caggcccaccuggagcaaagcgcuuccggcgugaagagacccgggggaugggucaggguuucuugcuggaccucagaagacaucuucgagcggagugaacucauuuacugggugcgccaggcaccuggucagggccuugaguggauaggguggguaaaaacagugacuggagccgucaacuuuggcagcccaaauuuccgacaucgugugucccugacgagagauagggacuuguuuaccgcgcacauggauauccgggguuuaacacagggggacacugcuaccuauuucugugcccgccaaaaguuugaaagaggaggccagggcugguacuucgaucugugggggaggggaacacuaauuguugugucuucg

SEQ ID NO: 26226 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacuagcuccggagccgugaacuuuggcucuccaaauuuccgcacgcgagucucgcugacccgugauagagacuuguuuacagcgcacauggauaucagggguuuaacucagggggacaccgcuacauacuucugugcccggcaaaaauuugaacgcggaggccagggcugguauuucgaucugugggggagaggaacccuaauugugguuucaagc

SEQ ID NO: 26227 - RNA, 375 nt, Artificial Sequence
  derived and/or modified sequence opt3 from anti-HIV-1_HeavyChain
caggcccaccuggagcaaagcggcgcuggggugaagaaacccggagcauccgucagaguuucuugcuggaccucagaagacaucuucgagaggacagaacucauucauugggugcggcaggccccuggucagggccuugaguggauaggguggguaaagacugugaguggagcggucaacuuuggcagcccaaauuuccgccaccgagugucccugacgcgugauagagacuuguuuaccgcucauauggauaucagggguuuaacacagggggacacugccaccuacuucugugcacggcaaaaauuugaacgcggaggccagggcugguauuucgaucugugggggagaggaacacuaauuguugugucuucg

SEQ ID NO: 26228 - RNA, 375 nt, Artificial Sequence
  derived and/or modified sequence opt3 from anti-HIV-1_HeavyChain
agacacaccugggagcagagcggcuccggggugaagaaacccggagccucugucaggguuucaugcuggacaagugaagacaucuucgagcggacugaacugauucauugggugcgccaagcuccuggucagggccucgaguggauaggguggguaaagacggugaccggagcagucaacuuuggcagcccaaauuuccgacaccgugugucccuuacaagagauagggaccuguuuacugcccauauggauauccgggguuugacccagggggacacagcgaccuacuucugugcucgccagaaauuugaaagaggaggccaaggcugguauuucgauuuaugggggaggggaacucugauuguugugucuucg

SEQ ID NO: 26229 - RNA, 375 nt, Artificial Sequence
  derived and/or modified sequence opt3 from anti-HIV-1_HeavyChain
ggcaccacauggaacaagagcggguccggagugaaaaagcccggugccucugucagaguuucaugcuggacgagugaggacaucuucgaaaggacugagcugauucacugggugcggcaggcuccuggccaagggcucgaauggauaggauggguaaaaaccgugacaggcgcagucaauuuugguagcccaaacuuccgccaucgagugucccuuacucgugauagagaccuguuuaccgcccacauggauaucaggggguugacacagggagacaccgcgacuuacuucugugcucggcagaaguuugagcgcggcggccaggggugguauuucgauuuauggggaagagguacacugauuguugugucuucg

SEQ ID NO: 26230 - RNA, 375 nt, Artificial Sequence
  derived and/or modified sequence opt3 from anti-HIV-1_HeavyChain
agacacaccuggaacgagagcggcuccggggugaagaaacccggagccucugucaggguuucaugcuggacaagugaagacaucuucgaaaagagcgagcugauucauugggugcggcaggcuccuggucaaggccucgaguggauaggguggguaaaaacugugacgggagcagucaauuuuggcuccucugauuuccgccagcgagugucgcuuacccgugacagagaucuguuuacagcccacauggacaucagggguuugacucagggggauaccgcgacauacuucugugcucggcagaaguuuuaugccggaggccaaggcugguacuucgacuuaugggggcgcggaacccugauuguugugucaagc

SEQ ID NO: 26231 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugguaacaucuucgaaaggacagagcuuauucauugggugcggcaggcacccggccaggggcuggaauggauaggauggguaaaggccgugagcggcgcggucaauuacgguuccuuggacuuucgccaccgagugucuuuaacucgugauagagaccugucgacggcucauauggauaucagggggcuaacccaggacgauacagccacuuauuucugugcacggcaaaaauuugcccgcggagaccagggcugguucuuugaucucuggggcagagggacccugauuguugugucaagc

SEQ ID NO: 26232 - RNA, 378 nt, Artificial Sequence
  derived and/or modified sequence opt3 from anti-HIV-1_HeavyChain
agaugcagcauggagcagcccggcugguccgaaaagccuggggccucugugacccugucauguaaaacagcugacgaggaugucuucgacgcagccuacaugcacuggguuaggcaagcgccaggacagacuuuugaauggcucgguuggaugaagccggugacgggcgcuguaaguuaugcccggaaauuccaggggcgcgugagcuuuuacaugacccgagagcuuggaauggcauauauggaucugcguaacuugagauucgacgauacagccgucuacuuuugcgcuaggaagacugcaggcgacguguccggugauaaucggggguauuucuuugacuuauggggacgcggcucuagaguuaucgugucguca

SEQ ID NO: 26233 - RNA, 375 nt, Artificial Sequence
  derived and/or modified sequence opt3 from anti-HIV-1_HeavyChain
agacacaccagcgagcaguccggcucuggggugaagaaacccggagccucagucaggguuaguugcuggacaagcgaagacaucuucgagcgguccgaacugauucauugggugcgccaagcuccuggucagggccucgaguggauaggguggguaaagacugugacgggagcagucaacuuuggcucuccaaauuuccgacaccgugugucgcuuaccagagauagggaccuguuuacagcccauauggauauccgggguuugacucagggggacaccgcgacauacuucugugcucgccagaaauauuacgccggaggccaaggcugguauuuugauuuaugggggagaggaacccugauuguugugucaagc

SEQ ID NO: 26234 - RNA, 375 nt, Artificial Sequence
  derived and/or modified sequence opt3 from anti-HIV-1_HeavyChain
agacacaccguggagcagagcggcgccggggucaagaaacccggagcuuccguuagggugucuugcuggacaucagaagacaucuucgagcggacugaacugauucauuggguacgccaagcaccuggucagggccucgaguggauagggugggugaagacggucaguggagccgugaacuuuggcagcccaaauuuccgacaccguguuucccuuaccagagauagggaccuguuuacagcgcauauggauauccgggguuugacucagggggacaccgcuacauacuucugugcccgccagaaauuugaaagaggaggccaaggcugguauuucgauuuaugggggaggggaacccugauuguggucucuucg

SEQ ID NO: 26235 - RNA, 375 nt, Artificial Sequence
  derived and/or modified sequence opt3 from anti-HIV-1_HeavyChain
ggcacccccuggaacgagagcggguccggagugaagaaaccuggugccucugucagaguuucaugcuggacaagugaagacaucuucgaaaagagcgagcugauucacugggugaggcaggcuccaggccaagggcucgaguggauaggauggguaaaaacugugacgggcgcagucaauuuugguuccccgaacuuccggcaucgcgugucucuuacccgagaucgugaccuguuuacagcccacauggauaucagaggguugacucagggagacaccgcgacauacuucugugcuaggcagaaguuugaacggggcggccaggggugguauuucgauuuauggggacgcgguacccugauuguugugucguca

SEQ ID NO: 26236 - RNA, 375 nt, Artificial Sequence
  derived and/or modified sequence opt3 from anti-HIV-1_HeavyChain
agacacgaccuggagcccagcggcuccggggugaagaaaccuggagccucugucaggguuucaugcuggaccagugaagauaucuucgagcggacagaacucauucauugggugcgccaggcuccaggucaaggccuugaguggauaggguggguaaagacugugacgggagcagucaacuuuggcagccuggacuuccgacaccguaucuccuugaccagagauagggacuuauuuacagcccauauggauauucggggucugacucagggggacaccgcgacauacuucugugcucgccagaaauuugaaucuagauauaccggaggccagggcugguacuucgaucuaugggggaggggaacucacaucgug

SEQ ID NO: 26237 - RNA, 375 nt, Artificial Sequence
  derived and/or modified sequence opt3 from anti-HIV-1_HeavyChain
agacacaccguggagcagagcggcuccggggucaagaaacugggagccucuguuagggugucaugccucgcuagugaagacaucuucgagcggacagaacuuauucauuggguacgccaagcacccggucagggccuggaguggauagggugggugaaggccgucagcggagcggugaacuacggcuccuuggauuuucgacaccguguuucuuuaacuagagacagggaucugucgacggcucauauggacauccggggucuaacccaggaugacacagccacuuauuucugugcacgccagaaauuugccagaggggaucaaggaugguucuuugaccucuggggcaggggcacccugauuguggucucaagc

SEQ ID NO: 26238 - RNA, 375 nt, Artificial Sequence
  derived and/or modified sequence opt3 from anti-HIV-1_HeavyChain
caggcccaccuggagcaaagcggcuccgaaucuaagaaacccggggcuucagugagagucaguugcuggaccagcgaggacaucuucgaaaaguccgagcucauucauuggguuaggcaggcaccuggacagggucuugaauggauaggcugggugaaaacaguaacuggggccgugaacuuuggaucuucggauuuccggcagcgcgucucacugacgcgagaccgugauuuguuuaccgcgcacauggacaucagaggcuuaacacaaggugauacugcuaccuacuucugugccaggcagaaguuuuaugcagggggacagggcugguacuucgaccuguggggccgggggacacuaauugugguuagcagu

SEQ ID NO: 26239 - RNA, 375 nt, Artificial Sequence
  derived and/or modified sequence opt3 from anti-HIV-1_HeavyChain
ggcacccccgggagcgaguccgccucuggagugagaaggccuggugcuucaguccggguuaguugcuggacaagcgaagacaucuucgagcgcuccgaacugauuuacugggugcgacaggcaccaggccgugggcucgaguggauaggauggaucaaacuuguaucuggcgccgugaacuuugguucggucgauuucagagacagggugucacugacucgggaucgcgacuuguuuacggcgcacauggauauuagaggguuaacccaaggagacacagcuacuuauuucugugccaggcagaaguuugaacggggcggccaggggugguacuucgaucuguggggacgcgguacccuaaucguugugagcagu

SEQ ID NO: 26240 - RNA, 375 nt, Artificial Sequence
  derived and/or modified sequence opt3 from anti-HIV-1_HeavyChain
caggugcaccuggagcaaagcggcuccggggucaagaaacccggagccucuguuagagugucaugcuggaccagugaagacaucuucgaaaagagcgagcucauucaguggguaaggcaggcuccuggucagggccuugaguggauagggugggugaaaacagucacuggagcagugaacuuuggcuccucugauuuccggcaacgcguuucgcugacgcgagaccgugauuuguuuaccgcccauauggacaucagagguuuaacacagggggauacugcgaccuacuucugugcuaggcagaaguuuuaugccggaggccagggcugguacuucgaccugugggggcggggaacacuaauuguggucucaagc

SEQ ID NO: 26241 - RNA, 375 nt, Artificial Sequence
  derived and/or modified sequence opt3 from anti-HIV-1_HeavyChain
ggcacccccgggagcgaguccggaucuggugugaagaaagucggcgccucaguuagagugaguugcuggacaagcgaagacaucuucgagaggacugaacugauucacuggguacggcaggcuccugggcaaggacucgaguggauaggcugggugaaggcagucuccggugccgugaacuacgggucucuugauuuucgccaucgaguuucgcugacgcgugacagagauuuguucaccgcgaggauggacauccggggauuaacacaggaugacacugcuauuuauuuuugugcccgccagaaauucgcaagaggcgaucagggcugguuuuucgaccugugggggaggggaacccuaaucguggucucaagc

SEQ ID NO: 26242 - RNA, 375 nt, Artificial Sequence
  derived and/or modified sequence opt3 from anti-HIV-1_HeavyChain
ggcacccccgggagcgaguccggaucuggugugaagagaccuggcgccucagucaggguuaguugcuggacaagcgaagacaucuucgagacuacggaacugauucacugggugcggcaggcuccagggcaaggacucgaguggauaggcuggguaaaaaccguguccggugcagucaacuuugggucucuuaauuuccgccaucgagugucgcugacacgugauagagacuugucaacugcccacauggauaucaggggauuaacccaggacgauacagcgaccuacuuuugugcucggcagaaguucgcccgcggcgaccagggcugguuuuucgaucugugggggagaggaacucuaauuguugugagcagu

SEQ ID NO: 26243 - RNA, 372 nt, Artificial Sequence
  derived and/or modified sequence opt3 from anti-HIV-1_HeavyChain
agagcccaccuggagcagagcggcgcuggggugaagaaacccggagguugggucaggguuuccugcuggaccucugaagacaucuucaagacagagcucauucauugggugcggcaagcaccuggccaggggcuugaauggauaggauggguaaaaacugugacgggcgccgucaacuuugguucaccaaauuuccgccaccgagugagucugacccgugauagagacuuguuuacagcgcauauggauaucaggggguuaacucagggagacaccgcuacauacuucugugcccggcagaaguuugagcgcggcggccaagggugguauuucgaucuguggggaagagguacccuaauuguugugagcucc

SEQ ID NO: 26244 - RNA, 378 nt, Artificial Sequence
  derived and/or modified sequence opt3 from anti-HIV-1_HeavyChain
caggugcaacugaugcagagcggcgccgaggucaagagacccggggcuuccguuaaaaucucuugcaccgcaucaggauucacacucacugaccacuacaugcauugggugaggcaggccccuggucagacguuugaauggcuuggcuggaugaagccaguaaccggggcggugaacuaugcucggaaauuccaaggacgcgucaguuuuuaccgaacacgugagcugggcauugccuauauggauuugagaaauuuaagguucgacgauacugcaguguacuuuugugcccggaagaccgcuggugacguuagcggggauaaacgcggauucuuuuucgaccuguggggcagaggcuccagggugauagucucuucg

SEQ ID NO: 26245 - RNA, 378 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaacuucaccgguuauuaccuccacugggugagacaggccccuggccagacauuugaauggcuuggguggaugaagccagucacuggagcggugaguuaugcuaggaaauuccaaggccggguuagcuuuuacaugacgcgcgagcuggguauggccuauauggacuugcgaaauuuacguuucgaugacaccgcaguguacuuuugugccagaaagacagcuggggaugucuccggagacaacaggggcuauuucuuugaucuguggggccgggggucucgcgugaucguaucguca

SEQ ID NO: 26246 - RNA, 375 nt, Artificial Sequence
  derived and/or modified sequence opt3 from anti-HIV-1_HeavyChain
ggcacccccgggagcaaguccggaucuggugugaaaaagccuggcgccucagucagaguuaguugcuggacaagcgaggacaucuucgaaaggacugagcugauucacugggugcggcaggcuccagggcaaggacucgaauggauaggcuggguaaaaacggugaccggugcagucaacuuuggguccccgaauuuccgccaucgagugucucuuacacgugauagagaccuguuuacugcccacauggauaucaggggauugacccagggcgacacagcgaccuacuucugugcucggcagaaguuugagcgcggcgggcagggaugguauuucgauuuaugggguagaggcacucugauuguugugucguca

SEQ ID NO: 26247 - RNA, 378 nt, Artificial Sequence
  derived and/or modified sequence opt3 from anti-HIV-1_HeavyChain
caggugcaacugguccagagcggcgccgagcucaagaaacccggggcuuccguuaaggugucuugcgaagcaucaggauacaguuucaccgaccaccauauccacuggguaagacaggccccuggucagggccuugaguggcugggguggaugaacccaaauaacggagauacagcguaugcucaaacguuuuugggcagggugacuaugacccgggacacaagcauuaauacugccuacauggaauuaucccgccugaccucugaugacacagcagucuauuucugugcccgaaaaaccgcuggugaugugucgggggacaagcguggauuuuucuuugaucuauggggcagaggcucaaggguuauagugagcagu

SEQ ID NO: 26248 - RNA, 378 nt, Artificial Sequence
  derived and/or modified sequence opt3 from anti-HIV-1_HeavyChain
cagguguacaugagcuccagaggcgggaugaagaaacccggagccucuaugaccgucucaugcaagacagcugacgaggauaucuucgacgcagccuauaugcacuggguuaggcaagcgccuggucagacuuuugaauggcugggcuggaugaaaccagugacgggggcuguaaacuacgcccggcaguuccagggacgcgugaguuuuuaucgaacccgugagcucggcauugcauacauggaucuuagagaccugaaguucgaugacacagccgucuauuuuugugcuaggaaaacuaagggugaugugagcggggacgaucggggauucuuuuucgacuuguggggccgcggcaccagaguuauaguguccucu

SEQ ID NO: 26249 - RNA, 378 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacagccuauuacaugcacuggcucagacaggcgccuggucagggccuugaauggaugggguggaucaacccacauaguggaggcacuaauuuugcucaaaaguuccaggguagggugacgaugacccgggacacaagcauuacuaccgccuauauggagcugucccgcuugcgaucugaugacacagcaaccuacuuuugugcccgucagaaauucgcuucgagauauucaggggaucagggaagcuacuuugacuuauggggcaggggcacucugauagucgugaguucc

SEQ ID NO: 26250 - RNA, 375 nt, Artificial Sequence
  derived and/or modified sequence opt3 from anti-HIV-1_HeavyChain
agagcccaccuggagcagagcggcgcuggggugaagaaacucggagcauccgucaggguuucuugcuggaccucagaagacaucuucgagcggacagaacuuauucauugggugcgccaagcccccggucagggccuggaguggauaggguggguaaaggcggugaguggagcugucaacuacggcagcuuggauuuucgacaccguguguccuuaacuagagacagggaucuguucacggcccauauggacauccggggucuaacccaggaugacacagcaacuuauuuuugugcccgccagaaauucgcuagaggggaucaaggaugguuuuucgaccucuggggcaggggcacccugauuguugugucuucg

SEQ ID NO: 26251 - RNA, 378 nt, Artificial Sequence
  derived and/or modified sequence opt3 from anti-HIV-1_HeavyChain
caggugagacugguccaaagcggcgccgacguuaagcagcccggggcuuccgugaaaguaucuugcaaggcaucaggauacaccuucacagauuauuacaugcacugggugaggcaggccccuggucagacuuuugaguggcucggcuggaugaaaccagucacgggggcggugaguuaugcucggaaguuccaaggacgcguuagcuuuuacaugacccgagaacuuggcauggccuauauggaccugcguaacuugagauucgaugacacagcaguguacuuuugugccaggaaaacugcuggugaugucuccggggacaaucggggauauuucuuugauuuauggggccgcggcucuagagugaucguaucguca

SEQ ID NO: 26252 - RNA, 378 nt, Artificial Sequence
  derived and/or modified sequence opt3 from anti-HIV-1_HeavyChain
caggcccaccugggcaacaagagcggguccggagugaaaaagcccggugcuucugucagaguuucaugcuggaccagugaggacaucuucgagaaaagcgaacucauucauugggugaggcaagcaccuggccaggggcuugaauggauaggauggguaaagacagugacuggcgccgucaauuuugguuccucugauuuccggcagcgcgugucgcugacgcgagaccgugauuuguuuaccgcgcacauggacaucagaggguuaacacagggagauacugcuaccuacuucugugccaggcaaaaauuuuaugcaggcggccaggggugguacuucgaccuguggggacgggguacacuaauuguugugucaagc

SEQ ID NO: 26253 - RNA, 381 nt, Artificial Sequence
  derived and/or modified sequence opt3 from anti-HIV-1_HeavyChain
cagguguacauggagcaaagcggcgggggagucaagaaacccggugccuccguuacccugucuugcaagacagcugacgaagauguguucgacgcagccuauaugcacuggguaagacaggcgccuggccagacuuuugaguggcucggguggaugaaaccagugacgggagcugucaacuacgccaggaaguuccagggccgggugucauuuuaucgcacccgagaacuugguaucgcauacauggaucugcguaauuugagauucgacgauacagccguuuauuuuuguacuaggaaaaccgcuggggacgugaguggagauaagcggggcuucuuuuucgacuuauggggccgcgggagcagagucauuguguccucu

SEQ ID NO: 26254 - RNA, 381 nt, Artificial Sequence
  derived and/or modified sequence opt3 from anti-HIV-1_HeavyChain
cagguguacgucgagcaacccggcgggggaguuaagaaaccuggugccagcgugacccuguccugcaagacagcugacgaagauguauucgacgcaacuuauaugcacugggugagacaggccccaggccagacguuugaguggcucggguggaugaaaccggucaccggagcggugaacuacgcuaggaaguuccagggccggguuucuuuuuaucgcacacgagaacuugguaucgccuacauggaucugcguaauuugagauucgacgauacugcaguguauuuuugugccaggaaaaccgcuggggacgucucaggagauaagcggggcuucuuuuucgacuuauggggccgcgggaguagagugauuguaagcucc

SEQ ID NO: 26255 - RNA, 381 nt, Artificial Sequence
  derived and/or modified sequence opt3 from anti-HIV-1_HeavyChain
cagguguacauggagcaagccggcgucgaaguugagaagcccggggcuagcgugacccuguccugcaaaacagcagacgaagauguauucgacgccgcguauaugcacugggugagacaggcuccuggacagacuuuugaguggcucgguuggaugaagccagucacgggcgccgugucuuacgcaaggaaauuccaggggcggguuucauuuuauaugacccgcgaacuuggaauggccuacauggaucugcgaaacuugcguuucgacgauacagcuguguauuuuugugcaagaaagacugccggcgacgucaguggugauaauaggggguacuucuuugacuuauggggacggggcagccgcgugaucguauccucu

SEQ ID NO: 26256 - RNA, 381 nt, Artificial Sequence
  derived and/or modified sequence opt3 from anti-HIV-1_HeavyChain
cagguguacauggagcaagccggcgcuggggucaagaaacccggagcaagcguuacccuguccugcaagacagccgacgaagauguguucgacgcggcuuauaugcacuggguaagacaggccccuggucagacuuuugaguggcucggcuggaugaaaccagugacgggggcagucucuuacgccaggaaguuccagggacgggugucauuuuauaugacccgcgaacuuggcauggcuuacauggaucugcgaaacuugcguuucgacgauacagcaguuuauuuuugugccagaaaaacugcuggugacgugaguggggauaauaggggauacuucuuugacuuauggggccggggcagccgcgucaucguguccucu

SEQ ID NO: 26257 - RNA, 381 nt, Artificial Sequence
  derived and/or modified sequence opt3 from anti-HIV-1_HeavyChain
caggugcacauggagcaagccggcgcuggggucaagaaacccggagcaagcguuacccuguccugcaagacagccgacgaagauguguucgacgcggcuuacaugcauuggguaagacaggccccuggucagacuuuugaguggcucggcuggaugaaaccagugacgggggcagucaacuaugccaggaaguuccagggacgggugucuuuuuaccgcacccgagaacuuggcaucgcuuauauggaucugcguaauuugagauucgacgauacagcaguuuacuuuugugccaggaaaacugcuggugacgugucaggggauaagcggggauucuuuuucgacuuauggggccgcggcaguagagucauugugagcucc

SEQ ID NO: 26258 - RNA, 381 nt, Artificial Sequence
  derived and/or modified sequence opt3 from anti-HIV-1_HeavyChain
cagguguacauggagcaagccggcgcugaagucaagaaacccggggcaagcguuacccuguccugcgagacagccgacgaagauguguucgacgcggcuuauaugcacuggguaagacaggccccuggacagacuuuugaguggcucgguuggaugaagccagugacgggcgcagucaacuacgccaggaaauuccaggggcgggugucuuuuuaucgcacccgagaacuuggaaucgcuuacauggaucugcguaauuugagauucgacgauacagcaguuuauuuuugugccaggaagacugcuggcgacgugucaggugauaaacggggguucuuuuucgacuuauggggacgcggcaguagagucauugugagcucc

SEQ ID NO: 26259 - RNA, 381 nt, Artificial Sequence
  derived and/or modified sequence opt3 from anti-HIV-1_HeavyChain
cagguguacauggagcaacccggcgggggagucaagaaaccuggugccagcguuacccuguccugcaagacagcugacgaagauguguucgacgcagccuauaugcacuggguaagacaggcgccaggccagacuuuugaguggcucggguggaugaaaccggugacgggagcugucaacuacgccaggaaguuccagggccgggugucuuuuuaucgcacccgagaacuugguaucgcauacauggaucugcguaauuugagauucgacgauacagccguuuauuuuugugcuaggaaaacugcaggggacgugucaggagauaagcggggcuucuuuuucgacuuauggggccgcgggaguagagucauugugagcucc

SEQ ID NO: 26260 - RNA, 372 nt, Artificial Sequence
  derived and/or modified sequence opt3 from anti-HIV-1_HeavyChain
gccacccccuggaacaagagcggcuccggggugaaaaagccuggagcuucugucagaguuucaugcuggacaagugaggacaucuucgaaaggacugagcugagccucgugcggcaggcaccaggucaaggccuugaauggauuggguggaugaaaacgguaaccggagccgugaauuuuggcuccccgaacuuccgccacggugucucucugacacgagaucgugacuuguuuacugcgcauauggauauaagaggguuaacccagggagacacagcuaccuacuucugugccaggcagaaguuugagcggggcggccaggggugguauuucgaucuguggggacgcgguacucuaaucgugguuucguca

SEQ ID NO: 26261 - RNA, 381 nt, Artificial Sequence
  derived and/or modified sequence opt3 from anti-HIV-1_HeavyChain
cagguguacauggagcaagccggcgcugggaugaagaaacccggagcaagcaugaccgccuccugcaagacagcggacgaagauaucuucgacgcugccuauaugcacugggucagacaggcaccuggucagacuuuugaguggcugggcuggaugaaaccaguuacgggggccgugaacuacgcuaggcaguuccaaggacggguaucuuuuuaucgcacccgagaacucggcauugcauacauggaucuucgugaccugaaguucgaugacacagccguguauuuuugugcuagaaaaacuaagggugaugucucaggggacgauaggggauucuuuuucgacuuguggggccggggcacccgcgugauaguuaguagc

SEQ ID NO: 26262 - RNA, 378 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacagguuauuacaugcacugggugagacaggccccuggccagacuuuugaauggcucggguggaugaagccagucacgggagcggugaacuaugcuaggcaauuccagggccggguuaguuuuuaccgcacccgagagcuugguaucgccuauauggaccugcgugauuugaaauucgacgauacagcaguguacuuuugugccagaaagacuaaggcugacgucagcggggaugacaggggauucuuuuucgauuuauggggccggggcacccgcgugauuguauccucu

SEQ ID NO: 26263 - RNA, 381 nt, Artificial Sequence
  derived and/or modified sequence opt3 from anti-HIV-1_HeavyChain
agaguguacauggagcaggccggcgcuggggucaagaaacccggagcaagcguuacccuguccugcaagacagccgacgaagauguguucgacgcggcuuauaugcacuggguaaggcaagccccuggucagacuuuugaguggcucggcuggaugaaaccagugacgggggcagucucuuacgcccggaaguuccagggacgcgugucauuuaccaugacacgagaacuuggcauggcuuauauggaucugcguaacuugagauucgacgauacugcaguuuacuuuugugccaggaaaaccgcuggugacgugaguggggauaaucggggauauuucuuugacuuauggggccgcggcagcagagucaucguguccucu

SEQ ID NO: 26264 - RNA, 381 nt, Artificial Sequence
  derived and/or modified sequence opt3 from anti-HIV-1_HeavyChain
cagguguacauggagcaaagcggcgggggagucaagaaacccgguccuuccguuacccugucuugcaagacagccgacgaagauguguucgacgcugcauauaugcacuggguaagacaggccccaggccagacuuuugaguggcucggguggaugaaaccggugacgggagcggucaacuacgcuaggaaguuccagggccgggugucauuuuaucgcacccgagaacuugguaucgccuacauggaucugcguaauuugagauucgacgauacagcaguuuauuuuugugccaggaaaacugcuggggacgugaguggagauaagcggggcuucuuuuucgacuuauggggccgcgggagcagagucauuguguccucu

SEQ ID NO: 26265 - RNA, 378 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacagguuauuacauccacuggaugagacaggccccuggccaggggcucgaauggaugggauggauuaacccaaauaguggcgcggugagcuaugcuaggaaguuucaaggucgggucuccuuccuucaugaccaggggauacgcauggccuacauggaucugcgaaacuugcguuuugacgauacugcaguguauuucugugccagaaaaacggcuggagacguuucuggcgauaauaggggcuacuuuuucgacuuaugggggcggggaucgcgcgugaucgucucaagc

SEQ ID NO: 26266 - RNA, 381 nt, Artificial Sequence
  derived and/or modified sequence opt3 from anti-HIV-1_HeavyChain
caggugcacauggagcaagccggcgucgaaguugagaagcccggggcuagcgugacccuguccugcaaaacagcagacgaagauguauucgacgccgcguacaugcauugggugagacaggcuccuggacagacuuuugaguggcucgguuggaugaagccagucacgggcgccgugaacuaugcaaggaaauuccaggggcggguuucuuuuuaccgcacccgagaacuuggaaucgccuauauggaucugcguaauuugagauucgacgauacagcuguguacuuuugugcaaggaagacugccggcgacgucucaggugauaaacggggguucuuuuucgacuuauggggacgcggcaguagagugauuguaagcucc

SEQ ID NO: 26267 - RNA, 381 nt, Artificial Sequence
  derived and/or modified sequence opt3 from anti-HIV-1_HeavyChain
cagguguacauggagcaagccggcgcuggggucaagaaacccggagcaagcgccacccuguccugcaagacagcggacgaagauguuuucgacgcugccuauaugcacugggugagacaggcaccuggucagacuuuugaguggcucggcuggaugaaaccaguaacgggggccgugucuuacgcuaggaaguuccagggacgggucucauuuuauaugacccgcgaacuuggcauggcauacauggaucugcgaaacuugcguuucgacgauacagccguguauuuuugugcuagaaaaacugccggugacguuaguggggauaauaggggauacuucuuugacuuauggggccggggcagccgcgugaucgucuccucu

SEQ ID NO: 26268 - RNA, 375 nt, Artificial Sequence
  derived and/or modified sequence opt3 from anti-HIV-1_HeavyChain
ggccacgaccuggagcagagcggguccggagugaagaaacccggugccucugucagaguuucaugcuggaccagugaagauaucuucgaaaagagcgagcucauucauugggugaggcaagcuccuggccaggggcuugaguggauaggauggguaaaagcaguguccggcgccgucaacuacgguucucuggacuuucggcaccgcgugucguugacacgagaucgugacuuauucacugcgcauauggauaucagagggcugacgcaggacgauaccgcuauuuauuuuugugccaggcagaaguucgcacggggagaccaaggcugguuuuucgaucuauggggccgcgggacacucaucguugugucaagc

SEQ ID NO: 26269 - RNA, 378 nt, Artificial Sequence
  derived and/or modified sequence opt3 from anti-HIV-1_HeavyChain
caggcccacagaggcaccaucugggggcuggaggugaagaaacccggagguugggucaggguuagcugcuggacauccgaagacauuuucgagcggacugaacucauacauugggugcgccaagcuccuggccaggggcuugaguggaucggauggguaaagacggugaccggcgcagucaacuuugguucuccaaauuuccgacaccgugugucacugacaagagauagggacuuguuuacugcccauauggauauucggggguuaacccagggagacacagcgaccuacuucugugcucgccagaaauuugaaagaggcggccaagggugguauuucgaucuguggggaagggguacucuaaucguugugaguagc

SEQ ID NO: 26270 - RNA, 381 nt, Artificial Sequence
  derived and/or modified sequence opt3 from anti-HIV-1_HeavyChain
caggugcacauggagcaagccggcgcuggggucgaaaagcccggagcaagcguuacccuguccugcaaaacagccgacgaggauguguucgacgcggcuuacaugcauuggguaagacaggccccuggucagacuuuugaauggcucggcuggaugaagccagugacgggggcagucucuuaugccaggaaauuccagggacgggugucauuuuacaugacccgcgagcuuggcauggcuuauauggaucugcgaaacuugcguuucgacgauacagcaguuuacuuuugugccagaaagacugcuggugacgugaguggggauaauaggggauauuucuuugacuuauggggccggggcagccgcgucaucguguccucu

SEQ ID NO: 26271 - RNA, 381 nt, Artificial Sequence
  derived and/or modified sequence opt3 from anti-HIV-1_HeavyChain
cagguguacauggagcaaagcggcgggggagucaagaaacccggugccuccguuacccugucuugcaagacagcugacgaagauguguucgacgcagccuauaugcacuggguaagacaggcgccuggccagacuuuugaguggcucggguggaugaaaccagugacgggagcugucucauacgccaggaaguuccagggccgggugaguuuuuauaugacccgcgaacuugguauggcauacauggaucugcgaaacuugcguuucgacgauacagccguuuauuuuugugcuagaaaaacugcaggggacgugagcggagauaauaggggcuacuucuuugacuuauggggccgggggucccgcgucaucgugucuucg

SEQ ID NO: 26272 - RNA, 381 nt, Artificial Sequence
  derived and/or modified sequence opt3 from anti-HIV-1_HeavyChain
cagguguacauggagcaaagcggcgggggagucaagaaacccggugccuccguuacccugucuugcaagacagcugacgaagauguguucgacgcagccuauaugcacuggguaagacaggcgccuggccagacuuuugaguggcucggguggaugaaaccagugacgggagcugucaacuacgccaggaaguuccagggccgggugucauuuuaucgcacccgagaacuugguaucgcauacauggaucugcguaauuugagauucgacgauacagccguuuauuuuugugcuaggaaaacugcaggggacgugaguggagauaagcggggcuucuuuuucgacuuauggggccgcgggagcagagucauuguguccucu

SEQ ID NO: 26273 - RNA, 381 nt, Artificial Sequence
  derived and/or modified sequence opt3 from anti-HIV-1_HeavyChain
gagguguacauggaacagagcggcgggggagucaagaaacccggugccuccguuacccugucuugcaagacagcuucagaggacguguucgaugcagccuauaugcacuggguaagacaagcgccuggccagacuuuugaauggcucggguggaugaaaccagugacgggagcugucaacuacgccaggaaguuccagggccgggugaguuuuuaucgcacccgagagcuugguaucgcauacauggaccugcguaauuugagauucgaugacacagccguuuauuuuugugcuaggaaaacugcaggggaugugagcggagacaagcggggcuucuuuuucgauuuauggggccgcggguccagagucauugugucuucg

SEQ ID NO: 26274 - RNA, 381 nt, Artificial Sequence
  derived and/or modified sequence opt3 from anti-HIV-1_HeavyChain
caggugcaacugguccagagcggcgccgagguuaagaaacccggggcuuccgugacccucucuugcaagacagcagacgaagauguauucgacgccgcguacaugcacugggugagacaggcuccuggacagacuuuugaguggcuugguuggaugaaaccagucacgggcgccgugucauaugcaaggaaguuccaagggcggguuaguuuuuacaugacccgcgaacugggaauggccuauauggauuugcgaaacuuacguuucgacgauacagcuguguacuuuugugcaagaaaaacugccggcgacgucagcggugauaauaggggguauuucuuugaccuguggggacggggcucccgcgugaucguaucuucg

SEQ ID NO: 26275 - RNA, 381 nt, Artificial Sequence
  derived and/or modified sequence opt3 from anti-HIV-1_HeavyChain
cagguguucauggagcaaagcggcgggggaaugaagaaacccggugccuccaugaccgucucuugcaagacagcugacgaagauguuuuugacgcagccuauaugcacugggugagacaggcgccuggccagacuuucgaguggcugggguggaugaaaccaguaacgggagcugugucauaugccaggaaguuucagggccgggucaguuucuacaugacccgcgaacucgguauggcauauauggaucuucgaaaccugcguuuugacgauacagccguguacuucugugcuagaaaaacugcaggggacguuagcggagauaauaggggcuacuuuuucgacuuguggggccgggggucccgcgugaucgucucuucg

SEQ ID NO: 26276 - RNA, 381 nt, Artificial Sequence
  derived and/or modified sequence opt3 from anti-HIV-1_HeavyChain
cagguguacauggagcaagccggcgggggaaugaagaaacccggugcuagcaugaccgucuccugcaagacagcagacgaagauaucuucgacgccgcguauaugcacuggguuagacaggcuccuggccagacuuuugaguggcugggguggaugaaaccagugacgggagccguaaacuacgcaaggcgguuccagggccgcgugucuuuuuaucgaacccgugaacucgguauugccuacauggaucuuagagaccugaaguucgaugacacagcugucuauuuuugugcaaggaaaacuaagggggaugugucaggagacgaucggggcuucuuuuucgacuuguggggccgcgggaccagaguuauagugaguagc

SEQ ID NO: 26277 - RNA, 381 nt, Artificial Sequence
  derived and/or modified sequence opt3 from anti-HIV-1_HeavyChain
cagguguacauggagcaagccggcgcuggggucaagaaacccggagcaagcguuacccuguccugcaaggccgcggacgaagauguguucgacgcugccuauaugcacuggguaagacaggcaccuggucagacauuugaguggcucggcuggaugaaaccagugacuggggccgucucuuacgcuaggaaguuccagggacgggugucauuuuauaugacgcgcgaacuuggcauggcauacauggaucugcgaaacuugcguuucgacgauaccgccguuuauuuuugugcuagaaaaacagccggugacgugaguggggauaauaggggauacuucuuugacuuauggggccggggcagccgcgucaucguguccucu

SEQ ID NO: 26278 - RNA, 381 nt, Artificial Sequence
  derived and/or modified sequence opt3 from anti-HIV-1_HeavyChain
cagguguucauggagcaagccggcgcugggaugaagaaacccggagcaagcaugaccgucuccugcaagacagccgacgaagauaucuuugacgcggcuuacaugcacuggguuagacaggccccuggucagacuuucgaguggcugggcuggaugaaaccagugacgggggcaguaaacuaugccaggcaguuucaaggacgggugucuuucuaccgcacccgagaacucggcauugcuuauauggaucuucgugaccugaaguuugaugacacagcagucuacuucugugccagaaaaacuaagggugaugugucaggggacgauaggggauuuuucuuugacuuguggggccggggcacccgcguuauagugaguagc

SEQ ID NO: 26279 - RNA, 381 nt, Artificial Sequence
  derived and/or modified sequence opt3 from anti-HIV-1_HeavyChain
cagguguacauggagcaacccggcggggaagucaagaaaccuggagcaagcguuacccuguccugcaagacagcugacgaggauguguucgacgcagccuauaugcacuggguaagacaggcgccaggucagacuuuugaauggcucggcuggaugaaaccggugacgggggcugucaacuacgccaggaaguuccagggacgggugucuuuuuauaugacccgcgagcuuggcauggcauacauggaucugcgaaauuugcguuucgacgauacagccguuuauuuuugugcuagaaaaacugccggugacgugucaggggauaacaggggauacuucuuugacuuauggggccggggcagucgcgucaucgugagcucc

SEQ ID NO: 26280 - RNA, 381 nt, Artificial Sequence
  derived and/or modified sequence opt3 from anti-HIV-1_HeavyChain
caggugcacauggagcaagccggcgcuggggucaagaaacccggagcaagcguuacccuguccugcaagacagccgacgaagauguguucgacgcggcuuacaugcauuggguaagacaggccccuggucagacuuuugaguggcucggcuggaugaaaccagugacgggggcagucucuuaugccaggaaguuccagggacgggugucauuuuacaugacccgcgaacuuggcauggcuuauauggaucugcgaaacuugcguuucgacgauacagcaguuuacuuuugugccagaaaaacugcuggugacgugaguggggauaauaggggauauuucuuugacuuauggggccggggcagccgcgucaucguguccucu

SEQ ID NO: 26281 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucaacuacgcaaggaaguuccagggccgggugucuuuuuaucgcacccgagaacuugguaucgccuacauggaucugcguaauuugagauucgacgauacagcuguuuauuuuugugcaaggaaaacugccggggacgugucaggagauaagcggggcuucuuuuucgacuuauggggccgcgggccgagagucauugugaguagc

SEQ ID NO: 26282 - RNA, 381 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggacacaccuucacaaacuacgacaucaauugggugagacaggccccuggucagggccucgaauggauugggugggucaagauagugaguggaacuguuaacuuugcgagccuugauuucaggaaucggaucucccugucucgcgaccgagauuugucgacggcuuauauggacauucguggcuuaacccaagaugacacagccacuuacuuuugugcaagacagaaauucgccucaagguauagcggugaucaggggaguuacuuugaccuguggggacggggcacccuaaucguggucuccucu

SEQ ID NO: 26283 - RNA, 381 nt, Artificial Sequence
  derived and/or modified sequence opt3 from anti-HIV-1_HeavyChain
cagguguacauggagcaagccggcgggggaaugaagaaacccggugcuagcaugaccgucuccugcaagacagcagacgaagauaucuucgacgccgcguauaugcacuggguuagacaggcuccuggccagacuuuugaguggcugggguggaugaaaccagugacgggagccguaaacuacgcaaggcaguuccaaggccgggugucuuuuuaucgcacccgagaacucgguauugccuacacagaucuucgugaccugaaguucgaugacacugcugucuauuuuugugcaagaaaaaccaagggggaugugucaggagacgauaggggcuucuuuuucgacuuguggggccgggggacacgcguuauagugaguagc

SEQ ID NO: 26284 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucaacuacgcaaggcaguuccaaggccgggugucuuuuuaucgcacccgagaacuugguaucgccuacauggaucugcgugacuugaaguucgaugacacagcuguuuauuuuugugcaagaaaaacuaagggggaugugucaggagacgauaggggcuucuuuuucgacuuauggggccgggggacccgcgucauugugaguagc

SEQ ID NO: 26285 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggccaggguggaugaaaccggugacgggagccgucaacuacgcaaggaaguuccagggccgggugucuuuuuaucgcacccgagaacucgguaucgccuacauggaucuucguaaucugagauucgacgauacagcuguuuauuuuugugcaaggaaaacugccggggacgugucaggagauaagcggggcuucuuuuucgacuuguggggccgcgggaguagagucauugugagcucc

SEQ ID NO: 26286 - RNA, 381 nt, Artificial Sequence
  derived and/or modified sequence opt3 from anti-HIV-1_HeavyChain
cagguguacauggagcaagccggcgggggagucaagaaacccggugcuagcgcaacccuguccugcaagacagccgacgaagauguuuucgacgcggcuuauaugcacugggugagacaggccccuggccagacuuuugaguggcucggguggaugaaaccaguaacgggagcagugucuuacgccaggaaguuccagggccgggucucauuuuauaugacccgcgaacuugguauggcuuacauggaucugcgaaacuugcguuucgacgauacagcaguguauuuuugugccagaaaaacugcuggggacguuaguggagauaauaggggcuacuucuuugacuuauggggccgggggagccgcgugaucgucuccucu

SEQ ID NO: 26287 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugagauggguaaggcaggcuccuggccagacuuuugaguggcucggguggaugaaaccagugacgggagccgucaacuacgcacggaaguuccagggccgcgugucuuuuuaucgaacccgugaacuugguaucgccuacauggaucugagaaauuugagguucgacgauacagcuguuuauuuuugugcacggaaaacugccggggacgugucaggagauaagcgcggcuucuuuuucgacuuauggggcagagggaguagggucauugugagcucc

SEQ ID NO: 26288 - RNA, 381 nt, Artificial Sequence
  derived and/or modified sequence opt3 from anti-HIV-1_HeavyChain
caggugcaacugguccagagcggcgccgagguuaagaaacccggggcuuccgugaagguaucuugcagagcaucaggauacaccuucgguaaccacgccaucaguugggugaggcaggcgccuggccaggggcucgaauggaugggauggauucggccaaaaacaggcgcucgcaaucaagcccgacaguuucagccgcguauaagccuuacuagagacagggcacuguccacggccuauuuggauuuaaacucucugaccucggcugacucagguacauacuucugugcacggcagacuuuuaagcccgauuucuauuuugccgaccaaggguggagcuucaaucuauggggacgcggcgcucauuuuaucgucaguucc

SEQ ID NO: 26289 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucucuuacgcaaggaaguuccagggccgggugucauuuuauaugacccgcgaacuugguauggccuacauggaucugcgaaacuugcguuucgacgauacagcuguuuauuuuugugcaagaaaaacugccggggacgugaguggagauaauaggggcuacuucuuugacuuauggggcccggggagccgggucaucguguccucu

SEQ ID NO: 26290 - RNA, 381 nt, Artificial Sequence
  derived and/or modified sequence opt3 from anti-HIV-1_HeavyChain
cagguguacauggagcaagccggcgcuggggucaagaaacccggagcaagcguuacccuguccugcaagacagccgacgaagauguguucgacgcggcuuauaugcacuggguaagacaggccccuggucagacuuuugaguggcucggcuggaugaaaccagugacgggggcagucaacuacgccaggaaguuccagggacgggugucuuuuuaucgcacccgagaacuuggcaucgcuuacauggaucugcguaauuugagauucgacgauacagcaguuuauuuuugugccaggaaaacugcuggugacgugucaggggauaagcggggauucuuuuucgacuuauggggccgcggcaguagagucauugugagcucc

SEQ ID NO: 26291 - RNA, 381 nt, Artificial Sequence
  derived and/or modified sequence opt3 from anti-HIV-1_HeavyChain
caggugcacauggagcaagccggcgggggagucaagaaacccggugcuagcguuacccuguccugcaagacagcagacgaagauguguucgacgccgcguacaugcauuggguaagacaggcuccuggccagacuuuugaguggcucggguggaugaaaccagugacgggagccgucaacuaugcaaggaaguuccagggccgggugucuuuuuaccgcacccgagaacuugguaucgccuauauggaucugcguaauuugagauucgacgauacagcuguuuacuuuugugcaaggaaaacugccggggacgugucaggagauaagcggggcuucuuuuucgacuuauggggccgcgggaguagagucauugugagcucc

SEQ ID NO: 26292 - RNA, 381 nt, Artificial Sequence
  derived and/or modified sequence opt3 from anti-HIV-1_HeavyChain
cagguguacauggagcaagccggcgacgggaugaagaaacccggagcuagcaugaccgucuccugcaagacagcagaugaagacaucuucgaugccgcguauaugcacuggguuagacaggcuccuggucagacuuuugaguggcugggcuggaugaaaccagugacgggggccguaaacuacgcaaggcaguuccaaggacgggugucuuuuuaucgcacccgagaacucggcauugccuacauggaccuucgugaucugaaguucgacgauacagcugucuauuuuugugcaagaaaaacuaagggugacgugucaggggaugacaggggauucuuuuucgauuuguggggccggggcacccgcguuauagugaguagc

SEQ ID NO: 26293 - RNA, 381 nt, Artificial Sequence
  derived and/or modified sequence opt3 from anti-HIV-1_HeavyChain
caggugcaacugguccagagcggcgccgagguuaagaaacccggggcuuccgugacccucucuugcaagacagcagacgaagauguauucgacgccgcguacaugcacugggugagacaggcucagggacaaacuuuugaguggcuugguuggaugaaaccugucacgggcgccgugaacuaugcaaggaaguuccaggggcggguuucauuuuaccgcacccgagaacugggaaucgccuauauggauuugcguaauuuaagauucgacgauacagcuguguacuuuugugcaaggaaaacugccggcgacgucaguggugauaagcggggguucuuuuucgaccuguggggacgcggcagcagagugauuguauccucu

SEQ ID NO: 26294 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucaacuacgcaaggaaguuccagggccgggugucuuuuuaucgcacccgagaacuugguaucgccuacauggaucugcguaauuugagauucgacgauacagcuguuuauuuuugugcaaggaaaacugccggggacgugucaggagauaagcggggcuucuuuuucgacuuauggggccgcgggagucaagucauugugagcucc

SEQ ID NO: 26295 - RNA, 381 nt, Artificial Sequence
  derived and/or modified sequence opt3 from anti-HIV-1_HeavyChain
caggugcaacugguccagagcggcgccgagguuagaaagcccggggcuuccgugaaaguaucuugcaaggcaucaggauacaccuucacaaacuauuacaugcacugggugaggcaggccccuggucagggccucgaauggaucgggugggucaaaauugugaguggaacuguuaauuuugcgagccuugacuuccggaaccgcauaucccugucucgagaucgugacuugucgacggcuuauauggauaucagaggcuuaacccaagacgauacagccacuuacuuuugugcaaggcagaaguucgccucacgguauagcggugaccaggggaguuacuuugaucuguggggacgcggcacccuaauuguggucuccucu

SEQ ID NO: 26296 - RNA, 381 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggaaccgucaacuacgcccgcaaauuucagggccgagugagcuucuaucguacaagagaacuggguaucgcguacauggauuugaggaauuuacgguuugacgauacugcuguuuauuucugugcccgcaagaccgcaggggacguguccggagauaaaagaggcuuuuucuuugaccuguggggcagggggucucgggucauugugucguca

SEQ ID NO: 26297 - RNA, 381 nt, Artificial Sequence
  derived and/or modified sequence opt3 from anti-HIV-1_HeavyChain
cugauccaccucgcccagagcggcgcugaggugaagaaacccggggcauccgucacccuuucuugcaagacagccgacgaagauguuuucgacgcggcuuacaugcauugggugagacaagccccuggacagacuuuugaguggcuggguuggaugaaaccaguaacgggcgcagugucauaugccaggaaguuccaggggcgggucaguuuuuacaugacccgcgaauugggaauggcuuauauggauuuacgaaaccugcguuucgacgauacagcaguguacuuuugugccagaaaaacugcuggcgacguuagcggugauaauaggggguauuucuuugaccuauggggacggggcucccgcgugauugucucuucg

SEQ ID NO: 26298 - RNA, 381 nt, Artificial Sequence
  derived and/or modified sequence opt3 from anti-HIV-1_HeavyChain
caggugcaacugguccagagcggcgccgagguuaagaaacccggggcuuccaugaccgugucuugcaagacagcagacgaagauaucuucgacgccgcguacaugcacuggguaagacaggcuccuggacagacuuuugaguggcucgguuggaugaaaccagugacgggcgccgucaacuaugcaaggcaauuccaggggcgggugucauuuuaccgcacccgagaacuuggaauugccuauauggaucugcgugacuugaaguucgaugacacagcuguuuacuuuugugcaagaaaaacuaagggcgaugugaguggugacgauaggggguucuuuuucgacuuauggggacggggcacccgcgucauagugagcucc

SEQ ID NO: 26299 - RNA, 381 nt, Artificial Sequence
  derived and/or modified sequence opt3 from anti-HIV-1_HeavyChain
cagguguacauggagcaaggcagagggggagucaagaaacccggugccagcguuacccuguccugcaagacagcugacgaagauguguucgacgcagccuauaugcacuggguaaggcaggcgccuggccagacuuuugaguggcucggguggaugaaaccagugacgggagcugucaacuacgcccggaaguuccagggccgcgugucuuuuuaucgaacccgugaacuugguaucgcauacauggaucugagaaauuugagguucgacgauacagccguuuauuuuugugcucggaaaacugcaggggacgugucaggagauaagcgcggcuucuuuuucgacuuauggggcagagggaguagggucauugugagcucc

SEQ ID NO: 26300 - RNA, 381 nt, Artificial Sequence
  derived and/or modified sequence opt3 from anti-HIV-1_HeavyChain
cagguguacauggagcaagccggcgggggaaugaagaaacccggugcuagcaugaccgucuccugcaagacagcagacgaagauguuuucgacgccgcguauaugcacugggugagacaggcuccuggccagacuuuugaguggcugggguggaugaaaccaguaacgggagccgugaacuacgcaaggcaguuccaaggccgggucucuuuuuaucgcacccgagaacucgguaucgccuacauggaucuucgugaccugaagucagaugacacagcuguguauuucugugcaagaaaaacugccggggauguuaguggagacaagaggggcuuuuucuuugauuuguggggccgggggagccgcgugauugucuccucu

SEQ ID NO: 26301 - RNA, 381 nt, Artificial Sequence
  derived and/or modified sequence opt3 from anti-HIV-1_HeavyChain
caggugcaacugguccagagcggcgccgagguuaagaaacccggguccucuaucaaggugucaugcaaagcuaguggagacaccauuagcagauacgcaauaaacuggguaaggcaggccccuggucagggccucgaauggaucgggugggugaagacagucacuggagcggugaauuucggcucccuugauuuucggcaccgcauuucucugacgcgagaccgugauuuguucaccgcucauauggguaucagaggguuaacacaaggagacacugccaccuauuuuugugcaaggcagaaauucgagucgcgguacacaggcggccaggggugguauuuugaucuguggggacgcgguacccacauuguugugucaagc

SEQ ID NO: 26302 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauaucuucgacgccgcguauaugcacugggugagacaggcuccuggccagacuuuugaguggcucggguggaugaaaccaguaacgggagccgugaacuacgcaaggaaguuccagggccgggucucuuuuuaucgcacccgagaacuugguauugccuacauggaucugcguaauuugagauucgacgauacagcuguguauuuuugugcaaggaaaacugccggggacguuucaggagauaagcggggcuucuuuuucgacuuauggggccgcgggaguagagugauagucagcucc

SEQ ID NO: 26303 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucaacuacgcaaggaauuuccagggccgggugucuuuuuaucgcacccgagaacuugguaucgccuacauggaucugcguaacuugagauucgacgauacagcuguuuauuuuugugcaaggcaaaaguucgagucacgguacaguggggaccagggaagcuauuuugauuuauggggccgcggcacucugauuauaguguccucu

SEQ ID NO: 26304 - RNA, 381 nt, Artificial Sequence
  derived and/or modified sequence opt3 from anti-HIV-1_HeavyChain
cagguguacauggagcaagccggcgggggagucaagagacccggugcuagcguuacccuguccugcaaaacagcagacgaagauguguucgacgccgcguauaugcacuggguaaggcaggcuccuggccagacuuuugaguggcucggguggaugaagccagugacgggagccgucaacuacgcacggaaauuccagggccgcgugucuuuuuaucgaacccgugaacuugguaucgccuacauggaucugagaaauuugagguucgacgauacagcuguuuauuuuugugcacggaagacugccggggacgugucaggagauaaacgcggcuucuuuuucgacuuauggggcagagggaguagggucauugugagcucc

SEQ ID NO: 26305 - RNA, 381 nt, Artificial Sequence
  derived and/or modified sequence opt3 from anti-HIV-1_HeavyChain
caggugcaacugguccagagcggcgacgagguuaagaaacccggggccuccgugacccucucuugcaagacagcugaugaagacguauucgaugcagccuacaugcacugggugagacaggcgccuggacagacuuuugaguggcuugguuggaugaaaccagucacgggcgcugugaacuaugccaggaaguuccaagggcggguuucauuuuaccgcacccgagaacugggaaucgcauauauggacuugcguaauuuaagauucgaugacacagccguguacuuuugugcuaggaaaacugcaggcgaugucaguggugacaagcggggguucuuuuucgaucuguggggacgcggcagcagagugauuguauccucu

SEQ ID NO: 26306 - RNA, 381 nt, Artificial Sequence
  derived and/or modified sequence opt3 from anti-HIV-1_HeavyChain
caggugcaacugguccagagcggcgccgggguuaagaaacccggauccucugugaagguaucaugcaaagcuagugguggcaccuucagcuccuacgcaaucaacuggcucagacaggugccugggcagaggccagaguggaugggauggauucggccgaagacaggcgcccgcaaucaagcgcgacaguuucagccccguauaucucuuacuagagacagggcucugucgacggccuauuuggauuuaaacucacugaccagcgcagacagugguacauacuucugugcccggcagacuuuuaaaccugauuucuauuuugcugaccaagggugguccuucaaucuauggggacgcggcgcacacuuuaucgucucuagc

SEQ ID NO: 26307 - RNA, 381 nt, Artificial Sequence
  derived and/or modified sequence opt3 from anti-HIV-1_HeavyChain
cagguguacauggagagagccggcgggggagucaagaaacccggugcuagcguuacccuguccugcgaaacagcagacgaggauguguucgacgccgcguauaugcacuggguaaggcaagcuccuggccagacuuuugaauggcucggguggaugaagccagugacgggagccgucaacuacgcacggaaauuccagggccgcgugucuuuuuaucgaacccgugagcuugguaucgccuacauggaucugagaaauuugagguucgacgauacagcuguuuauuuuugugcacggaagacugccggggacgugucaggagauaaacgcggcuucuuuuucgacuuauggggcagagggaguagggucauugugagcucc

SEQ ID NO: 26308 - RNA, 381 nt, Artificial Sequence
  derived and/or modified sequence opt3 from anti-HIV-1_HeavyChain
cagguguacauggagcaagccggcgcugggaugaagaaacccggagcaagcaugaccgucuccugcaagacagccgacgaagauaucuucgacgcggcuuauaugcacuggguuagacaggccccuggucagacuuuugaguggcugggcuggaugaaaccagugacgggggcaguaaacuacgccaggcaguuccaaggacgggugucuuuucuccaggaucagggcauucgcauagcuuauauggaccuucgagaucugaaguucgacgauaccgcagucuacuuuugugcccguaaaacaaagggugacgugucaggggaugacagaggauucuuuuucgauuuguggggcaggggcacucggguuaucgugaguagc

SEQ ID NO: 26309 - RNA, 381 nt, Artificial Sequence
  derived and/or modified sequence opt3 from anti-HIV-1_HeavyChain
cagguguacaugggcgccgggagaggaggugucaagaaacccggcgcuagcguuacccuguccugcaagacagcagacgaggauguguucgacgccgcguauaugcacuggguaaggcaagcuccugggcagacuuuugaauggcucggauggaugaaaccagugacgggcgccgucaacuacgcacggaaguuccagggucgcgugucuuuuuaucgaacccgugagcuugggaucgccuacauggaucugagaaauuugagguucgacgauacagcuguuuauuuuugugcacggaaaacugccggagacgugucaggcgauaagcgcggcuucuuuuucgacuuaugggggagaggaaguagggucauugugagcucc

SEQ ID NO: 26310 - RNA, 381 nt, Artificial Sequence
  derived and/or modified sequence opt3 from anti-HIV-1_HeavyChain
cagguguacauggagcaagccggcgcuggggucaagaaacccggagcaagcguuacccuguccugcaagacagccgacgaagauguguucgacgcggcuuauaugcacuggguaagacaggccccuggucagccauuugaguggcucggcuggaugaaaccggugacuggggcagucucuuacgccaggaaguuccagggacgggugucauuuuauaugacgcgcgaacuuggcauggcuuacauggaucugcgaaacuugcguuucgacgauaccgcaguuuauuuuugugccagaaaaacagcuggugacgugaguggggauaauaggggauacuucuuugacuuauggggccggggcagccgcgucaucguguccucu

SEQ ID NO: 26311 - RNA, 381 nt, Artificial Sequence
  derived and/or modified sequence opt3 from anti-HIV-1_HeavyChain
caggugcaacugguccagagcggcgccgagguuaagaaacccggggcuuccgugaagaucucuugcaaagcaucaggauacaccuucauuagacacgguauacauuggcucaggcagguaccuggccagcggccagaauggaugggguggauccgcccgaagacaggagcccgaaaccaagcgcgucaguuucagcccagaauuagucuugcuagggaccgggcccugagcacugcauauuuggauuuaaauucccugacgucugccgacucgggcaccuacuucugugcucgccagacauuuaaaccugauuucuauuuugcagaccaagguuggucauucaaccuaugggggagaggagcccacuuuaucgugagcagu

SEQ ID NO: 26312 - RNA, 381 nt, Artificial Sequence
  derived and/or modified sequence opt3 from anti-HIV-1_HeavyChain
caggugcugcucguccaaagcggcgccgagguuaagaaacccggguccucugugaagguaucaugcaaagcuaguggagacagccuuaccaaguacgcauucuccugggugagacaggccccuggucagggcccagaauggaugggguggaucaggccgaaaacaggagcgcggaaccgcgcucgacaguuucaaccccguauuucucugacuagagauagggccuugucgacggcauauuuagaccuaaauucacugaccagcgccgauaguggcacauacuucugugcucggcagacuuuuaagccugacuucuauuuugcagaucaggguugguccuucaaccucugggggcgcggagcccacuuuauagucucuagc

SEQ ID NO: 26313 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuaggggccagacuuuugaguggcucggguggaugaaaccugugacgggagccgucaacuacgcacggaaguuccagggccgcgugucuuuuuaucgaacccgugaacuugguaucgccuacauggaucugagaaauuugagguucgacgauacagcuguuuauuuuugugcacggaaaacugccggggacgugucaggagauaagcgcggcuucuuuuucgacuuauggggcagagggaguagggucauugugagcucc

SEQ ID NO: 26314 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucaacuacgcaaggaaguuccagggccgggugucuuuuuaucgcacccgagaacuugguaucgccuacauggaucugcguaauuugagauucgacgauacagcuguuuauuuuugugcaaggaaaacugccggggacgugucaggagauaaccggggcuacuucuuugacuuauggggccgcgggaguagagucauugugagcucc

SEQ ID NO: 26315 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucaacuacgcaaggaaguuccagggccgggugucuuuuuaucgcacccgagaacuugguaucgccuacauggaucugcguaauuugagauucgacgauacagcuguuuauuuuugugcaaggaaaacugccggggacgugucaggagauaagcggggcuucuuuuucgacuuauggggcccggggagucgcgucauugugagcucc

SEQ ID NO: 26316 - RNA, 381 nt, Artificial Sequence
  derived and/or modified sequence opt3 from anti-HIV-1_HeavyChain
cagguguacauggagcaagccggcgggggaaugaagaaacccggugcuagcaugaccgucuccugcaagacagcagacgaagauaucuucgacgccgcguauaugagauggguuaggcaggcuccuggccagacuuuugaguggcugggguggaugaaaccagugacgggagccguaaacuacgcacggcaguuccaaggccgcgugucuuuuuaucgaacccgugaacucgguauugccuacauggaucuuagagaccugaaguucgaugacacagcugucuauuuuugugcaaggaaaacuaagggggaugugucaggagacgaucggggcuucuuuuucgacuuguggggccgcgggaccagaguuauagugaguagc

SEQ ID NO: 26317 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucucuuacgcaaggaaguuccagggccgggugucauuuuauaugacccgcgaacuugguauggccuaccuggauuugcgaaacuuacguuucgacgauacagcuguuuauuuuugugcaagaaaaacugccggggacgugaguggagauaauaggggcuacuucuuugaccuguggggccgggggagccgcgucaucguguccucu

SEQ ID NO: 26318 - RNA, 381 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacagguuauuacaugcacugggugagacaggccccuggccaggggcucgaauggaucggaugggucaagacugugacgggcgcgguuaacuuugguagucuugacuucaggcaucggauuagccugacccgcgaucgagacuuguuuacagcucacauggauauacguggguuaacucaaggagacaccgccacauauuucugugcaagacagaaauuugaguccagguacaccggcggccaggggugguauuucgaucuguggggacgggguacucauaucguggucucuucg

SEQ ID NO: 26319 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaucaaaccagugacgggagccgucaacuacgcaaggaaguuccagggccgggugucuuuuuaucgcacccgagaacuugguauugccuacauggaucugcguaauuugagauucgacgauacagcuguuuauuuuugugcaaggaaaacugccggggacgugucaggagauaagcggggcuucuuuuucgacuuauggggccgcgggaguagagucauagugagcucc

SEQ ID NO: 26320 - RNA, 381 nt, Artificial Sequence
  derived and/or modified sequence opt3 from anti-HIV-1_HeavyChain
cagguguacauggagcaagccggcgggggaaugaagaaacccggugcuagcgucaccguuuccugcaagacagcagacgaagauaucuucgacgccgcguauaugcacugggugagacaggcuccuggccagacuuuugaguggcugggguggaugaaaccaguaacgggagccgugaacuacgcaaggcaguuccaaggccgggucucuuuuuaucgcacccgagaacucgguauugccuacauggaucuucgugaccugaaguucgaugacacagcuguguauuuuugugcaagaaaaacuaagggggauguuucaggagacgauaggggcuucuuuuucgacuuguggggccgggggacccgcgugauagucaguagc

SEQ ID NO: 26321 - RNA, 381 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuccaaggcagagcucauucauugggugaggcaggccccuggucagggccuugaauggauaggguggguaaaaaccgugacaggagcggucaacuucggcucucuggauuuucggcaccgcaucucguugacucgagaccgugauuuauucacggcucauauggacauuagaggucugacccagggggauacagccacuuacuuuugugcaaggcaaaaguucgagucacgguauaccggaggccagggcugguacuuugaccuaugggggcgcggaacacacaucgugguuagcagu

SEQ ID NO: 26322 - RNA, 381 nt, Artificial Sequence
  derived and/or modified sequence opt3 from anti-HIV-1_HeavyChain
cagguguacauggaggccggcagagggggagucaagaaacccggugcuagcgcaacccuguccugcaagacagccgacgaagauguuuucgacgcggcuuauaugcacugggugaggcaagccccuggccagacuuuugaguggcucggguggaugaaaccaguaacgggagcagugucuuacgcccggaaguuccagggccgcgucucauuuuauaugacccgagaacuugguauggcuuacauggaucugcguaacuugagauucgacgauacagcaguguauuuuugugccaggaaaacugcuggggacguuaguggagauaaucggggcuacuucuuugacuuauggggccgcgggagcagagugaucgucuccucu

SEQ ID NO: 26323 - RNA, 381 nt, Artificial Sequence
  derived and/or modified sequence opt3 from anti-HIV-1_HeavyChain
agaugcaucuggaggcaggccggcgggggagugaagaaacccggugcuagcgucacccuguccuguaagacagcagacgaggauguuuucgacgccgcguacaugcacugggugcggcaagcuccuggccagacuuuugaauggcucggguggaugaaaccaguaacgggagccgugucuuaugcacgcaaguuccagggccgagucucauuuuacaugacccgugagcuugguauggccuauauggaucugagaaacuugagguucgacgauacagcuguguacuuuugcgcacggaaaacugccggggacguuaguggagauaaucgcggcuauuucuuugacuuauggggcagagggagcagggugauugucuccucu

SEQ ID NO: 26324 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaucaaaccagugacgggagccgucucuuacgcaaggaaguuccagggccgggugucauuuuauaugacccgcgaacuugguauggccuacauggaucugcgaaacuugcguuucgacgauacagcuguuuauuuuugugcaagaaaaacugccggggacgugaguggagauaauaggggcuacuucuuugacuuauggggccgggggagccgcgucauuguguccucu

SEQ ID NO: 26325 - RNA, 384 nt, Artificial Sequence
  derived and/or modified sequence opt3 from anti-HIV-1_HeavyChain
cagagccaccuggagcaauccggcucugccaugaagaaacccggggcuucagugaagaguagcugcuggaccuccgaagacaucuucgauacaacugagcucauuuacugggucagacaggcaccuggacagggucuugaauggauaggcuggguuaaaaucgugucugggacgguaaacuuugccucgcuggacuucaggaaucggauuucauugagccgcgaucgagacuuaaguaccgcguauauggauauccguggacugacacaggacgauacugcuaccuacuuuugugccagacaaaaguucgcauccagguauucuggcgaccaggguagcuacuuugaucuaugggggcggggaacacucauuguggucuccuca

SEQ ID NO: 26326 - RNA, 381 nt, Artificial Sequence
  derived and/or modified sequence opt3 from anti-HIV-1_HeavyChain
agaugccuguggaggcaggccggcgggggaaugaagaaacccggugcuagcaugaccguguccuguaagacagcagacgaggaugucuucgacgccgcguacaugcacuggguucggcaagcuccuggccagacuuuugaauggcucggguggaugaaaccagugacgggagccguaaacuaugcacgcaaguuccagggccgagugucuuuuuaccguaccagagagcuugguaucgccuauauggaucugaggaauuugcgguucgacgauacagcugucuacuuuugcgcacgcaaaacugccggggacgugucaggagauaagagaggcuucuuuuucgacuuauggggcagggggagucggguuauugugagcucc

SEQ ID NO: 26327 - RNA, 381 nt, Artificial Sequence
  derived and/or modified sequence opt3 from anti-HIV-1_HeavyChain
agaugcaucugggagagggccggcgggggaaugaagaaacccggugcuagcaugaccguguccuguaagacagcagacgaagauauuuucgacgccgcguacaugcacuggguccggcaggcuccuggccaaacuuuugaguggcugggguggaugaaaccaguuacgggagccgugaacuaugcacgccaguuccagggccgaguaucuuuuuaccguaccagagaacucgguauagccuauauggaucuuagggaccugaaguucgaugacacagcuguguacuuuugcgcacggaaaacuaagggggaugucucaggagacgaucgcggcuucuuuuucgacuuguggggcagagggaccagggugaucguuaguagc

SEQ ID NO: 26328 - RNA, 381 nt, Artificial Sequence
  derived and/or modified sequence opt3 from anti-HIV-1_HeavyChain
caggugcaacuggagcaggccggcgggggagucaagaaacccggugcuagcguuacccucuccugcaagacagcagacgaagauguguucgacgccgcguacaugcacuggguaagacaggcuccuggccagacuuuugaguggcuuggguggaugaaaccagugacgggagccgucaacuaugcaaggaaguuccaaggccgggugucuuuuuaccgcacccgagaacuggguaucgccuauauggauuugcguaauuuaagauucgacgauacagcuguuuacuuuugugcaaggaaaacugccggggacgugucaggagauaagcggggcuucuuuuucgaccuguggggccgcgggaguagagucauugugagcucc

SEQ ID NO: 26329 - RNA, 381 nt, Artificial Sequence
  derived and/or modified sequence opt3 from anti-HIV-1_HeavyChain
cagguguacauggagcaagccggcgggggaaugaagaaacccggugcuagcaugaccgucuccugcaagacagcagacgaagauguuuucgacgccgcguauaugcacugggugagacaggcuccuggccagacuuuugaguggcugggguggaugaaaccaguaacgggagccgugaacuacgcaaggaaguuccagggccgggucucuuuuuaucgcacccgagaacucgguaucgccuacauggaucuucguaaucugagauucgacgauacagcuguguauuuuugugcaaggaaaacugccggggacguuucaggagauaagcggggcuucuuuuucgacuuguggggccgcgggaguagagugauugucagcucc

SEQ ID NO: 26330 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugagauggguaaggcaggcuccuggccagacuuuugaguggcucggguggaugaaaccagugacgggagccgucucuuacgcacggaaguuccagggccgcgugucauuuuauaugacccgagaacuugguauggccuacauggaucugcguaacuugagauucgacgauacagcuguuuauuuuugugcaaggaaaacugccggggacgugaguggagauaaucggggcuacuucuuugacuuauggggccgcgggagcagagucaucguguccucu

SEQ ID NO: 26331 - RNA, 381 nt, Artificial Sequence
  derived and/or modified sequence opt3 from anti-HIV-1_HeavyChain
cagguguacauggagcaacccggcgggggagucaagaaaccuggugccagcguuacccuguccugcaagacagcugacgaagauguguucgacgcagccuauaugcacuggguaagacaggcgccaggccagacuuuugaguggcucggguggaugaaaccggugacgggagcugucucuuacgccaggaaguuccagggccgggugucauuuuauaugacccgcgaacuugguauggcauacauggaucugcgaaacuugcguuucgacgauacagccguuuauuuuugugcuagaaaaacugcaggggacgugaguggagauaauaggggcuacuucuuugacuuauggggccgggggagccgcgucaucguguccucu

SEQ ID NO: 26332 - RNA, 381 nt, Artificial Sequence
  derived and/or modified sequence opt3 from anti-HIV-1_HeavyChain
cagguguacauggagcaagccggcggggaagucaagaaacccggagcuagcguuacccuguccugcaagacagcagacgaggauguguucgacgccgcguauaugcacuggguaagacaggcuccuggucagacuuuugaauggcucggcuggaugaaaccagugacgggggccgucucuuacgcaaggaaguuccagggacgggugucauuuuauaugacccgcgagcuuggcauggccuacauggaucugcgaaacuugcguuucgacgauacagcuguuuauuuuugugcaagaaaaacugccggugacgugaguggggauaauaggggauacuucuuugacuuauggggccggggcagccgcgucaucguguccucu

SEQ ID NO: 26333 - RNA, 381 nt, Artificial Sequence
  derived and/or modified sequence opt3 from anti-HIV-1_HeavyChain
caggugcaacugguccagagcggcgccgagguuaagaaacccggggcuuccgugagaguaucuugccaggcaucaggauacaucuucaccgguuauuuugugaacuggcucaggcagcuuccuggccaacggccagaauggaugggguggauucgcccgaagaguggagcccgaaaucaggcgcgucaguuccagcccagaauaagccugacaagggaccgggcuuuguccacugccuacuuagauucuaacucgcugacgucagcagacagcggcaccuauuuuugugcccgccaaacauucaaaccugauuuuuacuucgcugaccaggguuggaguuuuaaucuaugggggagaggagcacacuucaucgucuccucu

SEQ ID NO: 26334 - RNA, 381 nt, Artificial Sequence
  derived and/or modified sequence opt3 from anti-HIV-1_HeavyChain
ggcugcaucuggacccaggccgggggaggugugaagaaacccggcgcuagcgucacacuguccuguaagacugcagacgaggauguuuucgacgccgcguacaugcacugggugagacaagcuccugggcagacguuugaauggcucggauggaugaaaccaguaaccggcgccgugucuuaugcaaggaaguuccagggucgggucucauuuuacaugacacgcgagcuugggauggccuauauggaucugcgaaacuugcguuucgacgauacugcuguguacuuuugcgcaagaaaaaccgccggagacguuaguggcgauaauaggggcuauuucuuugacuuaugggggcggggaagccgcgugauugucuccucu

SEQ ID NO: 26335 - RNA, 381 nt, Artificial Sequence
  derived and/or modified sequence opt3 from anti-HIV-1_HeavyChain
agaugcaucuggaggcaggccggcgggggaaugaagaaacccggugcuagcaugaccguguccuguaagacagcagacgaggauauuuucgacgccgcguacaugcacuggguccggcaagcuccuggccagacuuuugaauggcugggguggaugaaaccaguuacgggagccgugaacuaugcacgccaguuccagggccgaguaucuuuuuaccguaccagagagcucgguauagccuauauggaucuuagggaccugaaguucgaugacacagcuguguacuuuugcgcacggaaaacuaagggggaugucucaggagacgaucgcggcuucuuuuucgacuuguggggcagagggaccagggugaucguuaguagc

SEQ ID NO: 26336 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugagugggugggguggaugaaaccagucacgggagccgugucuuacgcaaggaaguuccagggccggguuucauuuuauaugacccgcgaacucgguauggccuacauggaucuucgaaaccugcguuucgacgauacagcuguguauuuuugugcaagaaaaacugccggggacgucaguggagauaauaggggcuacuucuuugacuuguggggccgggggagccgcgugaucguauccucu

SEQ ID NO: 26337 - RNA, 381 nt, Artificial Sequence
  derived and/or modified sequence opt3 from anti-HIV-1_HeavyChain
cagguguacauggagcaagccggcgggggagucaaggaacccggugcuagcguuacccuguccugcaaaacagcagacgaggauguguucgacgccgcguauaugcacuggguaagacaggcuccuggccagacuuuugaauggcucggguggaugaagccagugacgggagccgucaacuacgcaaggaaauuccagggccgggugucuuuuuaucgcacccgagagcuugguaucgccuacauggaucugcguaauuugagauucgacgauacagcuguuuauuuuugugcaaggaagacugccggggacgugucaggagauaaacggggcuucuuuuucgacuuauggggccgcgggaguagagucauugugagcucc

SEQ ID NO: 26338 - RNA, 381 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucaagaccgagcucauucauugggugaggcaggcaccuggucagggccuugaauggauaggguggguaaaaacagugacuggagccgucaacuuuggcucccuggauuuccggcaccgcaucucuuugacgcgagaccgugauuuauuuaccgcgcauauggacauuagaggucugacacagggggauacugcuaccuacuucugugccaggcaaaaguuugagucgcgguauacaggaggccagggcugguacuucgaccuaugggggcgcggaacccacaucgugguuucaagc

SEQ ID NO: 26339 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggaugaagacaguaacuggagccgugaacuuuggcucccuggauuuccgccaccgaaucucuuugacgcgugacagagauuuauuuaccgcgcauauggacauuaggggucuggcucagggggauacagccacuuacuucugugcacggcaaaaauuugaaucgcgcuauaccggaggccagggcugguacuucgaccuaugggggagaggaacacacaucgucgugucaagc

SEQ ID NO: 26340 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagccuggauuuccgccaccgaaucuccuugacccgugacagagauuuauuuacagcgcauauggacauuaggggucugacucagggggauaccgcuacauacuucugugcccggcaaaaauuugaaucucgcuauaccggaggccagggcugguacuucgaccuaugggggagaggaacucacaucgugguuucguca

SEQ ID NO: 26341 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcguauauggauaucagaggacugacacaggacgauacugcuaccuacuuuugugccaggcaaaaauucgcaagucgguauuccggcgaccaggguucuuacuuugaucuaugggggcgcggaacacucauugucgugagcucc

SEQ ID NO: 26342 - RNA, 384 nt, Artificial Sequence
  derived and/or modified sequence opt3 from anti-HIV-1_HeavyChain
agccacaccuggaacaauagaggcuccgccaugaagaaacccggggcuucugugagggucucaugcuggacaagugaggacaucuucgauacuacggaacugauuuacuggguucggcaggcaccuggacaaggucucgaguggauaggcugggugaagaucguaagcgggaccgugaacuuugccucccuugacuuccgcaaucgaauuucucugucgcgugauagagacuugucaacagcguauauggauaucaggggauuaacucaggacgauaccgcuacauacuuuugugcccggcagaaauucgcaagccgcuauaguggcgaccaggguuccuacuuugaucugugggggagaggaacccuaauugucgugucuagc

SEQ ID NO: 26343 - RNA, 381 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuuccauaacgagcucauuuacuggguuaggcaggcaccuggacagggucuugaauggauaggcugggugaagaucguauccgggacagugaauuuugccucucuggauuuccggaaccgcauuucguugucacgagaccgugauuuaagcacugcguauauggacaucagaggacugacgcaggaugacaccgcuacauacuuuugugccaggcaaaaauucgcaagucgguauuccggcgaucaggguucuuacuuugaccuaugggggcgcggaacucucauugucgugagcucc

SEQ ID NO: 26344 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggaugaagacuguaacgggagccgugaacuuuggcagccuggauuuccgccaccgaaucuccuugacccgugacagagauuuauuuacagcgcauauggacauuaggggucugacucagggggauaccgcuacauacuucugugcccggcaaaaauuugaaucucgcuauaccggaggccagggcugguacuucgaccuaugggggagaggaacucacaucgucgugucguca

SEQ ID NO: 26345 - RNA, 381 nt, Artificial Sequence
  derived and/or modified sequence opt3 from anti-HIV-1_HeavyChain
cagguguucauggagcaagccggcggggaagucaagaaacccggagcuagcaugaccguuuccugcaagacagcagacgaggauguguuugacgccgcguacaugcacuggguaagacaggcuccuggucagacuuucgaauggcugggcuggaugaaaccagugacgggggccgucaacuaugcaaggcaguuucaaggacgggugucuuucuaccgcacccgagagcucggcaucgccuauauggaucuucgugaccugaaguuugaugacacagcuguuuacuucugugcaagaaaaacuaagggugaugugucaggggacgauaggggauuuuucuuugacuuguggggccggggcacccgcgucauugugaguagc

SEQ ID NO: 26346 - RNA, 381 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgaggaugaacuuauucauugggugaggcaggcacccggucagggccuggaguggauaggguggguaaagaucgugagcggaacagucaacuuugccuccuuggacuuccggaaucgcauuucuuuaucgcgagaucgugaccugucaacugcguacauggauaucagaggccuaacgcaggacgauaccgcuacauauuuuugugccaggcaaaaauucgcaagccgguacaguggugaccagggguccuauuuugaucucuggggacgcggcacucugauugugguuucuagc

SEQ ID NO: 26347 - RNA, 381 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacauccucaaggcagagcuuauuuacuggguuaggcaggccccuggacggggucuggaauggauaggcugggugaaaacaguauccgggacugugaacuucggaucuucggauuuucgcaaucgaaucucauugacgcgugacagagauuuaagcaccgcgcauauggacauuaggggccugacacaggaugacacugcuaccuauuucugugcccggcagaaguuugagagucuauacuccgaugaccaagguucuuauuucgaucucugggggcgcggaacacugaucauugucagcucc

SEQ ID NO: 26348 - RNA, 381 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaguuucaccgacuauuacauccacuggcucagacaggugcagggucaaaggccugaauggaugggcuggauucggccacgcacaggggcccgaaaccaggcgcgucaguuucagccgagaauaagccuuacuagggaucgggcucuguccacggccuauuuggacuuaaauucucugaccucggcagauucaggaacauacuucugugcccgccaaacuuuuaagcccgacuucuauuuugcugaucagggcuggagcuucaaccuaugggguagaggggcacauuuuaucgucaguucc

SEQ ID NO: 26349 - RNA, 381 nt, Artificial Sequence
  derived and/or modified sequence opt3 from anti-HIV-1_HeavyChain
cagguguucauggagcaagccggcggggaagucaagaaacccggagcuagcaugaccguuuccugcaagacagcagacgaggauguguuugacgccgcguacaugcacuggguaagacaggcuccuggucagacuuucgaauggcugggcuggaugaaaccagugacgggggccgucaacuaugcaaggaaguuucagggacgggugucuuucuaccgcacccgagagcucggcaucgccuauauggaucuucgugaccugaaauuugaugacacagcuguuuacuucugugcaagaaagacuaagggugaugugucaggggacgauaggggauuuuucuuugacuuguggggccggggcacccgcgucauugugaguagc

SEQ ID NO: 26350 - RNA, 384 nt, Artificial Sequence
  derived and/or modified sequence opt3 from anti-HIV-1_HeavyChain
caggcccaccuggagcaaagcggcgcuggggugaagaaacccggagcauccgucagaguuucuugcuggaccucagaagacaucuucgagaggacagaacucauucauugggugcggcaggccccuggucagggccuugaguggauaggguggguaaagacugugacgggagcggucaacuuuggcagucuggauuuccgccaccgaaucagcuugacccgugacagagauuuauuuacagcucauauggacauuaggggucugacucagggggauaccgccacauacuucugugcacggcaaaaauuugaaucccgcuauaccggaggccagggcugguacuucgaccuaugggggagaggaacucacaucgugguuucuucg

SEQ ID NO: 26351 - RNA, 384 nt, Artificial Sequence
  derived and/or modified sequence opt3 from anti-HIV-1_HeavyChain
caggcccaccuggagcaaagcggcgcuggggugaagaaacccggagcauccgucagaguuucuugcuggucaagugaagacaucuucgagaggaccgaacucauucauugggugcggcaggccccuggucagggccuugaguggauaggguggguaaagacagugacuggagcggucaacuuuggcagccuggauuuccgccaccgaaucuccuugacgcgugacagagauuuauuuaccgcucauauggacauuaggggucugacacagggggauacugccaccuacuucugugcacggcaaaaauuugaaucucgcuauacaggaggccagggcugguacuucgaccuaugggggagaggaacccacaucgugguuucguca

SEQ ID NO: 26352 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcugggcaagcgaagacaucuucgauaccacagagcucauuuacuggguuaggcaggccccuggacagggucuugaauggauaggcugggugaagaucguauccgggacugugaacuuugcgucucuggacuuccggaaucgcauuucguugucacgagaucgugacuuaagcacggcuuauauggauaucagaggacugacccaggacgauacagccacuuacuuuugugcaaggcaaaaauucgccagucgguauuccggcgaccaggguucuuacuuugaucuaugggggcgcggaacccucauugucgugagcucc

SEQ ID NO: 26353 - RNA, 381 nt, Artificial Sequence
  derived and/or modified sequence opt3 from anti-HIV-1_HeavyChain
agaugcaggcuggugcagagcggcgccgaggucaagaaacccggggcuuccguucgggugucuugucaagcaucaggauacaccuucagugccuaugguguaaacugggugcgccaggcgccuggccaggaacucgaguggaucgggugggucaagacagugacuggagcuguuaauuuuggcagcccaaacuuccgacaccguauuucccuuacgagagacagggaucuguuuaccgcccauauggacauacgggguuugacacagggggauacugcaaccuacuucugcgcccgccaaaaauuugaaucuagauauacaggaggccagggcugguacuucgacuuaugggggaggggaacccacaucguggucucguca

SEQ ID NO: 26354 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugugucaggcaccuggucagggccuugaguggauaggguggguaaagacagugacuggagccgucaacuuuggcucccuggauuuccggcaccgcaucucuuugacgcgagaccgugauuuauuuaccgcgcauauggacauuagaggucugacacagggggauacugcuaccuacuucugcgccaggcaaaaauuugaaucgcgguauacaggaggccagggcugguacuucgaccuaugggggcgcggaacccacaucgugguuucaagc

SEQ ID NO: 26355 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagaucgugacaggagccgucaacuuuggcucccuggauuuccgccaccgaauuucuuugacucgugacagagauuuauuuacggcgcauauggacaucaggggucugacccagggggauacagcuacuuacuucugugcccggcaaaaauuugaaucgcgcuauaccggaggccagggcugguacuucgaccuaugggggagaggaacacacauugugguuucaagc

SEQ ID NO: 26356 - RNA, 384 nt, Artificial Sequence
  derived and/or modified sequence opt3 from anti-HIV-1_HeavyChain
caggugcaacugguccagagcggccucgagguuaagaaacccggggccuccgugagaguaucuugcuggaccucagaagacaucuucgauacaacugagcuuauuuacugggugaggcaggcuccuggacagggucuggaauggauaggcugggucaagaucgugagugggacgguuaacuuugccagcuuggacuuccggaaucgcauuuccuuaucucgagaucgugaccugucgaccgcacacauggauaucagaggacuaacacaagacgauacugcgaccuauuuuugugcuaggcagaaauucgccucacgguacagcggcgaccaggguaguuauuuugaucucugggggcgcggaacacugauuaucguguccucu

SEQ ID NO: 26357 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugaggcaggacgauacagcuacuuauuuuugugcccggcaaaaauucgagagucgcuacuccggcgaccaggguucuuauuuugaucuaugggggagaggaacccucauuaucgucagcucc

SEQ ID NO: 26358 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugcaucacgguauagcggagaccagggcaguuacuucgaucuguggggccgcgggacacuaauuguuguguccucu

SEQ ID NO: 26359 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugaaucucgcuauaccggaggccagggcugguacuucgaucugugggggagaggaacucacauuguugugucguca

SEQ ID NO: 26360 - RNA, 384 nt, Artificial Sequence
  derived and/or modified sequence opt3 from anti-HIV-1_HeavyChain
agacacaccugggagcagagcggcuccggggugaagaaacccggagccucugucaggguuucaugcuggacaagugaagacaucuucgaaaagagcgagcugauucauugggugcggcaagcuccuggucagggccucgaguggauaggguggguaaaaacugugacgggagcagucaacuuuggcuccucugauuuccgccagcgagugucgcuuacccgugacagagaucugucaacagccuacauggacaucagggguuugacucaggaugacaccgcgacauauuuuugugcucggcaaaaguucgccagccgcuacaguggggaucagggauccuauuuugacuuauggggcagaggcacccugauuguugugucuagc

SEQ ID NO: 26361 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcguauauggauaucagaggacugacacaggacgauacugcuaccuacuuuugugccaggcaaaaauucgagagucgguauacaggcggucaggggugguacuuugaccuauggggacgcggcacccauauugucguguccucu

SEQ ID NO: 26362 - RNA, 384 nt, Artificial Sequence
  derived and/or modified sequence opt3 from anti-HIV-1_HeavyChain
caggugcaacugguccagagcggcgccgagguuaagaaacccggggcuuccgugagaguaucuugcuggaccucagaagacaucuucgauacaacugagcucauuuacugggugaggcaggcaccuggacagggucuugaauggauaggcugggucaagaucgugagugggacgguuaacuuugccagccuggacuuccggaaucgcauuuccuugucucgagaucgugacuuaucgaccgcgcacauggauaucagaggacugacacaagacgauacugcuaccuauuuuugugccaggcagaaauucgagucacgguacacaggcggucaggggugguauuuugaccuauggggacgcggcacccauauuguggucagcagu

SEQ ID NO: 26363 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcguauauggauaucagaggacugacacagggcgacacugcuaccuacuuuugugccaggcaaaaauucgagagucgguauacaggugggcagggaugguacuuugaucuauggggccgcggcacccauauugucguguccucu

SEQ ID NO: 26364 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccagauuuccgccaccgaaucucucugucgcgugacagagauuugucaacggcgcauauggacauuagggguuuaacccaggaugacacagcuacuuacuuuugugcccggcaaaaauucgcaagccgcuauaguggggaucagggauccuacuuugaccuguggggcagaggcacccuaaucauugugucuagc

SEQ ID NO: 26365 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucgcggccuugaguggauaggguggguaaagacugugagcggaacggucaacuuuggcuccucugauuuccgaaaucgugugucgcugaccagagacagggauuugucaacagcccacauggacauccgggguuuaacucaggaugacaccgcgacauacuuuugugcucgccagaaauucgaaagccuguauagugaugaccaaggguccuacuuugaucuauggggaagaggcacccucauuaucguuucuagc

SEQ ID NO: 26366 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgcaaccgaaucucccugacccgugauagagacuugucuacagcgcacauggauauuagggguuuaacucaggacgauaccgcuacauacuuuugugcccggcaaaaauucgaaucgcuguauucagacgaucaggggagcuacuuugaccuauggggacgcggcacccucaucauugugaguucc

SEQ ID NO: 26367 - RNA, 384 nt, Artificial Sequence
  derived and/or modified sequence opt3 from anti-HIV-1_HeavyChain
cagagccaccuggagcaauccggcucugccaugaagagacccggggcuucagugagggucaguugcuggaccagcgaagacaucuucgauacaacugagcucauuuacuggguucggcaggcaccuggacagggucuugaauggauaggcugggugaaaaucguauccgggacggugaacuuugccucucuggacuuccgcaaucgaauuucguugucacgugauagagacuuaagcaccgcguauauggauaucaggggacugacacaggacgauacugcuaccuacuuuugugcccggcaaaaguucgcaagucgcuauuccggcgaccaggguucuuacuuugaucuaugggggagaggaacacucauugucgugagcucc

SEQ ID NO: 26368 - RNA, 384 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgcaaucgaaucucuuuaucgcgugacagagaucugucaacugcuuauauggacauuaggggucuaacgcaggaugacaccgccacauacuucugugcacggcaaaaauuugccagccgcuauaguggggaucagggauccuacuucgaccucuggggcagaggcacucugaucgugguuucuagc

SEQ ID NO: 26369 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagccuggauuuccgccaccgaaucuccuugacccgugacagagacuuuuucacagcgcauauggauauuagggguuuaacucagggggauaccgcuacauacuuuugugcccggcaaaaauucgaaucucgcuauaccggaggccagggcugguacuuugaccugugggggagaggaacucacaucgugguuucguca

SEQ ID NO: 26370 - RNA, 381 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucaggaccgagcucauucauugggugcggcaggcaccuggucagggccuugaauggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugagucgcgcuauacaggaggccagggcugguacuucgaccuaugggggagaggaacccacaucgugguuucaagc

SEQ ID NO: 26371 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugaaucucuguauucggaugaccagggaucauacuucgaucuauggggccgcggcacccucauuaucguuagcagu

SEQ ID NO: 26372 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgcaagucgguacuccggcgaccaggguucuuauuuugaucuaugggggcgcggaacacucauuaucgucagcucc

SEQ ID NO: 26373 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucuucggacuuccggaaucgcauuucacugagccgagaucgugacuugaguaccgcgcauauggauaucagaggauuaacacaggacgauacugcuaccuauuuuugugccaggcaaaaauucgcaucccgguacucuggcgaccaggguagcuauuuugaucugugggggcgcggaacacuaauugucguguccuca

SEQ ID NO: 26374 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauuuacugggugcggcaggcaccuggucgcggccuugaguggauaggguggguaaagacugugagcggaacggucaacuuuggcuccucugauuuccgaaaucguaucucgcugaccagagacagggauuugucaacagcccauauggacauucgggguuuaacucaggaugacaccgcgacauauuuuugugcucgccagaaauucgaaagccuguacagugaugaccaaggguccuauuuugaucuauggggaagaggcacccucaucauugugucuagc

SEQ ID NO: 26375 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauucauuggguuaggcaggcaccuggacagggucuugaauggauaggcugggugaagacgguaaccggggccgugaacuuuggaucccuggacuuccggcaccgcaucucuuugacacgagaucgugacuuauuuacugcgcauauggauauuagaggccugacccagggugacacagcuaccuacuucugugccaggcaaaaauuugagucgcgguauacugggggacagggcugguacuucgaucuauggggccgcgggacacacaucgucgugucaagc

SEQ ID NO: 26376 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucggaacaacugagcucauuuacuggguuaggcaggcaccuggucagggccuugaauggauagggugggugaagaucguauccggaacggugaacuuugccucucuggauuuccggaaucgcauuucguugucacgagaccgugauuuaagcaccgcguauauggacaucagaggccugacacaggaugacacugcuaccuacuuuugugccaggcaaaaauucgcaagucgguauuccggugaucaggggucuuacuuugaccuauggggacgcggcacacucauugucgugagcucc

SEQ ID NO: 26377 - RNA, 384 nt, Artificial Sequence
  derived and/or modified sequence opt3 from anti-HIV-1_HeavyChain
caggugcaacugguccagagcggcuccgccaugaagaaacccggggcuucuguuagagugucaugcuggaccagugaggacaucuucgauacaacugaacucauuuacuggguaaggcaggcaccuggacagggucuugaguggauaggcugggugaagaucgucagcgggacggugaacuuugccucccuggacuuccggaaucgcauuucuuugucgcgagaucgugacuuaucaaccgcguauauggauaucagaggacugacacaagacgauacugcuaccuacuuuugugccaggcagaaauucgcaagccgguauaguggcgaccaggguuccuacuuugaucuaugggggcgcggaacacucauuguugugucuagc

SEQ ID NO: 26378 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagguaucuucgagaggacagaacucauucauugggugcggcaggcaccuggccaggggcuugaguggauaggauggguaaagacugugacgggcgccgucaacuuugguagccuggacuuccgccaccgaaucuccuugacccgugauagagacuuauuuacagcgcauauggauauuagggggcugacucagggagacaccgcuacauacuucugugcccggcaaaaauuugaaucucgcuauaccggcggccaggggugguacuucgaucuauggggaagagguacucacaucgugguuucguca

SEQ ID NO: 26379 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggcacggcaggccccuggucagggccuugaguggauagggugggugaagacuguaacgggagcggugaacuuuggcagcccaaauuuccgccaccgagcuucccugacccgugauagagacuuguuuacagcccauauggauaucagggguuuaacugaaggggacaccgcaacauacuucugugcccggcagaaauuugcuucucgcuauucgggagaucaaggcucauacuucgaccuguggggcagagggacccuaauuaucgucagcagu

SEQ ID NO: 26380 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacagcagagcucauuuacuggguuaggcaggccccuggacagggucuugaauggauaggcugggugaagaucguauccgggacugugaacuuugcgucucuggacuuccggaaucgcauuucguugucacgagaucgugacuuaagcacggcucauauggauaucagaggacugaggcaggacgauaccgccacauauuuuugugcacggcaaaaauucgagagucgcuacuccggcgaccaggguucuuauuuugaucuaugggggagaggaacucucauuaucgucagcucc

SEQ ID NO: 26381 - RNA, 384 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauagaauggguaaaggccgugagcggggcggucaacuacggauccuuggauuuucgccaccgagugucuuuaacucgugacagagaucuguucacggcucauauggacaucaggggccuaacccaggaugacacagccacuuauuuuugugcacggcaaaaauucgagucgcgcuacaccggugggcagggaugguauuuugaucucuggggcagaggcacacacauuguugugucaagc

SEQ ID NO: 26382 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcguauauggauaucagaggacugacacaggacgauacugcuaccuacuuuugugccaggcaaaaauucgcaagucgguauuccggcgaccaggguucuuacuuugaucuaugggggcgcggaacacucgacugcgucagcucc

SEQ ID NO: 26383 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccggggccgugaacuuugcgucucuggacuuccggaaucgcauuucguugucacgagaucgugacuuaagcacggcucauauggauaucagaggacugacccaggacgauacagccacuuauuuuugugcaaggcaaaaauucgccagucgguacuccggcgaccaggguucuuauuuugaucuaugggggcgcggaacccucauuaucgucagcucc

SEQ ID NO: 26384 - RNA, 384 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccagggggauacagccacuuauuucugugcacggcaaaaauuugaaucacgcuacaccggaggccagggcugguauuucgaccucugggggagaggaacacacauuguugugagcagu

SEQ ID NO: 26385 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuugucaaccgcgcacauggacaucagagguuuaacacaagaugacacugcuaccuacuuuugugccaggcagaaguucgaaagccuguauagugaugaccagggguccuacuuugaucuauggggacggggcacacucauuaucguuucuagc

SEQ ID NO: 26386 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggaaccgucaacuuuggcagccugaauuuccgccaccgaaucuccuugacacgugauagagacuuauuuacugcccauauggauauuaggggucugacccagggggacacagcgaccuacuucugugcucggcaaaaauuugaaucucgcuauacuggaggccagggcugguacuucgaucuaugggggagaggaacacacaucgugguuucguca

SEQ ID NO: 26387 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagaucguauccgggacugugaacuuugccucucuggauuuccgaaaucguauuucguugucaagagacagggauuuaagcacggcgcauauggacauccggggacugacccaggaugacacagcuacuuauuuuugugcccgccagaaauucgcaaguagauacuccggcgaucaagguucuuauuuugaccuaugggggaggggaacccucauuaucgucagcucc

SEQ ID NO: 26388 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcguauauggauaucagaggacugacacaggacgauacugcuaccuacuuuugugccaggcaaaaauucgcaagucgguauuccggcgaccaggguucuuacuuugaucuaugggggcgcggaacacucauuaucgucagcucc

SEQ ID NO: 26389 - RNA, 384 nt, Artificial Sequence
  derived and/or modified sequence opt3 from anti-HIV-1_HeavyChain
caggccagacuggagcaaagcggcuccggggugaagaaacucggagcuucugucaggguuucaugcuggaccagugaagacaucuucgagcggacagaacuuauucacugggugcgccaggcacccggucagggccuggaguggauaggguggguaaaggccgugagcggagcggucaacuacggcuccuuggauuuucgaaaucguaucucuuuaucgagagacagggaucugucaacugcuuauauggacauucggggucuaacgcaggaugacaccgccacauacuucugugcacgccaaaaauuugccagcagauauaguggggaucagggauccuacuucgaccucuggggcaggggcacucugaucgugguuucuagc

SEQ ID NO: 26390 - RNA, 384 nt, Artificial Sequence
  derived and/or modified sequence opt3 from anti-HIV-1_HeavyChain
caggcccaccuggagcaaagcggcuccgcuaugaagaaacccggggcaucugugagagucucaugcuggaccagugaagacaucuucgauacaacugagcucauuuacuggguuaggcaggccccuggacagggucuugaauggauaggcugggugaagaucguaagcgggacggugaacuuugcgucccuggacuuccggaaucgcauuucuuugucgcgagaucgugacuuaucaaccgcucauauggauaucagaggacugacacaggacgauacugccaccuauuuuugugcaaggcaaaaauucgccagccgguacaguggcgaccaggguuccuauuuugaucuaugggggcgcggaacacucauuaucgucucuagc

SEQ ID NO: 26391 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuaucgaccgcguacauggacauuaggggucugacacaggaugacacugcuaccuauuuuugugcccggcaaaaauucgcaucacgcuacagcggggaucagggaaguuauuuugaccuauggggcagaggcacacucaucgugguuuccucu

SEQ ID NO: 26392 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgcgaacuuuggcucccuggauuuccgccaccgaaucucuuugacgcgugacagagauuuauuuaccgcucauauggacauuaggggucugacacagggggauacugccaccuacuucugugcacggcaaaaauuugaaucgcgcuauacaggaggccagggcugguacuucgaccuaugggggagaggaacccacaucgucgugucaagc

SEQ ID NO: 26393 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggagcgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaaucgcgcuauacaggaggccagggcugguacuucgaccuaugggggagaggaacccacaucgugguuucaagc

SEQ ID NO: 26394 - RNA, 381 nt, Artificial Sequence
  derived and/or modified sequence opt3 from anti-HIV-1_HeavyChain
agaugcaucuggaggcaggccggcgggggagugaagaaacccggugcuagcgucacccuguccuguaagacagcagacgaggauguuuucgacgccgcguacaugcacugggugcggcaagcuccuggccagacuuuugaauggcucggguggaugaaaccaguaacgggagccgugucuuaugcacgcaaguuccagggccgagucucauuuuacaugacccgugguauuagaauggccuauauggaucuuaggaaccugcgguucgacgauacagcuguguacuuuugcgcacgcaaaacugccggggacguuaguggagauaauagaggcuauuucuuugacuuguggggcagggggagccgggugauagucuccucu

SEQ ID NO: 26395 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagaucguauccgggacugugaacuuugccucucuggauuuccgaaaucguauuucguugucaagagacagggauuuaagcacggcguauauggacauccggggacugacccaggaugacacagcuacuuacuuuugugcccgccagaaauucgcaaguagauauuccggcgaucaagguucuuacuuugaccuaugggggaggggaacccucauugucgugagcucc

SEQ ID NO: 26396 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauucauuggguucggcaggcaccuggacagggucuugaguggauaggcugggugaagacuguaacgggggccgugaacuuuggaucccuggauuuccgccaccgaaucucuuugacccgugacagagauuuauuuacagcgcauauggacauuaggggccugacucagggugauaccgcuacauacuucugugcccggcaaaaauuugaaucgcgcuauaccgggggacagggcugguacuucgaccuauggggcagagggacucacaucgucgugucaagc

SEQ ID NO: 26397 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcgcggcucauauggauaucagaggacugacccaggacgauacagccacuuauuuuugugcaaggcaaaaauucgccagucgguacuccggcgaccaggguucuuauuuugaucuaugggggcgcggaacccucauuaucgucagcucc

SEQ ID NO: 26398 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuugcaucgcgcuauucaggagaucagggcagcuacuucgaccuguggggcagagggacccuaaucguugugaguucc

SEQ ID NO: 26399 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucuguacacggcaaaaauuugaaucgcgcuauaccggaggccagggcugguacuucgaccuaugggggagaggaacucacaucgugguuucaagc

SEQ ID NO: 26400 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggcccagaguggauaggguggguaaagacagugacuggagccgucaacuuuggcucccuugauuuccgccaccgaaucucucugacgcgugacagagauuuguuuaccgcgcauauggacauuagggguuuaacacagggggauacugcuaccuacuucugugcccggcaaaaauuugaaucgcgcuauacaggaggccagggcugguacuucgaccugugggggagaggaacccacaucgugguuucaagc

SEQ ID NO: 26401 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcccacuggauuuccgccaccgaaucuccuugacgcgugacagagauuuauuuaccgcgcauauggacauuaggggucugacacagggggauacugcuaccuacuucugugcccggcaaaaauuugaaucucgcuauacaggaggccagggcugguacuucgaccuaugggggagaggaacccacaucgugguuucguca

SEQ ID NO: 26402 - RNA, 384 nt, Artificial Sequence
  derived and/or modified sequence opt3 from anti-HIV-1_HeavyChain
cagagccaccuggagcaauccggccccgccaugaagaaaccuggggcuucugugagagucucaugcuggaccagugaagacaucuucgagaggacagaacucauuuacuggguucggcaggcaccaggacgcggucuugaguggauaggcugggugaagacuguaagcgggacggugaacuuuggauccucugauuuccgaaaucguaucucgcugaccagagacagggauuugucaacagcccauauggacauucggggcuuaacucaggaugacaccgcgacauauuuuugugcucgccagaaauucgaaagccuguacagugaugaccaagguuccuauuuugaucuaugggggagaggaacccucaucauugucucuagc

SEQ ID NO: 26403 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucguggauuaagcaccgcgcauauggacaucagaggccugacacaggaugacacugcuaccuauuuuugugccaggcaaaaauucgcaagucgguacuccggugaucaggggucuuauuuugaccuauggggacgcggcacacucauuaucgucagcucc

SEQ ID NO: 26404 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugcaucgcgcuauucaggagaucagggcagcuacuucgaccuguggggcagagggacacuaauuaucguuaguucc

SEQ ID NO: 26405 - RNA, 384 nt, Artificial Sequence
  derived and/or modified sequence opt3 from anti-HIV-1_HeavyChain
cagagccaccuggagcauuccggcucugccaugaagaaacccggggcuucagugagagucaguugcuggaccagcgaagacaucuucgauacaacugagcucauuuacuggguuaggcaagcaccuggacagggucuugaauggauaggcugggugaagaucguauccgggacggugaacuuugccucucuggacuuccggaaucgcauuucguugucacgagaucgugacuuaagcaccgcguauauggauaucagaggacugacacaggacgauacugcuaccuacuuuugugccaggcagaaauucgcaagucgguauuccggcgaccaagguucuuacuuugaucuaugggggcgcggaacacucauugucgugagcucc

SEQ ID NO: 26406 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuugaaucgcuguauucagaugaccagggaagcuacuucgaucuauggggccgcggcacccucaucauuguuaguucc

SEQ ID NO: 26407 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgaaucucucugacgcgugauagagacuuguuuaccgcgcauauggauauuagggguuuaacacagggggacacugcuaccuacuucugugcccggcaaaaauuugaaucgcgcuauacaggaggccagggcugguacuucgaucugugggggagaggaacccacaucgugguuucaagc

SEQ ID NO: 26408 - RNA, 384 nt, Artificial Sequence
  derived and/or modified sequence opt3 from anti-HIV-1_HeavyChain
caggcccaccuggagcaaagcgcuuccggcgugagaaggcccggggcaucuguccggguuucaugcuggaccagugaagacaucuucgagcgcagcgaacucauuuacugggugcgacaggccccuggacguggucuugaguggauaggcuggaucaagcugguauccggggcggugaacuuuggaucugucgauuucagaaauaggauuucguugucacgggaccgcgauuuaagcacagcucauauggacaucagaggccugaggcaggaugacacugccacguauuuuugugcacggcagaaauucgaaagucgcuacuccggugaucaagggucuuauuuugaccuauggggacgaggcacccucauuaucgugagcucc

SEQ ID NO: 26409 - RNA, 384 nt, Artificial Sequence
  derived and/or modified sequence opt3 from anti-HIV-1_HeavyChain
caggcccaccuggagcaaagcgcuuccggcgugaagagacccggggcaucugucaggguuucaugcuggaccagugaagacaucuucgagcggacagaacucauuuacugggugcgccaggccccuggacagggucuugaguggauaggcuggguaaaaacugugagcggggcggucaacuuuggaucccaggauuuccgagaccguuuuucucugacgagagauagggacuugucgaccgcucauauggauauccggggcuuaacacaagacgauacugccaccuauuucugugcacgccagaaguuugccucaagauacagcggugaccaggggaguuauuucgaucuguggggaaggggcacacuaauuaucguguccucu

SEQ ID NO: 26410 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcucccuggauuuccggcaccgcaucucuuugacgcgagaccgugauuuauuuaccgcgcauauggacauuagaggucugacacagggggauacugcuaccuacuucugugccaggcaaaaguuugaaucgcgguauacaggaggccagggcugguacuucgaccuaugggggcgcggaacccacaucgugguuucaagc

SEQ ID NO: 26411 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacaggacgauacugcuaccuacuucugugcccggcaaaaauuugaaucgcuguauucagacgaucaggggagcuacuucgaccuauggggacgcggcacacucauuaucguuaguucc

SEQ ID NO: 26412 - RNA, 384 nt, Artificial Sequence
  derived and/or modified sequence opt3 from anti-HIV-1_HeavyChain
cagagccaccugaagcaauccggcucugccaugaaaaagcccggggcuucagugagagucaguugcuggaccagcgaggacaucuucgaaaggacagagcucauuuacuggguucggcaggcaccuggacgcggucuugaauggauaggcugggugaaaacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaguucgagagucuguacuccgaugaccaagguucuuauuuugaucuaugggggagaggaacccucaucauugucagcucc

SEQ ID NO: 26413 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuaucgaccgcgcauauggacauuaggggucugacacaggaugacacugcuaccuacuuuugugcccggcaaaaauucgcaucacgcuauagcggggaucagggaaguuacuuugaccuauggggcagaggcacacucaucauuguguccucu

SEQ ID NO: 26414 - RNA, 384 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccacuuauuuuugugcacggcaaaaauucgaaucgcgcuacaccgggggacagggcugguauuuugaucucuggggcagagggacacacauuguugugucaagc

SEQ ID NO: 26415 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucaggacgauaccgcuacauacuucugugcccggcaaaaauuugaaucucuguauucggacgaucaggggucauacuucgaccuauggggacgcggcacccucauuaucguuagcagu

SEQ ID NO: 26416 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacauccucgagaggacagaacuuauuuacuggguucggcaggcaccuggacgcggucuggaguggauaggcugggugaagacuguauccgggacggugaacuucggaucuucggauuuucgaaaucguaucucauugaccagagacagggauuuaagcacagcccauauggacauucggggccugacucaggaugacaccgcgacauauuucugugcucgccagaaauuugaaagucuauacuccgaugaccaagguucuuauuucgaucucugggggagaggaacccugaucauugucagcucc

SEQ ID NO: 26417 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccagcgagugucccugacccgugauagagacuuguuuacagcgcacauggauaucagggguuuaacucaaggggacaccgcuacauacuucugugcccggcagaaauuugcaucucgcuauucgggagaucagggcucauacuucgaccuguggggcagagggacccuaauuguugugagcagu

SEQ ID NO: 26418 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgaaucucccugacccgugauagagacuuguuuacagcgcauauggauauuagggguuuaacucagggggacaccgcuacauacuucugugcccggcaaaaauuugaaucucgcuauaccggaggccagggcugguacuucgaucugugggggagaggaacucacaucgugguuucguca

SEQ ID NO: 26419 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugacgauaucuucgaaaggacagagcucauucauugggugcggcaggcaccuggucagggccuugaauggauaggguggguaaagacugugacgggagccgucaacuuuggcagcccaaauuuccgccagcgagugucccugacccgugacagagauuuguuuacagcgcacauggacaucagggguuuaacucaaggggauaccgcuacauacuucugugcccggcagaaauuugagucucgcuauaccggaggccagggcugguacuucgaccugugggggagaggaacucauauuguugugucguca

SEQ ID NO: 26420 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgcaagucgguacuccggcgaccaggguucuuauuuugaucuaugggggcgcggaacacucauugucgugagcucc

SEQ ID NO: 26421 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgcaaccgaaucucccugucucgugauagagacuugucgaccgcgcacauggauauuagggguuuaacacaggacgauacugcuaccuacuuuugugcccggcaaaaauucgcaucacgcuauagcggggaccagggaaguuacuuugaucuguggggcagaggcacacuaaucauuguguccucu

SEQ ID NO: 26422 - RNA, 384 nt, Artificial Sequence
  derived and/or modified sequence opt3 from anti-HIV-1_HeavyChain
caggcccaccuggagcaaagcgcuuccggcgugaagagacccggggcaucugucaggguuucaugcuggaccagugaagacaucuucgagcggacagaacucauuuacugggugcgccaggccccuggacagggucuugaguggauaggcuggguaaaaacugugacgggggcggucaacuuuggaagccuggauuuccgacaucguaucuccuugaccagagacagggauuuauuuacagcucacauggacauucggggccugacucagggugauaccgccacauauuucugugcacgccaaaaguuugaaucuagauacaccgggggacagggcugguauuucgaccuauggggcagggggacucauaucgugguuucguca

SEQ ID NO: 26423 - RNA, 384 nt, Artificial Sequence
  derived and/or modified sequence opt3 from anti-HIV-1_HeavyChain
caggcccaccuggagcaaagcgcuuccggcgugagaaggcccggggcaucuguccggguuucaugcuggaccagugaagacaucuucgagcgcagcgaacucauuuacugggugcgacaggccccuggacguggucuugaguggauaggcuggaucaagcugguauccggggcggugaacuuuggaucugucgauuucagagacagggugucguugacacgggaucgcgacuuauuuacugcucauauggauauuagaggccugacgcaggacgauaccgccacauauuucugugcaaggcagaaauuugccucacgguacagcggugaccaagggaguuauuucgaucuauggggacgcggcacucucaucauuguuuccucu

SEQ ID NO: 26424 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggaacggucaacuuugccucccuggauuuccgcaaucgaaucucuuugucgcgugacagagauuuaucaaccgcguacauggacauuaggggccugacacaggaugacacugcuaccuauuuuugugcccggcaaaaauucgcaagccgcuacaguggugaucagggguccuauuuugaccuauggggaagaggcacacucaucgugguuucuagc

SEQ ID NO: 26425 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgaaucucucugucgcgugauagagacuugucaacggcguacauggauauuagggguuuaacccaggacgauacagcuacuuauuuuugugcccggcaaaaauucgcaagccgcuacaguggggaccagggauccuauuuugaucuguggggcagaggcacccuaaucgugguuucuagc

SEQ ID NO: 26426 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuccaacgcgugacagagauuuguuuaccgcgcauauggacauuagggguuuaacacagggggauacugcuaccuacuucugugcccggcaaaaauuugaaucgcgcuauacaggaggccagggcugguacuucgaccugugggggagaggaacccuaaucgugguuucaagc

SEQ ID NO: 26427 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaccaaccgcguauauggauaucagaggacugacacaggacgauacugcuaccuacuuuugugccaggcaaaaauucgcaagccgguauaguggcgaccaggguuccuacuuugaucuaugggggcgcggaacacucauugucgugucuagc

SEQ ID NO: 26428 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucgccuccgggacgguaaacuuugcgucucuggacuuccggaaucgcauuucguugucacgagaucgugacuuaagcaccgcucauauggauaucagaggacugacacaggacgauacugccaccuauuuuugugcaaggcaaaaauucgccagucgguacuccggcgaccaggguucuuauuuugaucuaugggggcgcggaacacucauuguggucagcucc

SEQ ID NO: 26429 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagacgguaaccggggccgugaacuuuggaucccuggacuuccggcaucgcaucucuuugacacgagaucgugacuuauuuacugcgcacauggauauuagaggccugacccagggugacacagcuaccuauuucugugccaggcaaaaauuugagucgcgguacacugggggacagggcugguauuucgaucuauggggccgcgggacacauaucgucgugucaagc

SEQ ID NO: 26430 - RNA, 384 nt, Artificial Sequence
  derived and/or modified sequence opt3 from anti-HIV-1_HeavyChain
caggugcaacugguccagagcggcgccgagguuaagaaacccggggcuuccgugagaguaucuugcuggaccucagaagacaucuucgauacaacugagcucauuuacugggugaggcaggcaccuggacagggucuugaauggauaggcugggucaagaucgugagugggacgguuaacuuugccagccuggacuuccggaaucgcauuuccuugucucgagaucgugacuuaucgaccgcgcacauggauaucagaggacugaggcaagacgauacagcuacuuauuuuugugcccggcagaaauucgagucacgcuacagcggcgaccaggguaguuauuuugaucuaugggggagaggaacccucauuaucguguccucu

SEQ ID NO: 26431 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggcaucgcauuucguugacccgagaucgugacuuauuuacagcgcacauggauaucagaggacugacucagggcgacaccgcuacauauuucugugccaggcaaaaauuugagucacgguacaccggugggcagggaugguauuucgaucuauggggccgcggcacucauauugucgugagcagu

SEQ ID NO: 26432 - RNA, 384 nt, Artificial Sequence
  derived and/or modified sequence opt3 from anti-HIV-1_HeavyChain
caggcccaccuggagcaaagcgcuuccggcgugaagagacccggggcaucugucaggguuucaugcuggaccagugaagacaucuucgagcggagcgaacucauuuacugggugcgccaggccccuggacagggucuugaguggauaggcuggguaaaaacagugacuggggcggucaacuuuggaucccuggauuuccgacaucguaucucuuugacgagagacagggauuuauuuaccgcucacauggacauucggggccugacacagggugauacugccaccuauuucugugcacgccaaaaguuugaaucgagauacacagggggacagggcugguauuucgaccuauggggcagggggacccauaucgugguuucaagc

SEQ ID NO: 26433 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugaaucacuguauagcgacgaucagggaaguuacuucgaccuauggggccggggcacacucauuaucguuuccucu

SEQ ID NO: 26434 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaauucgaaagucuguacuccgaugaccaagguucuuauuuugaucuaugggggagaggaacccucaucgucgugagcucc

SEQ ID NO: 26435 - RNA, 384 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccagggggauacagccacuuauuuuugugcacggcaaaaauucgaaucgcgcuacaccggaggccagggcugguauuuugaccucugggggagaggaacacacauuguugugucaagc

SEQ ID NO: 26436 - RNA, 381 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacauccucaggaaaagcgagcuuauucauugggugcggcaggcaccuggucagggccuggaauggauaggguggguaaagacagugacuggagccgucaacuucggccaccagaucuccgaucgcgugucuuugacgcgagaccgugauuuaucgaccgcgcauauggacauuagaggucugacacaagaugacacugcuaccuacuuuugugccaggcagaaguucgagucacuauauagcgaugaccaggggaguuacuuugaucucuggggacggggcacacugaucauuguuuccucu

SEQ ID NO: 26437 - RNA, 384 nt, Artificial Sequence
  derived and/or modified sequence opt3 from anti-HIV-1_HeavyChain
cccgcccaccuggagcagagcggcuccggggugaagaaaccuggagcuucugucagaguuucaugcugggcaagugaagacaucuucgagaggaccgaacucauucauugggugcggcaagccccaggucagggccuugaguggauaggguggguaaagacagugacuggagcggucaacuuuggcagccuggauuuccgccaccgaaucuccuugacgcgugacagagauuuauuuaccgcucauauggacauuaggggucugacacagggggauacugccaccuacuucugugcacggcagaaauuugaaucucgcuauacaggaggccaaggcugguacuucgaccuaugggggagaggaacccacaucgugguuucguca

SEQ ID NO: 26438 - RNA, 384 nt, Artificial Sequence
  derived and/or modified sequence opt3 from anti-HIV-1_HeavyChain
caggcccaccuggagcaaagcgcuuccggcgugaagagacccggggcaucugucaggguuucaugcuggaccagugaagacaucuucgagcggagcgaacucauuuacugggugcgccaggccccuggacagggucuugaguggauaggcuggguaaaaacaguguccggggcggucaacuuuggaucuacugauuuccgagaacguaucucgcugucaagagacagggauuugagcacggcuuauauggacauucggggcuuaacccaggaugacgccgcaacauacuuuugugcccgccaaaaguucgcuaguagauauuccggugaucaggggucuuacuuugaccuguggggaaggggcacucuaaucgugguuagcucc

SEQ ID NO: 26439 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuugcgccaccgaaucucuuuaacgcgugacagagaucuguucaccgcgcauauggacauuaggggucuaacacagggggauacugcuaccuacuuuugugcccggcaaaaauucgaaucgcgcuauacaggaggccagggcugguacuuugaccucugggggagaggaacccacaucgugguuucaagc

SEQ ID NO: 26440 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagccuggauuuccgccaccgaaucuccuugacccgugacagagauuuauuuacagcgcauauggacauuaggggucugacucagggggauaccgcuacauacuucugugcccggcaaaaauuugaaucucgcuauaccggaggccagggcugguacuucgaccuaugggggagaggaacucucaucgugguuucguca

SEQ ID NO: 26441 - RNA, 384 nt, Artificial Sequence
  derived and/or modified sequence opt3 from anti-HIV-1_HeavyChain
agccacgaccuggagcaguccggcucugccaugaagaaacccggggcuucagugagagucaguugcuggaccagcgaagauaucuucgacacaacugagcucauuuacuggguuaggcaagcaccuggacagggucuugaauggauaggcugggugaagaucguauccgggacggugaacuuugccucucuggauuuccggaaucgcauuucguugucacgagaccgugauuuaagcaccgcguauauggacaucagaggacugacacaggaugacacugcuaccuacuuuugugccaggcagaaauucgcaagucgguauuccggcgaucaagguucuuacuuugaccuaugggggcgcggaacacucauugucgugagcucc

SEQ ID NO: 26442 - RNA, 384 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugacuggagcggucaacuuuggcagcuuggauuuccgccaccgaaucuccuuaacgcgugacagagaucuguuuaccgcucauauggacauuaggggucuaacacagggggauacugccaccuacuucugugcacggcaaaaauuugaaucucgcuauacaggaggccagggcugguacuucgaccucugggggagaggaacccacaucgugguuucguca

SEQ ID NO: 26443 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugcaucucgcuauucgggagaucagggcucauacuucgaccuguggggcagagggacccuaauuguugugagcagu

SEQ ID NO: 26444 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucuucggacuuccggaaucgcauuucacugagccgagaucgugacuugaguaccgcgcauaugggaaucagaggcuuaaggcaggaugacacagcuacuuauuuuugugcccggcaaaaauucgagucccgcuacucuggugaucaggggagcuauuuugaccuguggggaagaggcacccuaauuaucgucuccuca

SEQ ID NO: 26445 - RNA, 384 nt, Artificial Sequence
  derived and/or modified sequence opt3 from anti-HIV-1_HeavyChain
gaggugcagcugguccaaagcggcgccgacguuaagaaacccggggcuuccgugagaguaucuugcuggaccucagaagauaucuucgacacaacugagcucauuuacugggugaggcaggcaccuggacagggucuugaauggauaggcugggucaagaucgugagugggacgguuaacuuugccagccuggauuuccggaaucgcauuuccuugucucgagaccgugauuuaucgaccgcguauauggacaucagaggacugacacaggaugacacugcuaccuacuuuugugccaggcaaaaauucgcaucacgguauagcggcgaucaggguaguuacuuugaccuaugggggcgcggaacacucauuguggucuccucu

SEQ ID NO: 26446 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcaccaggcaccuggucagggccuugaguggauaggguggguaaagacagugacuggagccgucaacuuuggcucccuggauuuccggcaucgcaucucuuugacgcgagaccgugauuuauuuaccgcgcacauggacauuagaggucugacacagggggauacugcuaccuacuucugugccaggcaaaaauuugaaucgcgguauacaggaggccagggcugguacuucgaccuaugggggcgcggaacccauaucgugguuucaagc

SEQ ID NO: 26447 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugcguuaagcaccgcucauauggacaucagaggacugacacaggaugacacugccaccuauuuuugugcaaggcaaaaauucgccagucgguacuccggcgaucaggguucuuauuuugaccuaugggggcgcggaacacucauuaucgucagcucc

SEQ ID NO: 26448 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuugcgucccuggauuuccgcaaucgaaucucuuugucgcgugacagagauuuaucaacggcuuacauggacauuaggggccugacccaggaugacacagccacuuauuuuugugcacggcaaaaauucgccagccgcuacaguggugaucagggguccuauuuugaccuauggggaagaggcacccucaucgugguuucuagc

SEQ ID NO: 26449 - RNA, 384 nt, Artificial Sequence
  derived and/or modified sequence opt3 from anti-HIV-1_HeavyChain
caggcccaccuggagcaaagcgcuuccggcgugagaaggcccggggcaucuguccggguuucaugcuggaccagugaagacaucuucgagcgcagcgaacucauuuacugggugcgacaggccccuggacguggucuugaguggauaggcuggaucaagcugguauccggggcggugaacuuugcuucuuuggauuucagaaauaggauuucguuaucacgggaccgcgaucugagcacagccuauauggacaucagaggacuaacucaggaugacacggcaaccuacuuuugugccaggcagaaauucgcuagucgguauuccggcgaucaagguucuuacuuugaccucugggggcgcggaacacugauugucgugagcucc

SEQ ID NO: 26450 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacaggaugacacugcuaccuacuucugugcccggcaaaaauuugcaucgcgcuauucaggggaucagggaagcuacuucgaccuauggggcagaggcacacucaucauugugaguucc

SEQ ID NO: 26451 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuuggcuggauagggugggugaagaucguauccggaacggugaacuuugccucucuggacuuccggucgcgcauuucauugagccgagaucgugacuuaaguaccgcguauauggauaucagaggccugacacaggacgauacugcuaccuacuuuugugccaggcaaaaauucgcaucccgguauucuggugaccaggggagcuacuuugaucuauggggacgcggcacacucauugucguguccuca

SEQ ID NO: 26452 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauagggugggccaagacuguaacgggagcggugaacuuuggcagccuggauuuccgccaccgaaucuccuugacccgugacagagauuuauuuacagcucauauggacauuaggggucugacucagggggauaccgccacauacuucugugcacggcaaaaauuugaaucucgcuauaccggaggccagggcugguacuucgaccuaugggggagaggaacucacaucgucgugucguca

SEQ ID NO: 26453 - RNA, 384 nt, Artificial Sequence
  derived and/or modified sequence opt3 from anti-HIV-1_HeavyChain
caggcccaccuggagcaaagcggcuccgcuaugaagaaacccggggcaucugugagagucucaugcuggaccagugaagacaucuucgagaggacagaacucauuuacuggguucggcaggccccuggacgcggucuugaguggauaggcugggugaagacuguaagcgggacggugaacuuuggauccucugauuuccgaaaucguaucucgcugaccagagacagggauuugucaacagcgcauauggacauucggggcuuaacucaggaugacaccgcuacauauuuuugugcccgccagaaauucgaaagccuguacagugaugaccaagguuccuauuuugaucuaugggggagaggaacccucaucauugucucuagc

SEQ ID NO: 26454 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuuggaucucuggacuuccggcaucgcauuucguugacccgagaucgugacuuauuuacagcccacauggauaucagaggccugacucagggugacaccgcgacauauuucugugcuaggcaaaaauuugagucacgguacaccgggggacagggcugguauuucgaucuauggggccgcgggacucauauugucgugagcagu

SEQ ID NO: 26455 - RNA, 384 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgauacaacugagcuuauuuacugggugaggcaggcacccggucagggccuggaauggauaggguggguaaagaucgugagcggaacggucaacuuugccuccuuggacuuccggaaucgcauuucuuuaucgcgagaucgugaccugucaaccgcguauauggauaucagaggccuaacacaggacgauacugcuaccuacuuuugugccaggcaaaaauucgcaagccgguauaguggugaccagggguccuacuuugaucucuggggacgcggcacacugauugugguuucuagc

SEQ ID NO: 26456 - RNA, 384 nt, Artificial Sequence
  derived and/or modified sequence opt3 from anti-HIV-1_HeavyChain
agccacaaccuggagcaguccggcucugccaugaagaaacccggggcuucagugagagucaguugcuggaccagcgaagacaucuucgauacaacugagcucauuuacuggguuaggcaagcaccuggacagggucuugaauggauaggcugggugaagaucguauccgggacggugaauuuugccucucuggacuuccggaaccgcauuucguugucacgagaucgugacuuaagcaccgcguauauggauaucagaggacugacacaggacgauacugcuaccuacuuuugugccaggcagaaauucgcaagucgguauuccggcgaccaagguucuuacuuugaucuaugggggcgcggaacacucauugucgugagcucc

SEQ ID NO: 26457 - RNA, 384 nt, Artificial Sequence
  derived and/or modified sequence opt3 from anti-HIV-1_HeavyChain
agccacaccuggaacaauagaggcuccgccaugaagaaacccggggcuucugugagggucucaugcuggacaagugaggacaucuucgaacggacugagcugauuuacuggguucgccaggcaccuggacgaggucucgaauggauaggcugggugaagacgguaagcgggaccgugaacuuuggauccucugauuuccguaauagaaucucgcuuucaagggaccgggaucugagcacagcccauauggacauucgcggcuugacucaagaugacaccgcgacauauuuuugugcuagacagaaauucgccaguagguacuccggugaucaggggucuuauuuugacuuauggggacggggcacccugaucauugucagcucc

SEQ ID NO: 26458 - RNA, 384 nt, Artificial Sequence
  derived and/or modified sequence opt3 from anti-HIV-1_HeavyChain
agccacaccuggaacgaguccggcucugccaugaagaaacccggggcuucagugagagucaguugcuggacaagcgaagacaucuucgagaggacugaacugauuuacuggguucggcaggcaccuggacgcggucucgaguggauaggcugggugaagaucguauccgggacggugaauuuugccucucuugauuuccgaaaccguauuucgcugucaagagacagggauuugagcaccgcguauauggacauccggggauuaacacaagaugacacugcuaccuacuuuugugcccgccagaaauucgcaaguagauauuccggcgaucaggguucuuacuuugaccugugggggaggggaacacuaauugucgugagcucc

SEQ ID NO: 26459 - RNA, 384 nt, Artificial Sequence
  derived and/or modified sequence opt3 from anti-HIV-1_HeavyChain
agacacaccugggagcagagcggcuccggggugaagaaacccggagccucugucaggguuucaugcuggacaagugaagacaucuucgagcggacugaacugauucauugggugcgccaagcuccuggucagggccucgaguggauaggguggguaaagacggugaccggagcagucaacuacggcagccuuaauuuucgaucccguaucucucugacaagagauagggacuuguucacugcccacauggauauucgggguuuaacccagggggacacagcgaccuauuuuugugcucgccagaaauucgaaucgagauacacuggaggccaaggcugguauuuugaucugugggggaggggaacacauaucgugguuucaagc

SEQ ID NO: 26460 - RNA, 384 nt, Artificial Sequence
  derived and/or modified sequence opt3 from anti-HIV-1_HeavyChain
caggcccaccuggagcaaagcggcuccggggugaagaaacccggagcuucugucaagguuucaugcuggaccagugaagacaucuucgagagaacagaacucauucauugggugaggcaggcaccuggucagggccuugaguggauaggguggguaaaaacugugacgggagccgucaacuuuggcagccuggauuuccggcaccgcaucuccuugacccgagaccgugauuuauuuacagcgcauauggacauuagaggucugacucagggggauaccgcuacauacuucugugccaggcaaaaguuugaaucucgguauaccggaggccagggcugguacuucgaccuaugggggcgcggaacucacaucgugguuucguca

SEQ ID NO: 26461 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguagcgaacucauucauugggugaggcaggcaccuggccaggggcuugaguggauaggauggguaaagacagugacuggcgccgucaacuuugguuccgcguacuuccggcaccgcgugucucugacgcgagaucgugacuugucgaccgcuuauauggauaucagaggguuaacacaggacgauacugccaccuacuuuugugcaaggcaaaaauucgccucacgguauagcggagaccagggcaguuacuuugaucuguggggccgcgggacacuaauuguuguguccucu

SEQ ID NO: 26462 - RNA, 384 nt, Artificial Sequence
  derived and/or modified sequence opt3 from anti-HIV-1_HeavyChain
ggccacgaccuggagcagagcggguccggagugaagaaacccggugccucugucagaguuucaugcuggaccagugaagauaucuucgagggcagcgaacucauucauugggugaggcaagcuccugggcagggacuugaguggauaggcuggguaaagacagugacuggugcagucaacuuuggguccgccuacuuccggcaccgcaucucucugucgcgagaccgugauuugucaacggcguauauggacauuagaggauuaacccaggaugacacagcuacuuacuuuugugccaggcagaaauucgcaagccgguauaguggcgaucaaggcuccuacuuugaccugugggggcgcggaacccuaaucgugguuucuagc

SEQ ID NO: 26463 - RNA, 384 nt, Artificial Sequence
  derived and/or modified sequence opt3 from anti-HIV-1_HeavyChain
agccacaccuggaacaauagaggcuccgccaugaagaaacccggggcuucugugagggucucaugcuggacaagugaagacaucuucgauacuacggaacugauuuacuggguucggcaggcaccuggacaaggucucgaguggauaggcugggugaagaccguaagcgggacagugaacuuuggauccucugacuuccgcaaucgaaucucgcuuacucgugauagagaccugucaaccgcccauauggauauuaggggcuugacacaggacgauaccgcgacuuauuuuugugcucggcagaaauucgagagcuuauacagugacgaucaggguuccuauuuugaccugugggggcgcggaacacuaaucauugucucuagc

SEQ ID NO: 26464 - RNA, 384 nt, Artificial Sequence
  derived and/or modified sequence opt3 from anti-HIV-1_HeavyChain
agacacaccugggagcagagcggcuccggggugaagaaacccggagccucugucaggguuucaugcuggacaagugaagacaucuucgagcggacugaacugauucauugggugcgccaagcuccuggucagggccucgaguggauaggguggguaaagacggugagcggagcagucaacuuuggcuccccaaauuuccgacaccgugugucucuuaccagagauagggaccuguuuacagcccauauggauauccgggguuugacucagggggacaccgcgacauacuucugugcucgccagaaauuugaaucgagauauaccggaggccaaggcugguacuucgauuuaugggggaggggaacucacauuguugugucaagc

SEQ ID NO: 26465 - RNA, 384 nt, Artificial Sequence
  derived and/or modified sequence opt3 from anti-HIV-1_HeavyChain
agccacaccuggaacaauagaggcuccgccaugaagaaacccggggcuucugugagggucucaugcuggacaagugaggacaucuucgaacggacugagcugauuuacuggguucgccaggcaccuggacgaggucucgaauggauaggcugggugaagacgguaagcgggaccgugaacuuuggauccucugauuuccguaauagaaucucgcuuacaagggaccgggaucugucaacugcccauauggacauucgcggcuugacccaagaugacacagcgaccuauuuuugugcuagacagaaauucgagagcuuauacagugaugaccaggguuccuauuuugaucugugggggaggggaacucuaaucauugucucuagc

SEQ ID NO: 26466 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugccucgcaagcgaagacaucuucgauaccacagagcuuauuuacuggguuaggcaggccccuggacagggucuggaauggauaggcugggugaagaucguauccgggacugugaacuuugcgucuuuggacuuccggaaucgcauuucguuaucacgagaucgugaccugagcacggcuuauauggauaucagaggacuaacccaggacgauacagccacuuacuuuugugcaaggcaaaaauucgccagucgguauuccggcgaccaggguucuuacuuugaucucugggggcgcggaacccugauugucgugagcucc

SEQ ID NO: 26467 - RNA, 384 nt, Artificial Sequence
  derived and/or modified sequence opt3 from anti-HIV-1_HeavyChain
cagagccaccuggagcaauccggcgccgcuaugaagaaacccggggcaucugugagagucucaugcuggaccagugaagacaucuucgauacaacugagcucauuuacuggguuaggcaggccccuggacagggucuugaauggauaggcugggugaagaucguaagcgggacggugaacuuugcgucccuggacuuccggaaucgcauuucuuugucgcgagaucgugacuuaucaaccgcucauauggauaucagaggacugaggcaggacgauacagccacuuauuuuugugcacggcaaaaauucgagagccgcuacaguggcgaccaggguuccuauuuugaucuaugggggagaggaacccucauuaucgucucuagc

SEQ ID NO: 26468 - RNA, 384 nt, Artificial Sequence
  derived and/or modified sequence opt3 from anti-HIV-1_HeavyChain
agacacaccugggagcagagcggcuccggggugaagaaacccggagccucugucaggguuucaugcuggacaagugaagacaucuucgaaaagagcgagcugauucauugggugcggcaagcuccuggucagggccucgaguggauaggguggguaaaaacugugacgggagcagucaacuuuggcuccucugauuuccgccagcgagugucgcuuacccgugacagagaucuguuuacagcccacauggacaucagggguuugacucagggggauaccgcgacauacuucugugcucggcaaaaguuugaaucacgcuauaccggaggccagggcugguacuucgacuuaugggggagaggaacucauauuguugugagcagu

SEQ ID NO: 26469 - RNA, 384 nt, Artificial Sequence
  derived and/or modified sequence opt3 from anti-HIV-1_HeavyChain
agccacaccuggaacgaguccggcucugccaugaagaaacccggggcuucagugagagucaguugcuggacaagcgaagacaucuucgauacuacggagcugauuuacuggguuaggcaggcaccuggacaaggucucgaauggauaggcugggugaagaucguauccgggaccgugaauuuugccucucuugacuuccggaaccgcauuucgcugucacgagaucgugacuugagcacagcguauauggauaucagaggauuaacucaggacgauaccgcuacauacuuuugugccaggcagaaauucgcaagucgguauuccggcgaccaggguucuuacuuugaucugugggggcgcggaacccuaauugucgugagcucc

SEQ ID NO: 26470 - RNA, 384 nt, Artificial Sequence
  derived and/or modified sequence opt3 from anti-HIV-1_HeavyChain
agacacaccuggaacgagagcggcuccggggugaagaaacccggagccucugucaggguuucaugcuggaguagcgaagacaucuucgagcggacagaacugauucauugggugcgccaggcuccuggucgaggccucgaguggauaggguggguaaagacuguguccggaacggucaauuuugguucuucggauuuccguaacagaaucucacuuaccagggaccgggaucugagcacagcacacauggacauucgcggcuugacucaagaugacaccgccacauacuuuugugcgagacagaaauucgaaaguuuauauuccgaugaccaggggucuuacuuugaucuguggggaaggggcacccuaaucauugugagcucc

SEQ ID NO: 26471 - RNA, 384 nt, Artificial Sequence
  derived and/or modified sequence opt3 from anti-HIV-1_HeavyChain
cagagccaccuggagcaauccggcucugaaaugaagaaacccggggccucagugagagucaguugcuggaccagcgaggacaucuucgauacaacugaacucauuuacuggguuaggcaggcuccuggacagggucuugaguggauaggcugggugaagaucguauccgggacggugaacuuugcaucucuggacuuccggaaucgcauuucguugucacgagaucgugacuuaagcaccgccuauauggauaucagaggacugacacaggacgauacugcgaccuacuuuugugcuaggcaaaaauucgccagucgguauuccggcgaccaggguucuuacuuugaucuaugggggcgcggaacacucauugucgugagcucc

SEQ ID NO: 26472 - RNA, 384 nt, Artificial Sequence
  derived and/or modified sequence opt3 from anti-HIV-1_HeavyChain
agacacaccugggagcagagcggcuccggggugaagaaacccggagccucugucaggguuucaugcuggacaagugaagacaucuucgagcggacugaacugauucauugggugcgccaagcuccuggucagggccucgaguggauaggguggguaaagacggugaccggaacagucaacuuuggcagccuuaauuuccgacagcgugugucccugacuagagauagggacuuguuuaccgcacacauggauauccgggguuuaacacagggggacaccgccacuuacuucugugcgcgccaaaaauuugaaucucuguauucggaugaccagggaucauacuucgaucuauggggcagaggcacacucauuaucguuagcagu

SEQ ID NO: 26473 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggagcgaacucauucauugggugcggcaggcaccuggucagggccuugaguggauaggguggguaaagacagugacuggagccgucaacuuuggcucccagaucuuccgccaccgaauuucucugacgcgugauagagacuuguuuaccgcgcauauggauaucagggguuuaacacaaggggacacugcuaccuacuucugugcccggcagaaauuugaaucgcgcuauacaggaggccagggcugguacuucgaucugugggggagaggaacccacauugugguuucaagc

SEQ ID NO: 26474 - RNA, 384 nt, Artificial Sequence
  derived and/or modified sequence opt3 from anti-HIV-1_HeavyChain
agccacaccuggaacaaguccggcucugccaugaaaaagcccggggcuucagugagagucaguugcuggacaagcgaggacaucuucgaaaggacugagcugauuuacuggguucggcaggcaccuggacgcggucucgaauggauaggcugggugaaaacgguauccgggaccgugaauuuuggaucuucggauuuccgaaaccguaucucacuuacaagagacagggaucugagcacugcccauauggacauucggggcuugacccaagaugacacagcgaccuauuuuugugcucgccagaaguucgagaguuuauacuccgaugaccaggguucuuauuuugaucugugggggagaggaacucuaaucauugucagcucc

SEQ ID NO: 26475 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccagaucuuccgccaccgaauuucucugacgcgugauagagacuuguuuaccgcgcauauggauaucagggguuuaacacaaggggacacugcuaccuacuucugugcccggcagaaauuugaaucgcgcuauacaggaggccagggcugguacuucgaucugugggggagaggaccaacccuauuugugucaagc

SEQ ID NO: 26476 - RNA, 384 nt, Artificial Sequence
  derived and/or modified sequence opt3 from anti-HIV-1_HeavyChain
caggcccaccuggagcaaagcgcuuccggcgugagaaggcccggggcaucuguccggguuucaugcuggaccagugaagacaucuucgagcgcagcgaacucauuuacugggugcgacaggccccuggacguggucuugaguggauaggcuggaucaagacauguuccggggcgguaaacuuuggaucuguggauuucagagacagggucucgcugacucgggaucgcgacuuguuuacggcucauauggauauuagaggcuuaacccagggugacacagccacuuauuucugcgcaaggcagaaauuugaaucacgguacaccgggggacaaggcugguauuucgaucuguggggccgcgggacacacaucgugguuagcagu

SEQ ID NO: 26477 - RNA, 384 nt, Artificial Sequence
  derived and/or modified sequence opt3 from anti-HIV-1_HeavyChain
agccacaccguggagcaguccggcucugccaugaagaaacccggggcuucagucagaguuaguugcuggacaagcgaagacaucuucgauacuacggagcugauuuacugggugaggcaagcaccuggacagggucucgaauggauaggcuggguaaagaucguguccgggaccgucaacuuugccucucuugacuuccggaaucgcauuucgcugucacgagaucgugacuugagcacagcguauauggauaucagaggauuaacucaggacgauaccgcuacauacuuuugugccaggcagaaauucgcaagucgguauuccggcgaccaagguucuuacuuugaucugugggggcgcggaacccuaauugugguuagcucc

SEQ ID NO: 26478 - RNA, 384 nt, Artificial Sequence
  derived and/or modified sequence opt3 from anti-HIV-1_HeavyChain
agacacaccuggaacaagagcggcuccggggugaaaaagcccggagccucugucaggguuucaugcuggaguagcgaggacaucuucgaacggacagagcugauucauugggugcgccaggcuccuggucaaggccucgaauggauaggguggguaaaaacugugacgggagcagucaauuuuggcucccuugauuuccgacaccguaucucucugaccagagacagggauuuguuuacagcccauauggacauucgggguuuaacucagggggauaccgcgacauacuucugugcucgccagaaguuugagucgagauauaccggaggccagggcugguacuucgaccugugggggaggggaacucacaucgugguuucaagc

SEQ ID NO: 26479 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagcgccuugaguggauaggcuggguaaagacugugacgggggccgucaacuuuggaagcccaaauuuccgacaccgugugucccugaccagagauagggacuugucuacagcguacauggauauccggggcuuaacucaggacgauaccgcuacauauuuuugugcccgccaaaaauucgcaucgagauacucaggugaccaggggagcuauuuugaucuguggggaaggggcacccuaauuguugugaguucc

SEQ ID NO: 26480 - RNA, 384 nt, Artificial Sequence
  derived and/or modified sequence opt3 from anti-HIV-1_HeavyChain
agccacgaccuggagcaguccggcucugccaugaagaaacccggggcuucagugagagucaguugcuggaccagcgaagauaucuucgacacaacugagcucauuuacuggguuaggcaagcaccuggacagggucuugaauggauaggcugggugaagaucguauccgggacggugaacuuugccucucuggauuuccggaaucgcauuucguugucacgagaccgugauuuaagcaccgcgcauauggacaucagaggacugaggcaggaugacacagcuacuuauuuuugugcccggcagaaauucgagagucgcuacuccggcgaucaagguucuuauuuugaccuaugggggagaggaacccucauuaucgucagcucc

SEQ ID NO: 26481 - RNA, 384 nt, Artificial Sequence
  derived and/or modified sequence opt3 from anti-HIV-1_HeavyChain
agacacaccuggaacgagagcggcuccggggugaagaaacccggagccucugucaggguuucaugcuggaguagcgaagacaucuucgagcggacagaacugauucauugggugcgccaggcuccuggucaaggccucgaguggauaggguggguaaagacugugacgggagcagucaauuuuggcucccuugauuuccgacaccguaucucucugaccagagacagggauuuguuuacagcccauauggacauucgggguuuaacucagggggauaccacaaccuacuucugugcgcgccagaaauuugaaucgagauauacuggaggccagggcugguacuucgaccugugggggaggggaacacacaucgugguuucaagc

SEQ ID NO: 26482 - RNA, 384 nt, Artificial Sequence
  derived and/or modified sequence opt3 from anti-HIV-1_HeavyChain
agacacaccugggaacagguguggagcggcgucaagaaacccggggccuccguuagggugucuugcuggucaagugaggacaucuucgagcggacagaacugauucauuggguacgccaagcuccuggacagggucucgaguggauaggcugggugaagacugucacgggggcagugaacuuuggaagccuugauuuccgacaccguaucucccugaccagagacagggauuuguuuacagcccauauggacauucggggcuuaacucagggugauaccgcgacauacuucugugcucgccagaaauuugaaucuagauauaccgggggacaaggcugguacuucgaccuguggggcagggggacucacaucguugugucguca

SEQ ID NO: 26483 - RNA, 384 nt, Artificial Sequence
  derived and/or modified sequence opt3 from anti-HIV-1_HeavyChain
cagagccaccuggagcaauccggcucugccaugaagaaacccggggcuucagugaccgucaguugcuggacaagcgaagacaucuucgauacuacggagcucauuuacuggguuagacaggcaccuggacagggucuugaauggauaggcugggugaagaucguauccgggaccgugaacuuugccucucuggacuucaggaaucggauuucguugucacgcgaucgagacuuaagcacagcguauauggauauccguggacugacucaggacgauaccgcuacauacuuuugugccagacaaaaauucgcaaguagguauuccggcgaccaggguucuuacuuugaucuaugggggcggggaacccucauugucgugagcucc

SEQ ID NO: 26484 - RNA, 384 nt, Artificial Sequence
  derived and/or modified sequence opt3 from anti-HIV-1_HeavyChain
agacacgaccuggagcagagcggcuccggggugaagaaacccggagccucugucaggguuucaugcuggaguagcgaagauaucuucgagcggaccgaacucauucauugggugcgccaagcuccuggucagggccuugaguggauaggguggguaaagacagugacuggagcagucaacuuuggcucccuggacuuccgacaccguaucucuuugacgagagauagggacuuauuuaccgcccauauggauauucggggucugacacagggggacacugcgaccuacuucugugcucgccagaaauuugaaucgagauauacaggaggccaaggcugguacuucgaucuaugggggaggggaacccacaucgugguuucaagc

SEQ ID NO: 26485 - RNA, 384 nt, Artificial Sequence
  derived and/or modified sequence opt3 from anti-HIV-1_HeavyChain
gugaccacauggaacaagagcggcuccgccaugaaaaagcccggggcuucugucagaguuucaugcuggacuagcgaggacaucuucgauacgaccgaacugauuuacugggugaggcaggcaccuggacggggucucgaguggauaggcuggguaaaaacagugagcgggacugucaauuuuggauccucugacuuccgcaaccgaaucucgcuuacccgugauagagaccugucaacagcccacauggauauuaggggcuugacccaagacgauacugcgacauauuuuugugcucggcagaaguucgaaaguuuauacagugacgaucaggguuccuauuuugaccugugggggcgcggaacccuaaucauugugucuagc

SEQ ID NO: 26486 - RNA, 384 nt, Artificial Sequence
  derived and/or modified sequence opt3 from anti-HIV-1_HeavyChain
agacacaccuggaacaauacaggcagcggggugaagaaacccggagccuccgucaggguuucuugccuggcuucagaggacaucuucgaacggacugagcucauucauugggugcgccaggcaccuggucaaggccuugaauggauaggguggguaaagacggugaccggagccgucaacuuuggcagucuggauuuccgacaccguaucagcuugacaagagacagggauuuauuuacugcgcauauggacauucggggucugacccagggggauacagcuaccuacuucugugcccgccagaaauuugaguccagauauacuggaggccagggcugguacuucgaccuaugggggaggggaacacacaucgugguuucuucg

SEQ ID NO: 26487 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugccucgcaagcgaagacaucuucgagaggaccgaacuuauuuacuggguucggcaggccccuggacgcgguccagaguggauaggcugggugaagacaguauccgggacugugaacuuuggaucuucggauuuccgaaaucguaucucacugacgagagacagggauuugagcaccgcgcauauggacauucggggcuuaacacaggaugacacugcuaccuauuuuugugcccgccagaaauucgaaagucuguacuccgaugaccaagguucuuauuuugaucuaugggggagaggaacacucaucauugucagcucc

SEQ ID NO: 26488 - RNA, 384 nt, Artificial Sequence
  derived and/or modified sequence opt3 from anti-HIV-1_HeavyChain
agacacaccuggaacaauacaggcagcggggugaagaaacccggagccuccgucaggguuucuugcuggacuucagacgauaucuucgagcggacggaacugauucauugggugcgccaggcuccuggucaaggccucgaguggauaggguggguaaagaccgugaguggaacagucaacuuugcaagccuugacuuccgaaaucguaucucccugucuagagauagggacuugucgacugccuacauggauauucggggcuuaacccaggacgauacagcgaccuauuuuugugcucgccagaaauucgccucaagauacagcggugaccaggggaguuauuuugaucuguggggaaggggcacucuaaucgugguuuccucu

SEQ ID NO: 26489 - RNA, 384 nt, Artificial Sequence
  derived and/or modified sequence opt3 from anti-HIV-1_HeavyChain
ggcacccccgggaacaagagcggauccggugugaaaaagccuggcgccucugucagaguuucaugcuggaguagcgaggacaucuucgaaaggacagagcugauucacugggugcggcaggcuccagggcaaggacucgaauggauaggcuggguaaaaacugugacgggugcagucaauuuugggucccuugauuuccgccaucgaaucucucugacccgugacagagauuuguuuacagcccacauggacauuaggggauuaacucagggcgauaccgcgacauacuucugugcucggcagaaguuugagucgcgcuauaccggcgggcagggaugguacuucgaccugugggguagaggcacucauaucgugguuucaagc

SEQ ID NO: 26490 - RNA, 384 nt, Artificial Sequence
  derived and/or modified sequence opt3 from anti-HIV-1_HeavyChain
ggcacccccgggagcgaguccggaucuggugugaagagaccuggcgccucagucaggguuaguugcuggacaagcgaagacaucuucgagacuacggaacugauucacugggugcggcaggcuccagggcaaggacucgaguggauaggcuggguaaaaaccguguccggugcagucaacuuugggucucuuaauuuccgccaucgagugucgcugacacgugauagagacuuguuuacugcccacauggauaucaggggauuaacccagggcgacacagcgaccuacuucugugcucggcagaaguuugaaucacgcuauacuggcgggcagggaugguacuucgaucugugggguagaggcacacauauuguugugagcagu

SEQ ID NO: 26491 - RNA, 384 nt, Artificial Sequence
  derived and/or modified sequence opt3 from anti-HIV-1_HeavyChain
gugacccccggcacaaaccuggggcucagaaugaagaaaccuggagccagcgucaggguuuccugcuggacuucugaggacaucuucgauacgaccgaacuuauuuacugggugcggcaggcuccaggucaaggccuggaguggauaggguggguaaagaucgugucaggaacagucaauuuugcaaguuuggacuuccgcaaccgaauuagcuuaucccgugauagagaccugucuacugccuauauggauaucaggggccuaacccaggacgauacagcgaccuacuuuugugcucggcagaaauucgccucgcgcuauucaggugaccaggggagcuacuuugaucucuggggaagaggcacucugauugugguuaguucc

SEQ ID NO: 26492 - RNA, 384 nt, Artificial Sequence
  derived and/or modified sequence opt3 from anti-HIV-1_HeavyChain
agacacgaccuggagcagagcggcgccggggugaagaaacccggagcuuccgucaggguuucuugcuggucaagugaagauaucuucgagcggaccgaacucauucauugggugcgccaagcaccuggucagggccuugaguggauaggguggguaaagacagugacuggagccgucaacuuuggcagccuggacuuccgacaccguaucuccuugacgagagauagggacuuauuuaccgcgcauauggauauucggggucugacacagggggacacugcuaccuacuucugugcccgccagaaauuugaaucuagauauacaggaggccaaggcugguacuucgaucuaugggggaggggaacccacaucgugguuucguca

SEQ ID NO: 26493 - RNA, 384 nt, Artificial Sequence
  derived and/or modified sequence opt3 from anti-HIV-1_HeavyChain
caggugcaccuggagcaaagcggcuccggggucaagaaacccggagccucuguuagagugucaugcuggaccagugaagacaucuucgaaaagagcgagcucauucauuggguaaggcaggcuccuggucagggccuugaguggauagggugggugaaaacagucacuggagcagugaacuuuggcuccucugauuuccggcagcgcguuucgcugacgccagaccgagauuuguuuaccgcccacauggacauccgugguuuaacacaaggggauacugcgaccuacuucugugcuagacagaaguuugaaucaagguauacaggaggccagggcugguacuucgaccugugggggcggggaacccauauuguggucagcagu

SEQ ID NO: 26494 - RNA, 384 nt, Artificial Sequence
  derived and/or modified sequence opt3 from anti-HIV-1_HeavyChain
ggcaccacaugggagcagagcggguccggagugaagaaacccggugccucugucagaguuucaugcuggacuagcgaagacaucuucgagaagagugaacugauucacugggugaggcaagcuccuggccaggggcucgaguggauaggauggguaaaaacggugaccggcgcagucaacuuugguucccuugauuuccggcaucgcaucucucugacacgagaccgugauuuguuuacugcccacauggacauuagaggguuaacccagggagauacagcgaccuacuucugugcuaggcagaaguuugaaucgcgguauacuggcggccaagggugguacuucgaccuguggggacgcgguacacauaucgugguuucaagc

SEQ ID NO: 26495 - RNA, 384 nt, Artificial Sequence
  derived and/or modified sequence opt3 from anti-HIV-1_HeavyChain
agccacgaccuggagcaguccggcucugaauggaagaaacccggggccucagugagagucaguugcuggaccagcgaggauaucuucgacacaacugaacucauucauuggguuaggcaagcuccuggacagggucuugaguggauaggcugggugaagacgguaaccggggcagugaacuuuggaucccuggauuuccggcaccgcaucucuuugacacgagaccgugauuuauuuacugcccauauggacauuagaggccugacccagggugauacagcgaccuacuucugugcuaggcagaaauuugaaucgcgguauacugggggacaaggcugguacuucgaccuauggggccgcgggacacacaucgucgugucaagc

SEQ ID NO: 26496 - RNA, 384 nt, Artificial Sequence
  derived and/or modified sequence opt3 from anti-HIV-1_HeavyChain
cagagcagacccggcaacaaguccgggucugccaugaaaaagccuggagcuucagugagggucaguugcuggaccagcgaggacaucuucgaacggacagagcugcucuggguucgccaagcaccaggucgaggccuugaauggauugggugggugaaaacuguauccggaacggugaauuuugguucuucggauuuccguaacagaauaucacugaccagggaccgggauuugagcacagcccacauggacauccgcggcuuaacucaggaugacaccgcgacauacuuuugugcuagacagaaguucgagagucuguauuccgaugaccaggggucuuacuuugaucuauggggaaggggcacccucauuaucgucagcucc

SEQ ID NO: 26497 - RNA, 384 nt, Artificial Sequence
  derived and/or modified sequence opt3 from anti-HIV-1_HeavyChain
ggcaccacauggagcaaguccgggucuggagugaaaaagcccggugccucagucagaguuaguugcuggacuagcgaggacaucuucgaaaggacggagcugauuuacugggugcggcaggcuccuggccaagggcucgaauggauaggauggguaaaaaucguguccggcaccgucaacuuugcaucucuugauuuccgcaaucgaauuucgcugucacgugacagagauuugagcacagcccacauggacaucagggguuuaacucaggaugacaccgcgacauauuuuugugcucggcagaaguucgccagucgcuacuccggggaucagggaucuuauuuugaccuguggggcagaggcacccuaauuaucgugagcucc

SEQ ID NO: 26498 - RNA, 387 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacauccucaggaagaaacggguggauagcguagguugugacacagcaccuggccaggggcuugaguggauuggaugggugaagacugucacgggcgccgugaacuucgguuccucugauuuucgccagcgaguuucgcugacccgugacagagauuuguucacagcgcauauggacauaaggggguuaacucaggaugacaccgcuacauacuuuugcgcccggcaaaaauucgcaucacgcuauagcggagaucagggcaguuacuuugaccuguggggcagagggacccuaaucguggucuccucu

SEQ ID NO: 26499 - RNA, 387 nt, Artificial Sequence
  derived and/or modified sequence opt3 from anti-HIV-1_HeavyChain
aaggcccaccugggcaacaaaagcggguccggagugaagaaacccggugcuucugucagaguuucaugcuggaguagcgaggacaucuucgaaaggaccgagcucauucauugggugcggcaggcaccuggccaagggcuugaauggauaggauggguaaagacagugacuggcgccgucaauuuugguucccuggauuuccgccaccgaaucucuuugacgcgugacagagauuuauuuaccgcgcauauggacauuagggggcugacacagggagauacugcuaccuacuucugugcccggcagaaauuugagucgcgcuauacaggcggccaggggugguacuucgaccuauggggaagagguacccacaucgugguuucaagc

SEQ ID NO: 26500 - RNA, 384 nt, Artificial Sequence
  derived and/or modified sequence opt3 from anti-HIV-1_HeavyChain
accacagugggcacuauccuggggagagccaugaagaaacccggagcuagcgucaggguuuccugcuggacgucugaggacauuuucgauaccacagaacucauauacugggugcggcaggcaccuggucaaggccuugaguggaucggguggguaaagauugugucaggaacugucaacuuugccagucuggacuuccgcaaucgaaucagcuugucccgugauagagacuuaucuaccgcguauauggauauuaggggccugacacaggacgauaccgcuacuuacuuuugugcccggcagaaauucgcaucgcgcuauucaggugaccaggggagcuacuuugaucuauggggaagaggcacacucaucgugguuaguucc

SEQ ID NO: 26501 - RNA, 384 nt, Artificial Sequence
  derived and/or modified sequence opt3 from anti-HIV-1_HeavyChain
cagagccaccuggagcaauccggcucugccaugaagaaacccggggcuucagugaaggucaguugcuggaccagcgaagacaucuucgauacaacugagcucauuuacuggguuagacaggcaccuggacagggucuugaauggauaggcugggugaaaaucguauccgggacggugaacuuugccucucuggacuucaggaaucggauuucguugucacgcgaucgagacuuaagcaccgcguauauggauauccguggacugacacaggacgauacugcuaccuacuuuugugccagacaaaaguucgcaaguagguauuccggcgaccaggguucuuacuuugaucuaugggggcggggaacacucauugucgugagcucc

SEQ ID NO: 26502 - RNA, 387 nt, Artificial Sequence
  derived and/or modified sequence opt3 from anti-HIV-1_HeavyChain
cagagccaccuggagcaagugugggucugccaguccaagaaacccggcgccucuguuagagugucauguuggaccagugaagacaucuucgauacaacugagcucauuuacuggguaaggcaggcuccugggcagggacuugaauggauagguugggugaagaucgucagcggcacggugaacuuugcaucccuggacuuccggaaucgcauuucuuugucgcgagaucgugacuuaucaaccgcccauauggauaucagagggcugacacaagacgauacugcgaccuauuuuugcgcuaggcagaaauucgccagccgguacaguggagaccagggcuccuauuuugaucuauggggucgcgggacacucauuaucguuucuagc

SEQ ID NO: 26503 - RNA, 384 nt, Artificial Sequence
  derived and/or modified sequence opt3 from anti-HIV-1_HeavyChain
agacacaccguggagcagagcggcuccggggucaagaaacccggagccucuguuagggugucaugcuggaguagcgaagacaucuucgagcggacagaacugauucauuggguacgccaagcuccuggucagggccucgaguggauggggugggugaagacugucacgggagcagugaacuuuggcucccuugauuuccgacaccguauaucucugaccagagacagggauuuguuuacagcccauauggacauccgggguuuaacucagggggauaccgcgacauacuucugugcucgccagaaauuugaaucgagauauaccggaggccaaggcugguacuucgaccugugggggaggggaacucacauuguugugucaagc

SEQ ID NO: 26504 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcagcgcaagggaagacaucuucgauaccacagagcucauuuacuggguucggcaggccccuggacagggucuugaauggauaggcugggugaagaucguaugugggacugugaacuuugcgucccuggacuuccgcaaucgaauuucuuugucgcgugauagagacuuaucaacggcucauauggauaucaggggacugacccaggacgauacagccacuuauuuuugcgcacggcaaaaauucgccagccgcuacaguggcgaccaggguuccuauuuugaucuaugggggagaggaacccucauuaucgucucuagc

SEQ ID NO: 26505 - RNA, 387 nt, Artificial Sequence
  derived and/or modified sequence opt3 from anti-HIV-1_HeavyChain
gaggugcagagaggcgggagggucguuggacgggacgugaagaaacccggugccagcguacgcguguccugcuggaccucugaagauaucuuccacacagagcugauuuacuggguccgacaagcuccuggccaggggcucgaauggauaggaugggugaagaucguuucaggcacugugaacuuugcaagucuugacuuccguaauagaauuagccuguccagggaucgggacuugucuacggccuauauggauauccgcgguuuaacccaggacgauacagcgacuuacuuuugugcuagacagaaauucgccucgagguauucaggggaccaaggaagcuacuuugaucuguggggccggggcacccuaauugucgugaguucc

SEQ ID NO: 26506 - RNA, 384 nt, Artificial Sequence
  derived and/or modified sequence opt3 from anti-HIV-1_HeavyChain
ggcaccacauggaacgagagcggguccggagugaagaaacccggugccucugucagaguuccuugcuggucaagugaagacaucuucgagaggacugaacugauucaccgggugcgccaggcuccaggccaagggcucgaguggauaggauggguaaagacggugaccggcgcagucaauuuugguagcccgaacuuccgacaucguaucucccuuacaagagauagggaccuguuuacugcccacauggauauucggggguugacccagggagacacagcgaccuacuucugugcucgccagaaauuugaaucuagauauacuggcggccaggggugguacuucgauuuauggggaagggguacacauaucgugguuucguca

SEQ ID NO: 26507 - RNA, 384 nt, Artificial Sequence
  derived and/or modified sequence opt3 from anti-HIV-1_HeavyChain
agaagcaacugggugcaguccggcgccgacgucaagaaacccggggcuucuguuaagucaaguugcuggaccagcgaggauaucuucgacacaacugaacugauuuacugggugaggcaagcaccuggacagggucucgaguggauaggcuggguaaaaaucguguccgggacggucaauuuugccucucuugauuuccggaaccgcauuucgcugucacgagaccgugauuugagcaccgcguauauggacaucagaggauuaacacaggaugacacugcuaccuacuuuugugccaggcagaaguucgcaagucgguauuccggcgaucaagguucuuacuuugaccugugggggcgcggaacacuaauugugguuagcucc

SEQ ID NO: 26508 - RNA, 384 nt, Artificial Sequence
  derived and/or modified sequence opt3 from anti-HIV-1_HeavyChain
cccgugcagcugguccaaagcggcgccgagguuaagaaaccuggggcuuccgugaagguaucuugcuggaccucagaagacaucuucgagagaacagaacucauucacugggugaggcaggcaccaggacagggucuugaguggauaggcugggucaaaacugugacgggggccguuaacuuuggaagucuggauuuccggcaucgcaucagcuugacccgagaccgugauuuauuuacagcgcacauggacauuagaggccugacucagggugauaccgcuacauacuucugugccaggcaaaaguuugaaucccgguauaccgggggacagggcugguacuucgaccuauggggccgcgggacucauaucguggucucuucg

SEQ ID NO: 26509 - RNA, 399 nt, Artificial Sequence
  derived and/or modified sequence opt3 from anti-HIV-1_HeavyChain
agagaguaccuggaacagagcggcgggggagugaagaaacucggugccuccgucaggguuucuugccgggcuucagaggaccuuuucggcgaugaagcaaucuaugacgaugagcugauucacugguugcgccaagugcccgggcagcgaccugaauggaugggauggauacguccaaagaccggcgccagaaaccaggcgaggcaguuucaaccgcggaucaauuuaagucgcgacagagcucugaacacagccuaccuagaucucagcucccugacuucugcagacucggccacguauuucugugcuaggcagaccuuuaaacccgauuucuacuuugcagaccaggguuggucauucaaucuuugggggcggggagcccgcguaauugugagcagu

SEQ ID NO: 26510 - RNA, 399 nt, Artificial Sequence
  derived and/or modified sequence opt3 from anti-HIV-1_HeavyChain
caggugcaacugguccagagcggcaccgagguuaagaaacccggggccucccucagggugucuugcagggcuucagaagaccuuuucggagauaagaucauuuacgacgaugagguaauacacuggcugcggcaguugccuggucagcgcccagaauggaugggcuggauccgaccgaaaaguggggcacguaaccaagccagacaguuucagcccaggauuagcuuaacacgggaccgcgcgcuguccacugcuuaucuagaucucaauucucugacgucggccgacucaggaaccuacuucugugcaagacagacauuuaagccugauuucuauuuugccgaccaaggcuggagcuucaaccuuugggguagaggggcucauuuuaucgugaguucc

SEQ ID NO: 26511 - RNA, 399 nt, Artificial Sequence
  derived and/or modified sequence opt3 from anti-HIV-1_HeavyChain
caggcccaccuggagcaaagcggcuccggggugaagaaacccggagcuucugucagaguuucaugcagggcaagugaagaccucuucggugaugagaucauuuacgacgaugaagugauacauuggcuucggcagguaccuggccagcgcccagaguggaugggguggauccgaccgaagaccggagcccguaaccaggcgagacaauuucagcccaggauuagccugacacgggaccgcgcuuuguccacugccuauuuagaucuaaauucucugacgucggcagacucaggcaccuacuucugugccagacagacauuuaaaccugauuucuauuuugcugaccaggguuggagcuucaaccucugggggaggggagcacacuuuaucgugaguucc

SEQ ID NO: 26512 - RNA, 399 nt, Artificial Sequence
  derived and/or modified sequence opt3 from anti-HIV-1_HeavyChain
gggaacaucuggagcgaguccgggggaggugugaagaaacccggcgccucugucagaguuucaugcagggcuagugaagaccuguucggggaugagauuauauacgacgaugaagugauccacuggcuccggcagguaccuggacaacgcccagaguggaugggcuggauucgaccgaagaauggugggcguaaccaggcaagacaguuucagcccaggaucagccuuacccgggaccgcgcccugaauacagcguauuuggauuuaaacucccugacuucugcugacucgggaacguacuucugugccagacaaaccuuuaaaccugauuucuauuuugcagaccagggcuggucauucaaucuauggggcaggggcgcccgggugauugucagcagu

SEQ ID NO: 26513 - RNA, 399 nt, Artificial Sequence
  derived and/or modified sequence opt3 from anti-HIV-1_HeavyChain
caggugcaacugguccagagcggggccgagguuaagaaacccggggcuucccucagagugccuugcagggcaucugaagaccuuuucggagaugagaucauuuacgacgaugaaguaauacacuggcugcgccaggugccaggucagcggccggaguggaugggcuggauccgacccaagaccggggcccguaaccaagcgagacaguuucagccuaggauuucauugacacgggaccgcgcuuuaaguacugccuaucuggaucuaaauagccucacguccgcagacucuggaaccuacuucugugccagacagacauuuaaaccagauuucuauuuugcugaccaaggcuggucguucaaccugugggguaggggcgcacauuuuaucgucucaagc

SEQ ID NO: 26514 - RNA, 390 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuugaacgcggaggccagggcuggaucuucgaucugugggggagaggaacccuaauugcaguuucgucagccagcaggagugcu

SEQ ID NO: 26515 - RNA, 393 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugcccgcggggaucagggaugguucuuugaccucuggggcagaggcacccugauuguugugucaagcgcuaguacaagguccacc

SEQ ID NO: 26516 - RNA, 414 nt, Artificial Sequence
  derived and/or modified sequence opt3 from anti-HIV-1_HeavyChain
caggugcaacugguccagagcggcgccgagguuaagaaacccggggcuuccgugaccguaucuugcaaggcaucaagauacacauucaucaacuauuacauucacugggugaggcaggccccuggacagggucucgaauggauaggcugggucaaaccagugaguggggcgguuaauuuuggaagcccgaacuuccggcaucgcgugucccuuacucgagaccgugaucuguuuacggcucacauggacaucagaggcuugacccaaggugauacagccacuuauuucugugcaaggcagaaguuugcccgcggggaccagggaugguucuuugauuuauggggccggggcacccugauugucgugucuucggcuucaacaaaagggcccagcguauucccucaugaccuaaga

SEQ ID NO: 26517 - RNA, 414 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccaucacaagacacuauaugcauugggugaggcaggccccuggucagggccucgaauggauugggugggucaagacugugacgggagcgguuaacuucggcaguccaaauuuucggcaccgcgugagccuuacccgagaccgugaucuguucacagcucauauggacauaagagguuugacucaaggggauaccgccacauacuuuugugcaaggcagaaauucgagcggggaggccagggcugguauuuugacuuaugggggcgcggaacccugaucgucguguccucugccucgacuaaggguccgucaguauucccccacgaucuaaga

SEQ ID NO: 26518 - RNA, 408 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccccaaauuuccggcaccgcgugucucugacgcgagaucgugacuuguuuaccgcgcauauggauaucagagguuuaacacagggggacacugcuaccuacuucugugccaggcaaaaguauuacgcaggaggccagggcugguauuuugaucugugggggcggggaacacuaauuguugugucgucagccagcaccaaagguccgagugacgaucuccgc

SEQ ID NO: 26519 - RNA, 411 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuugaacgcggaggccagggcuggaucuucgaucugugggggagaggaacccuaauugcaguuucgucagccagcacaaaggguccgaguguguaugaccucagg

SEQ ID NO: 26520 - RNA, 417 nt, Artificial Sequence
  derived and/or modified sequence opt3 from anti-HIV-1_HeavyChain
caggugcaacugguccagagcggcuccgggguuaagaaacccggagccucugugagaguaucaugcuggaccagugaggacaucuucgaaaggacagagcucauucacugggugcggcaggcuccuggucagggccuugaauggauagggugggucaagacugugagcggagcaguuaacuuuggcuccccaaauuuccgccaucgagugucucugacgcgugauagagacuuguuuaccgcccacauggauaucagggguuuaacacaaggggacacugcgaccuacuucugugcucggcagaaauuugagcgcggaggccagggcugguauuucgaucugugggggagaggaacacuaauugucgugucgucagccagcaccaaggguccgaguguauuuccccaugaccucagg

SEQ ID NO: 26521 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccccaaauuuccggcaccgcgugucucugacgcgagaucgugacuuguuuaccgcgcauauggauaucagagguuuaacacagggggacacugcuaccuacuucugugccaggcaaaaguuugaacggggaggccagggcugguauuucgaucugugggggcgcggaacacuaauuguugugucgucagcaagcaccaaagguccgagugucuuucccacuaucuacgug

SEQ ID NO: 26522 - RNA, 417 nt, Artificial Sequence
  derived and/or modified sequence opt3 from anti-HIV-1_HeavyChain
caggugcaacuggagcagagcggcuccggggucaagaaacucggagccucuguuagagugucaugcuggaccagugaagacaucuucgaggaugaacuuauucacuggguaaggcaggcucccggucagggccuggaguggauagggugggugaaggcagucagcggagccgugaacuacggcuccuuggacuuucggcaucgcguuucuuuaacacgagaucgugaccuguucacugcgcacauggauaucagaggucuaacgcaagacgauaccgcuacauauuuuugugccaggcagaaauucgcacgcggggaccagggaugguuuuucgaucucuggggccggggcacucugauuguggucucgucagggcuucaucagggaccuaucggucugccaccgagauugagcagg

SEQ ID NO: 26523 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuugaacgcggaggccagggcuggaucuucgaucugugggggagaggaacccuaauugcaguuucgucagccagcccgagggcucaucggaguucccccacaaucugcgug

SEQ ID NO: 26524 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcuccgauuuccgccagcgagugucucugacccgugacagagauuuguuuacagcgcacauggacaucagggguuuaacucaaggggauaccgcuacauacuucugugcccggcagaaauuuuaugcaggaggccagggcugguacuucgaccugugggggcgcggaacccuaauuguugugucgucagccagcacuaaggguccaagugucuuuccgcaugaucucaga

SEQ ID NO: 26525 - RNA, 414 nt, Artificial Sequence
  derived and/or modified sequence opt3 from anti-HIV-1_HeavyChain
caggugcaccugguccaaagcggcgccgagguuaagagacccggggcuuccgugaaaguaucuugcaaggcaucaggauacaccuucacagacuauuuuauccauugggugaggcaggccccuggucagggccucgaauggauugggugggucaaaacugugaguggagcgguuaacuucggcagccuuaauuuucggcaccgcgugucccugacgcgagaucgugacuuguucaccgcucauauggauauaagagguuuaacacagggggacacugccaccuacuuuugugcaaggcaaaaguucgcccggggagaucagggcugguuuuucgaccuguggggccgcgggacacuaaucgucgugucuucggcuucaaccaaaggaccaagcguauuuccgcacgaucucaga

SEQ ID NO: 26526 - RNA, 420 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaucuucaccgguaguuauaugcacugggugagacaggccccuggccagacauuugaauggcucggguggaugaagccagucacuggagcggugaacuacgcuaggcaauuccagggccggguuagcuuuuaucgcacgcgagagcuugguauugccuacauggaccugcgugauuugaaauucgacgauaccgcaguguauuuuugugccagaaagacaaagggggacgucuccggagaugacaggggcuucuuuuucgauuuauggggccgggggacucgcgugauaguaucuucggcuucaaccaaaggaccgagcguuuuuccccaugaccugaga

SEQ ID NO: 26527 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccccaaauuuccggcaccgcgugucucugacgcgagaucgugacuuguuuaccgcgcauauggauaucagagguuuaacacagggggacacugcuaccuacuucugugccaggcaaaaguuugaacggggaggccagggcugguauuucgaucugugggggcgcggaacacuaauuguugugucgucagcaagcaccaaagguccgagugucuuuccccacgaccucaga

SEQ ID NO: 26528 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguagcgaacucauucauugggugaggcaggcaccuggccaggggcuugaguggauaggauggguaaagacagugacuggcgccgucaacuuugguuccccaaauuuccggcaccgcgugucucugacgcgagaucgugacuuguuuaccgcgcauauggauaucagaggguuaacacagggagacacugcuaccuacuucugugccaggcaaaaauuugaacggggcggccaggggugguauuucgaucuguggggacgcgguacacuaauuguugugucgucagcaagcaccaagggcccgagugucuuuccccacgaccucaga

SEQ ID NO: 26529 - RNA, 420 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacagguuauuacauccacugggugagacaggccccuggccaggggcucgaauggaugggauggauuaacccaaauaguggcgcgacuaacuaugcucaaaaguuucaggguaggcuuacgauagcccgggacaccagcaucuccacagcauacauggaucugcgcaauuugcgauucgacgauacugccgucuauuuuugugcucguaaaaccgcaggggacgugucuggagauaacagaggcuacuucuuugacuuauggggcagggggucgcggguuauugugucaagcgccaguacaaagggaccguccgucuucccccaugaucugcgc

SEQ ID NO: 26530 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuguugugucaagcgccaguaccaaagguccauccgucuuucaugaucuccgc

SEQ ID NO: 26531 - RNA, 414 nt, Artificial Sequence
  derived and/or modified sequence opt3 from anti-HIV-1_HeavyChain
caggccacccuggagcaaagcggcuccggggugaagaaacccggagcuucugucagaguuucaugcuggaguagcgaagacaucuucaagacagagcucauucacugggugaggcaggcaccuggucagggccuugaauggauaggguggguaaaagccguguccggagcggucaacuacggcucucuggauuuucggcaucgcgugucguugacucgagaccgugauuuaucaacggcucacauggacaucagaggucugacccaggaugacacagccacucauuucugugcaaggcaaaaguuugcccgcggggaucagggaugguucuuugaccuauggggccggggcacccucauuguugugagcagugcuuccacaaaagggccaucugucuucccgaccaucuaugug

SEQ ID NO: 26532 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugaacgcggaggccagggcugguauuucgaucugugggggagaggaacccuaauuguugugucuucggcaucaacuaaggguccgagcgucuuucccacaaucugcgug

SEQ ID NO: 26533 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugaacgcggaggccagggcuggauuuucgaucugugggggagaggaacacuaaucgcaguuucgucagccagcccgagggcucaccggaguucuccccgcuccgca

SEQ ID NO: 26534 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucaagagcgagcucauucauugggugaggcaggcaccuggucagggccuugaauggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugagcggggaggccagggcuggauuuucgaccugugggggcgcggaacacuaaucgcaguuucaagcgccaguaccaaagguccauccguguuuccgacuauuugcguc

SEQ ID NO: 26535 - RNA, 414 nt, Artificial Sequence
  derived and/or modified sequence opt3 from anti-HIV-1_HeavyChain
caggcccaccuggagcaaagcggccccggggugaagaaacucggagcuuccgucagaguuucuugcuggaccucagaagacaucuucgagaggacagaacuuauucauugggugcggcaggcaccuggucagggccuggaguggauaggguggguaaaggccgugaguggagcggucaacuacggcagcuuggauuuucgccaccgaguguccuuaacucgugacagagaucuguucacggcucauauggacaucaggggucuaacccaggaugacacagccauuuauuuuugugcacggcaaaaauucgcccgcggggaucagggaugguuuuucgaccucuggggcagaggcacucugaucguugugucuucggcuucaaccaaggcacacaggagcaguccacgguccaca

SEQ ID NO: 26536 - RNA, 420 nt, Artificial Sequence
  derived and/or modified sequence opt3 from anti-HIV-1_HeavyChain
caggugcaacugguccagagcggcgccgagaugaagaaacccggggcuuccguuaagcucucuugcaugaccucaggauacguguucacagacuuuuauauccacuggguaagacaggcaccuggucagggccuugaauggaugggguggauuaacccaggaacuggcgguacgauaagugccccgagguuccuggggcgggugaccuugacacgcgauacuagcaucuccgcggcuuacauugagaucaaucgagucaccauugacgauacagccaccuauuuuugugcacgucaaaaauucgccucuagauacucgggagaccagggcucauauuuugauuuauggggcagggggacucugaucgugguuagcagugcuuccacaaagggaccccuaggucucccuccacggucugca

SEQ ID NO: 26537 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccccugaagacaucuucgagaggacagaacucauucauugggugcggcaggcaccaggucagggccuugaguggauaggguggguaaagaucgugaguggagccgucaacuuuggcagcccgaauuuccgccagcgagugucccugacucgugauagagacuuguuuacggcgcacauggauauuagggguuuaacccaaggggacacagcuacuuacuucugugcccggcagaaauuugaacgcggaggccagggcuggaucuucgaucugugggggagaggaacccuaauugcaguuucuucggccucacccagggcucaucggagcaguccucgcuccgca

SEQ ID NO: 26538 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagccagugacuggagccgucaaccuggcgccgaauuuucgccaccgagugagcuugacgcgugauagagacuuauucaccgcucauauggauaucaggggccugacacagggugacacugccaccuacuuuugugcacggcaaaaauucgaacgcgggggacagggcugguauuuugaucuauggggcagagggacacucauuguuguguccucugccucgaccaagggacccucagucuucccucacgaccugagg

SEQ ID NO: 26539 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaaggccguguccggagcggucaacuacggcucucuggauuuucgccaccgagugucguugacacgugacagagauuuaucaacugcucauauggacaucaggggucugacgcaggaugacaccgccacauauuucugugcacggcaaaaauuugcccgcggggaucagggaugguucuuugaccuauggggcagaggcacucucauuguugugagcagugcuuccaccaaggggccaucugucuucccgcacgaucugagg

SEQ ID NO: 26540 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggagcgaacucauucauugggugcggcaggcaccuggucagggccuugaguggauaggguggguaaagacagugacuggagccgucaacuuuggcuccccaaauuuccgccagcgagugucucugacgcgugauagagacuuguuuaccgcgcacauggauaucagggguuuaacacaaggggacacugcuaccuacuucugugcccggcagaaauuuuaugcaggaggccagggcugguacuucgaucugugggggcgcggaacacuaauuguugugucgucagccagcaccaaggcucauagaaguuccccgaggucuacu

SEQ ID NO: 26541 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucaagagcgagcucauucauugggugaggcaggcaccuggucagggccuugaauggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuguugugucaagcgccaguaccaaagguccauccgucuuuccgacuaucugcgug

SEQ ID NO: 26542 - RNA, 414 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucaagacagagcuuauucauugggugaggcaggcacccggucagggccuggaauggauaggguggguaaaagccgugagcggagcggucaacuacggcuccuuggauuuucggcaccgcgugucuuuaacucgagaccgugaucugucgacggcucauauggacaucagaggucuaacccaggaugacacagccacuuauuucugugcaaggcaaaaguuugcccgcggggaucagggaugguucuuugaccucuggggccggggcacccugauuguugugucaagcgcuaguacaaaagggccuuccgucuucccacacgaucuuaga

SEQ ID NO: 26543 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuguugugucaagcgccaguaccaaagguccauccgucuuuccgacuaucuaugug

SEQ ID NO: 26544 - RNA, 417 nt, Artificial Sequence
  derived and/or modified sequence opt3 from anti-HIV-1_HeavyChain
caggcccaccuggagcaaagcggcuccggggugaagaaacccggaaccucugucagaguuucaugcuggacaagugaagacaucuucgagaggacugaacucauucauugggugcggcaggcuccuggucagggccuugaguggauaggguggguaaagacggugaccggagcagucaacuuuggcagcccaaauuuccgccaccgagugucccugacacgugauagagacuuguuuacugcccauauggauaucagggguuuaacccagggggacacagcgaccuacuucugugcucggcaaaaauuugcccgcggagaucagggcugguucuuugaccuguggggcagagggacucuaauuguugugucuucggcaucaacaaagggaccgagcgucuuccccaccaucugcgug

SEQ ID NO: 26545 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuguugugucaagcgccaguaccaaagguccauccgucuuuccgcagaucuaugug

SEQ ID NO: 26546 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcagacaccuggucagggccuugaguggauaggguggguaaaaacugugacgggagcagucaacuuuggcuccucugauuuccggcagcgcgugucgcugacccgagaccgugauuuguuuacagcccacauggacaucagagguuuaacucaaggggauaccgcgacauacuucugugcuaggcagaaguuuuaugccggaggccagggcugguacuucgaccugugggggcggggaacccuaauuguugugucaagcgcaaguacuaaagguccauccgucuuuccgacaaucuaugug

SEQ ID NO: 26547 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggguauuaggggguuaacccaaggagauacagcuacuuacuucugugcccggcagaaauuugaacgcggcggccagggguggaucuucgaccuguggggaagagguacccuaauugcaguuucgucagccagcacaaagggcccgaguguguuucccaccaucuauguc

SEQ ID NO: 26548 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccacuuauuuuugugcacggcaaaaauucgcccgcggggaucagggaugguuuuucgaccucuggggcagaggcacccugauuguugugucgucagcuagcacaaaggggccuagugucuuuccacacgaucuuagg

SEQ ID NO: 26549 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugaacgcggaggccagggcuggauuuucgaucugugggggagaggaacccuaaucgcaguuucuucggccucaacuaaggguccgagcguguuucccaggagugcuguc

SEQ ID NO: 26550 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggaugaagaucguaagcggagccgugaacuuuggcuccccaaauuuccgccagcgagucucucugacucgugauagagacuuguuuacggcgcacauggauauuagggguuuaacccaaggggacacagcuacuuacuucugugcccggcagaaauuugaacgcggaggccagggcuggaucuucgaucugugggggagaggaacccuaauugcagugucgucagccagcacaaaggguccgaguguuuuuccccaugaccucagg

SEQ ID NO: 26551 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucagcgaggguuccgaacucauucauugggugaggcaggcaccuggccaggggcuugaguggauaggauggguaaagacagugacuggcgccgucaacuucgguucugcguacuuucggcaccgcgugucgcugacgcgagaucgugacuuguucaccgcucauauggauaucagaggguuaacacagggagacacugccaccuauuuuugugcaaggcaaaaauucuacaagggcggccaggggugguauuuugaucuguggggacgggguacacuaauuguugugucaagcgccaguaccaaaggcccauccgucuucccgacuaucugcgug

SEQ ID NO: 26552 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuacggcagccuggauuuucgccaccgaguguccuugacccgugacagagauuuaucuacagcgcauauggacaucaggggucugacucaggaugacaccgcuacauauuucugugcccggcaaaaauuugcacgcggggaucagggaugguucuuugaccuauggggcagaggcacccucauuguugugucgucagccagcacuaaggggccaagugucuucccgcacgaucugagg

SEQ ID NO: 26553 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagaucguguccggagccgucaacuuuggcucuccaaauuuccgccagcgagugucgcugacacgugauagagacuuguuuacugcgcacauggauauuagggguuuaacgcaaggggacaccgcuacauacuucugugcccggcagaaauuugaacgcggaggccagggcuggaucuucgaucugugggggagaggaacucuaauugcaguuucaagcgccaguaccaaggguccguccguguuucccacaaucuauguc

SEQ ID NO: 26554 - RNA, 417 nt, Artificial Sequence
  derived and/or modified sequence opt3 from anti-HIV-1_HeavyChain
caggcccaccuggagcaaagcggcuccggggugaagagacccggagcuucugucaggguuucaugcuggaccagugaagacaucuucgagacaacugaacucauucauugggugcggcaggcaccuggucagggccuugaguggauaggguggguaaaaacggugagcggagccgucaacuuuggcucccugaauuuccgccaccgagugucuuugacccgugauagagacuuauuuacagcgcauauggauaucaggggucugacucagggggacaccgcuacauacuucugugcccggcaaaaguuugcacgcggagaucagggcugguucuuugaccuauggggcagagggacccucauuguugugucgucagccagcacuaaaggaccaagugucuucccgacaaucugcgug

SEQ ID NO: 26555 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaaccugggcagcccaaauuuucgccaccgaguguccuugacccgugauagagacuuauucacagcgcauauggauaucaggggucugacucagggggacaccgcuacauacuuuugugcccggcaaaaauucgaacgcggaggccagggcugguauuuugaucuaugggggagaggaacccucauuguugugucuucggcaucaacuaaggguccgagcgucuucccccacgaccugagg

SEQ ID NO: 26556 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugaacgcgggggacagggcuggauuuucgaucucuggggcagagggacccugaucgccguuucaagcgcuaguacaaagggaccuuccguguuuccaaccauuugcguc

SEQ ID NO: 26557 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugaacgcggaggccagggcugguauuucgaucugugggggagaggaacccuaauuguugugucuucggcaucaacuaaggguccgagcgucuuuccccacgaccucgug

SEQ ID NO: 26558 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaaggccguguccggagcggucaacuacggcucucuggauuuucgccaccgagugucguugacacgugacagagauuuauucacugcucauauggacaucaggggucugacgcaggaugacaccgccacauauuuuugugcacggcaaaaauucgcccgcggggaucagggaugguuuuucgaccuauggggcagaggcacucucauuguugugucaagcgcuaguaccaaggggccauccgucuuuccgacaaucuacgug

SEQ ID NO: 26559 - RNA, 420 nt, Artificial Sequence
  derived and/or modified sequence opt3 from anti-HIV-1_HeavyChain
caggugcaccuggagcaaagcggcuccggggucaagaaacccggagccccuguuagagugucuugcuggucaagugaagacaucuucgagaggaccgaacucauucauuggguacggcaggcuccaggucagggccuugaguggauagggugggugaagacagucacuggagcagugaacuuuggcagccuggauuuccgccaccgaaucuccuugacgcgugacagagauuuauuuaccgcccauauggacauuaggggucugacacagggggauacugcgaccuacuucugugcucggcaaaaauuuuaugccggaggccagggcugguacuucgaccuaugggggcgcggaacacucaucguugugucuucggcaucaaccaaggcccacagcguccugccgcccagaaguagggug

SEQ ID NO: 26560 - RNA, 417 nt, Artificial Sequence
  derived and/or modified sequence opt3 from anti-HIV-1_HeavyChain
caggcccaccuggagcaaagcggcuccggggugaagaaacccggagcucucgucagaguuucuugcuggaccucagaagacaucuucgagaagagugaacuuauucauugggugaggcaggcaccuggucagggccuggaguggauaggguggguaaaaacagugacuggagccgucaacuuuggcagcuccgauuuccggcagcgcgugucuuugacgcgagaccgugauuuauuuaccgcgcacauggacaucagaggucugacacaaggggauacugcuaccuacuucugugccaggcagaaguuuuaugcaggaggccagggcugguacuucgaccuaugggggcggggaacacucauuguugugucgucagccagcaccaaagguccaagugucuuuccgcaugaucugcgc

SEQ ID NO: 26561 - RNA, 414 nt, Artificial Sequence
  derived and/or modified sequence opt3 from anti-HIV-1_HeavyChain
caggugcaacugguccagagcggcgccgagguuaagaaacccggggcuuccgugaagguaucuugccaggugucaggauacacccucacagaacuuaguaugcacugggucagacaggcaccuggucaaggccuggaguggaucgggugggugaaaacuguuacgggagccgugaacuucggcagcccaaauuuuaggcaucgggucuccuugacccgcgaccgagauuuauucacagcgcacauggacauucguggucugacucagggggauaccgcuacauauuuuugugccagacagaaguucgaaaggggaggccagggcugguacuuugaccuaugggggcggggaacccucauagugguaucuucggcaucaacuaaagguccgagcguuuucccccaugaucugcgc

SEQ ID NO: 26562 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucaagacagagcucauucauugggugaggcaggcaccuggucagggccuugaauggauaggguggguaaaaaucgugagcggagccgucaacuuuggcuccccaaauuuccggcagcgcgugucucugacucgagaucgugacuuguuuacggcgcacauggauauuagagguuuaacccaaggggacacagcuacuuacuucugugccaggcagaaguuugagcggggaggccagggcuggaucuucgaucugugggggcgcggaacccuaauugcaguuucgucagccagcacaaaagguccgaguguguuuccccaugaccucaga

SEQ ID NO: 26563 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccacuuauuuuugugcacggcaaaaauucgcccgcggggaucagggaugguuuuucgaccucuggggcagaggcacccugauuguugugucgucagcuagcacaaaggggccuagugucuuuccaaccaucugcgug

SEQ ID NO: 26564 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggguagggugggugaaaacagucacuggagccgugaacuuuggcuccucugauuuccggcagcgcguuucgcugacgcgagaccgugauuuguuuaccgcgcacauggacauaagagguuuaacacaaggggauacugcuaccuacuucugugccaggcagaaguuuuaugcaggaggccagggcugguacuucgaccugugggggcggggaacacuaaucguggucucaagcgccaguaccaaagguccauccguguuuccgcaugaucuccgc

SEQ ID NO: 26565 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugaacggggaggccagggcugguauuucgaccugugggggcgcggaacacuaauuguugugucaagcgcaaguaccaaagguccauccgucuuuccgacuaucugcgug

SEQ ID NO: 26566 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugcccgcggggaucagggaugguucuuugaccucuggggcagaggcacccugauuguugugucaagcgcuaguacaaaggggccuuccgucuucccacagaucugcgug

SEQ ID NO: 26567 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggccaccagaucuccgaucgggugucucugacgccagaccgcgauuuguucaccgcgcauauggacauucgagguuuaacacaaggggauacugcuaccuacuuuugugcccgucagaaguucuaugcaggaggccagggcugguacuuugaccugugggggagaggaacacuaaucguugugucgucagccagcaccaaagguccgagugucuuccccacuauuugcgug

SEQ ID NO: 26568 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcgggcaccuggucagggccuugaguggauaggguggguaaaaacagugacuggagccgucaacuuuggcuccucugauuuccgccagcgagugucgcugacgcgugacagagauuuguuuaccgcgcacauggacaucagggguuuaacacagggggauacugcuaccuacuucugugcccggcaaaaguuuuaugcaggaggccagggcugguacuucgaccugugggggcgcggaacacuaauuguugugucaagcgccaguaccaaagcucauagauccucuccaacuaucugcguc

SEQ ID NO: 26569 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccacuuauuuuugugcacggcaaaaauucgcccgcggggaucagggaugguuuuucgaccucuggggcagaggcacccugauuguugugucgucagcuccuacaaaggggccaagcgucuuuccgaccaucugcgug

SEQ ID NO: 26570 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcuccgauuuccgccagcgagugucucugacccgugacagagauuuguuuacagcgcacauggacaucagggguuuaacucaaggggauaccgcuacauacuucugugcccggcagaaauuuuaugcaggaggccagggcugguacuucgaccugugggggcgcggaacccuaauuguugugucgucagccagcacuaaggguccaagugucuuuccgcagaucuaugug

SEQ ID NO: 26571 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgaggucgugacuuguuuaccgcgcacauggauaucagaggguuaacacaaggagacacugcuaccuacuucugugccaggcagaaguuuuaugcaggcggccaggggugguacuucgaucuguggggacgggguacacuaauuguugugucaagcgccaguaccaaaggcccauccgucuuuccgacuaucugcgug

SEQ ID NO: 26572 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuugucuacagcgcauauggauaucagggguuuaacucaggacgauaccgcuacauacuuuugugcccggcaaaaauucgcacgcggggaccagggaugguuuuucgaucuguggggcagaggcacccuaauuguugugucgucagccagcacuaaggggccgagugucuuuccccacgaccaugug

SEQ ID NO: 26573 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuuuaugcaggaggccagggcugguacuucgaucugugggggcgcggaacccuaauuguugugucuucggccucaacuaaggguccgagcgucuuuccccagaucugcgug

SEQ ID NO: 26574 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuugaacgcggaggccagggcuggaucuucgaucugugggggagaggaacccuaauuguugugucgucagcaagcacaaaggguccgagugucuuucccaccaucugcgug

SEQ ID NO: 26575 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcugggcaagugaagacaucuucgagaggaccgaacucauucauugggugcggcaggccccuggucagggccuugaguggauaggguggguaaagacagugacuggagcggucaacuuuggcagcccaaauuuccgccaccgagugucccugacgcgugauagagacuuguuuaccgcucauauggauaucagggguuuaacacagggggacacugccaccuacuucugugcacggcaaaaauuuuaugccggaggccagggcugguacuucgaucugugggggcgcggaacacuaauuguugugucuucggcuucaaccaaggguccgagcgucuuuccccacgaccuccug

SEQ ID NO: 26576 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugaacggggaggccagggcuggauuuucgaccugugggggcgcggaacacuaaucgcaguuucaagcgccaguaccaaagguccauccguguuuccgcaugaucucaga

SEQ ID NO: 26577 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaaggccgugagcggagcggucaacuacggcucccuggauuuucgccaccgagugucuuugacucgugacagagauuuaucgacggcucauauggacaucaggggucugacccaggaugacacagccacuuauuucugugcacggcaaaaauuugcccgcggggaucagggaugguucuuugaccuauggggcagaggcacccucauuguugugucaagcgcuaguacaaaggggccauccgucuucccgcacgaucugagg

SEQ ID NO: 26578 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggagcgaacucauucauugggugcggcaggcaccuggucagggccuugaguggauaggguggguaaagacagugacuggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauauuacgcaggaggccagggcugguauuuugaucugugggggcgcggaacacuaauuguugugucgucagccagcaccaaggguccgagugucuuccccacuaucugcaga

SEQ ID NO: 26579 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugaacggggaggccagggcugguauuucgaccugugggggcgcggaacacuaauuguugugucaagcgcaaguaccaaagguccauccgucuuuccgcaugaucucaga

SEQ ID NO: 26580 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccacuuauuuuugugcacggcaaaaauucgcccgcggggaucagggaugguuuuucgaccucuggggcagaggcacccugauuguugugucgucagcuagcacaaaggggccuagugucuuuccaaccaucuacgug

SEQ ID NO: 26581 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuauaaaggaggccagggcugguacuucgaccugugggggcggggaacacuaauuguugugucaagcgcaaguaccaaggguccauccgucuuuccgcaugaucuccgc

SEQ ID NO: 26582 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggaaccgucaacuuuggcagccugaauuuccgccagcgaguguccuugacacgugauagagacuuauuuacugcccacauggauaucaggggucugacccaagacgauacagcgaccuacuucugugcucggcagaaauuugcccgcggggaccagggaugguucuuugaucuauggggcagaggcacucucauuguugugucuucggcaucaacaaaggggccaagcgucuucccgcaugaccugagg

SEQ ID NO: 26583 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggccuagugaagacaucuucgaaaagagcgagcucauucauugggugaggcaggcaccaggucagggccuugaguggauaggguggguaaaaaccgugacaggagccgucaacuuuggcuccucugauuuccggcagcgcgugucgcugacucgagaccgugauuuguuuacggcgcacauggacaucagagguuuaacccaaggggauacagcuacuuacuucugugccaggcagaaguuugaacggggaggccagggcuggauuuucgaccugugggggcgcggaacccuaaucgcaguuucaagcgccaguacaaaagguccguccguguuuccccaugaucucaga

SEQ ID NO: 26584 - RNA, 417 nt, Artificial Sequence
  derived and/or modified sequence opt3 from anti-HIV-1_HeavyChain
caggcccaccuggagcaaagcggcuccggggugaagagacccggagcuucugucaggguuucaugcuggaccagugaagacaucuucgagacaacugaacucauucauugggugcggcaggcaccuggucagggccuugaguggauaggguggguaaaaacggugagcggagccgucaacuuuggcucccugaauuuccgccaccgagugucuuugacccgugauagagacuuauuuacagcgcauauggauaucaggggucugacucagggggacaccgcuacauacuucugugcccggcaaaaguuugcacgcggagaucagggcugguucuuugaccuauggggcagagggacccucauuguugugucgucagccagcacuaaaggaccaagugucuucccgcacgaucugagg

SEQ ID NO: 26585 - RNA, 417 nt, Artificial Sequence
  derived and/or modified sequence opt3 from anti-HIV-1_HeavyChain
caggcccaccuggagcaaagcggcuccgggguggaaaagcccggagcuucugucagaguuucaugcuggaccagugaggacaucuucgaaaggagcgagcucauucauugggugcggcaggcaccuggucagggccuugaauggauaggguggguaaaaacagugacuggagccgucaacuuuggcuccccaaauuuccgccaccgagugucucugacgcgugauagagacuuguuuaccgcgcauauggauaucagggguuuaacacagggggacacugcuaccuacuucugugcccggcaaaaguauuacgcaggaggccagggcugguauuuugaucugugggggcgcggaacacuaauuguugugucgucagccagcaccaaagguccgagugucuucccccacgaccucaga

SEQ ID NO: 26586 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuugaacgcggaggccagggcuggaucuucgaucugugggggagaggaacccuaauugcaguuucgucagccagcacaaaggguccgaguguguuuccccaugaccucagg

SEQ ID NO: 26587 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagaaacuuguuuacagcgcauauggacaucagggguuuaacucagggggauaccgcuacauacuucugugcccggcaaaaauuugaacgcggaggccagggcugguauuucgaccugugggggagaggaacccuaauuguugugucuucggcaucaacuaaggguccgagcgucuuuccccacgaucucagg

SEQ ID NO: 26588 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuuuaugcaggaggccagggcugguacuucgaucugugggggcgcggaacccuaaucguugugucgucagccagcacaaaggguccgagugucuuuccccaugaccucaga

SEQ ID NO: 26589 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuacggcagccugaauuuucgcucccgaaucucuuugacccgugauagagacuuauucacagcgcacauggauauuaggggucugacucagggggacaccgcuacauauuuuugugcccggcaaaaauucgaacgcggaggccagggcuggaucuuugaucuaugggggagaggaacccucauugcagugucgucagccagcacuaaggguccaaguguuuucccgcaugaccugagg

SEQ ID NO: 26590 - RNA, 417 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacagggcgacacugcuaccuauuuuugugccaggcaaaaauucuacgccggugggcagggaugguauuuugaucuauggggccggggcacacucauugucgugaguuccgcaucuaccaaggggccaagcguuuucccgcacgaccugcgc

SEQ ID NO: 26591 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggauugaacucauacauugggugcggcaggcaccuggucagggccuugaguggaucggguggguaaagacagugacuggagccgucaacuuuggcagcccaaauuuccgccaccgagugucccugacgcgugauagagacuuguuuaccgcgcauauggauauuagggguuuaacacagggggacacugcuaccuacuucugugcccggcaaaaauuugaacgcggaggccagggcugguauuucgaucugugggggagaggaacacuaaucguugugucuucggcaucaaccaaggguccgagcgucuuuccccacgaccucagg

SEQ ID NO: 26592 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccagcgagugucuuuaacucgugacagagaucuguucacggcucacauggacaucaggggucuaacccaaggggauacagccacuuauuuuugugcacggcagaaauucuacgccggaggccagggcugguauuuugaccucugggggcgcggaacccugauuguugugucgucagcuagcacaaaggguccuagugucuucccacaugaucuuaga

SEQ ID NO: 26593 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagagggcagaacucauucauugggugcggcaggccccuggucagggccuugaguggauaggguggguaaagaccgugacaggagcggucaacuuuggcuccccaaauuuccgccagcgagugucucugacucgugauagagacuuguuuacggcucacauggauaucagggguuuaacccaaggggacacagccacuuacuucugugcacggcagaaauuugaacgcggaggccagggcuggauuuucgaucugugggggagaggaacccuaaucgccguuucgucagcuagcacaaaggguccgaguguguuuccccaugaccucagg

SEQ ID NO: 26594 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaaggccgugagcggagcggucaacuacggcucccuggauuuucgccaccgagugucuuugacucgugacagagauuuauucacggcucauauggacaucaggggucugacccaggaugacacagccacuuauuuuugugcacggcaaaaauucgcccgcggggaucagggaugguuuuucgaccuauggggcagaggcacccucauuguugugucgucagcuagcacaaaggggccaagugucuuuccgcacgaucugagg

SEQ ID NO: 26595 - RNA, 417 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgagcggggcggucaggggugguacuuugaccuauggggacgcggcacacucauugucgugaguuccgcaucuaccaagggcccaagcguuuucccgcacgaucugaga

SEQ ID NO: 26596 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuuuaugcaggaggccagggcugguacuucgaccuaugggggcgcggaacacucaucgugguuucgucagccagcaccaaggguccaaguguguuuccgcacgaucugaga

SEQ ID NO: 26597 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaagaugacacugcuauuuacuucugugccaggcagaaguuugcacgcggggaucagggaugguucuuugaccuguggggccggggcacccuaaucguugugucaagcgccaguacaaaagggccauccgucuucccgcaugaucucaga

SEQ ID NO: 26598 - RNA, 417 nt, Artificial Sequence
  derived and/or modified sequence opt3 from anti-HIV-1_HeavyChain
caggcccaccuggagcaaagcggcuccggggugaagggacccggugcuucugucagaguuucaugcuggaccagugaagacaucuucgagacaacugaacucauucauugggugaggcaggcaccuggccaggggcuugaguggauaggauggguaaaaacggugagcggcgccgucaacuuugguucccugaauuuccggcaccgcgugucuuugacccgagaucgugacuuauuuacagcgcauauggauaucagagggcugacucagggagacaccgcuacauacuucugugccaggcaaaaguuugcacggggcgaucagggcugguucuuugaccuaugggggcgcggaacccucauuguugugucgucagccagcacuaaagguccaagugucuucccgcacgaucugaga

SEQ ID NO: 26599 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguagcgaacucauucauugggugaggcaggcaccuggccaggggcuugaguggauaggauggguaaagacagugacuggcgccgucaacuuugguuccgcguacuuccggcaccgcgugccacugacgcgagaucgugacuuguuuaccgcucauauggauaucagaggguuaacacagggagacacugccaccuauuucugugcaaggcaaaaauuuuacaagggcggccaggggugguauuucgaucuguggggacgggguacacuaauuguugugucuucggccucaaccaaaggcccgagcgucuuuccccacgaccuccgc

SEQ ID NO: 26600 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugaacgcggaggccagggcugguauuucgaucugugggggagaggaacccuaauuguugugucuucggcaucaacuaaggguccgagcgucuuuccccacgaccucagg

SEQ ID NO: 26601 - RNA, 417 nt, Artificial Sequence
  derived and/or modified sequence opt3 from anti-HIV-1_HeavyChain
caggcccaccuggagcaaagcggcuccggggugaagaaagucggagcuucuguuagagugucaugcuggaccagugaagacaucuucgagaggacagaacucauucauuggguacggcaggcacccggucagggccuugaguggauagggugggugaaggccgucagcggagcggugaacuacggcucccuggauuuucgccaccgaguuucuuugacucgugacagagauuuauucacggcucauauggacaucaggggucugacccagggggauacagccacuuauuuuugugcacggcaaaaauucuacgccggaggccagggcugguauuuugaccuaugggggcgcggaacccucauuguggucucgucagcuagcacaaaggguccuaguguguucccacacgaucugaga

SEQ ID NO: 26602 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucaggacgauaccgcuacauacuucugugcccggcaaaaauuugcacgcggggaccagggaugguucuuugaucuguggggcagaggcacccuaauuguugugucuucggccucaacuaaggggccgagcgucuucccccacgaccucagg

SEQ ID NO: 26603 - RNA, 417 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaauucgccagaggugaucaagggugguuuuucgaccuguggggaaggggcacccuaaucgucgugaguuccgcaucuacuaagggcccaagcguuuuuccgcacgaucuccgg

SEQ ID NO: 26604 - RNA, 417 nt, Artificial Sequence
  derived and/or modified sequence opt3 from anti-HIV-1_HeavyChain
caggcccaccuggagcaaagcgaauccggcgugaagaaacucggggcuucugucagaguuucaugcuggaccagugaggacaucuucgaaaggacagagcuuauucauugggugcggcaggcacccggacagggucuggaauggauaggcuggguaaaggccgugagcggggcggucaacuacggauccuuggauuuucgccaccgagugucuuuaacucgugacagagaucuguucacggcucauauggacaucaggggccuaacccaggaugacacagccacuuauuuuugugcacggcaaaaauucgcccgcggugaucaggggugguuuuucgaccucuggggaagaggcacccugauuguugugucgucagcuagcacaaagggcccuagugucuuuccacacgaucuuagg

SEQ ID NO: 26605 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuguugugucaagcgccaguaccaaagguccauccgucuuuccgacuacacuccgc

SEQ ID NO: 26606 - RNA, 417 nt, Artificial Sequence
  derived and/or modified sequence opt3 from anti-HIV-1_HeavyChain
caggcccaccuggagcaaagcggcuccggggugaagaaagucggagcuucuguuagagugucaugcuggaccagugaagacaucuucgagaggacagaacucauucauuggguacggcaggcacccggucagggccuugaguggauagggugggugaagacugucacgggagccgugaacuuuggcagcuccgauuuccgccagcgaguuucucugacccgugacagagauuuguuuacagcgcacauggacaucagggguuuaacucaaggggauaccgcuacauacuucugugcccggcagaaauuuuaugcaggaggccagggcugguacuucgaccugugggggcgcggaacccuaauuguggucucgucagccagcacuaaggguccuaguguguuuccacaugaucucaga

SEQ ID NO: 26607 - RNA, 420 nt, Artificial Sequence
  derived and/or modified sequence opt3 from anti-HIV-1_HeavyChain
caggccagacccggcgcuaacagggggagcggagugaagaaaccuggugcauccguccggguuucuugcuggaccucagaggacaucuucgaacgcacagagcugauucacugggugcgacaagccccaggccaggggcucgaauggauaggauggguaaagaucgugaguggcgcggucaauuuugguagcccgaacuuccgucagagagugucccuuacuagggaucgggaccuguuuacggcucauauggauauucgcggguugacccagggagacacagccacuuacuucugugcaagacaaaaauuugagaggggcggccagggguggaucuucgauuuauggggacgggguacccugauugccguuucuucggcuucaacaaagggccccagcguguuuccucacgaccuacgc

SEQ ID NO: 26608 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggagcgaacucauucauugggugcggcaggcaccuggucagggccuugaguggauaggguggguaaagacagugacuggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauauuacgcaggaggccagggcugguauuuugaucugugggggcgcggaacacuaauuguugugucgucagccagcaccaaggguccgagugucuucccccacgaccucaga

SEQ ID NO: 26609 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguagcgaacucauucauugggugaggcaggcaccuggccaggggcuugaguggauaggauggguaaagacagugacuggcgccgucaacuuugguuccgcguacuuccggcaccgcgugucucugacgcgagaucgugacuuguuuaccgcucauauggauaucagaggguuaacacagggagacacugccaccuauuucugugcaaggcaaaaauuuuacaagggcggccaggggugguauuucgaucuguggggacgggguacacuaauuguugugucgucagccagcaccaaaggcccaagugucuuuccgcacgaccuccgc

SEQ ID NO: 26610 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugcccgcggggaucagggaugguucuuugaccucuggggcagaggcacccugauuguugugucaagcgcuaguacaaaggggccuuccguccuuccaccgaggucugca

SEQ ID NO: 26611 - RNA, 417 nt, Artificial Sequence
  derived and/or modified sequence opt3 from anti-HIV-1_HeavyChain
caggcccaccuggagcaaagcggcuccgggaugaagaaacccggagcuucugugagagucucaugcuggaguagcgaagacaucuucgagaggaccgaacucauucauuggguucggcaggcaccuggucagggccuugaguggauagggugggugaagacaguaacuggagccgugaacuuuggcuccucugauuuccgccagcgagucucgcugacgcgugacagagauuuguuuaccgcgcacauggacaucagggguuuaacacaaggggauacugcuaccuacuucugugcccggcagaaauuuuaugcaggaggccagggcugguacuucgaccugugggggcgcggaacacuaauugugguuucaagcgccaguaccaaggguccauccguguuuccgcaugaucucaga

SEQ ID NO: 26612 - RNA, 417 nt, Artificial Sequence
  derived and/or modified sequence opt3 from anti-HIV-1_HeavyChain
caggcccaccuggagcaaagcggcuccggggugaaggaacccggaaccucugucagaguuucaugcuggacaagugaggacaucuucgaaaggacugagcucauucauugggugcggcaggcuccuggucagggccuugaauggauaggguggguaaaaacggugaccggagcagucaacuuuggcagcccaaauuuccgccaccgagugucccugacacgugauagagacuuguuuacugcccauauggauaucagggguuuaacccagggggacacagcgaccuacuucugugcucggcaaaaguuugagcgcggaggccagggcuggauuuucgaucugugggggagaggaacucuaaucgccguuucuucggcaucaacaaaagguccgagcguguuuccccagacccucagg

SEQ ID NO: 26613 - RNA, 417 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggcaucgcgucucguugacccgagaucgugacuuaucaacagcgcacauggauauuagaggacugacucaggacgauaccgcuacauauuuuugugccaggcaaaaauucgcacggggcgaccaggguugguuuuucgaucuaugggggcgcggaacccucaucgugguuagcagugccuccacuaagggcccaucuguguuuccgcaugaccugaga

SEQ ID NO: 26614 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagacaacugaacucauucauugggugaggcaggcaccuggucagggccuugaguggauaggguggguaaagacggugagcggagccgucaacuuuggcucccugaauuuccggcaccgcgugucuuugacccgagaucgugacuuauuuacagcgcauauggauaucagaggucugacucagggggacaccgcuacauacuucugugccaggcaaaaauuugcacggggagaucagggcugguucuuugaccuauggggccgcgggacccucauuguugugucgucagccagcacuaagggaccaagugucuucccgcacgaucugaga

SEQ ID NO: 26615 - RNA, 417 nt, Artificial Sequence
  derived and/or modified sequence opt3 from anti-HIV-1_HeavyChain
caggcccaccuggagcaaagcggcuccggggugaagaaagucggagcuucuguuagagugucaugcuggaccagugaagacaucuucgagaggacagaacucauucauuggguacggcaggcacccggucagggccuugaguggauagggugggugaagacugucacgggagccgugaacuuuggcagcccuaauuuccgccaccgaguuucccugacccgugauagagacuuguuuacagcgcauauggauaucagggguuuaacucagggggacaccgcuacauacuucugugcccggcaaaaauuugaacgcggaggccagggcugguauuucgaucugugggggagaggaacccuaauuguggucucuucggcaucaacuaaggguccaagcguguuuccgcacgaccucagg

SEQ ID NO: 26616 - RNA, 417 nt, Artificial Sequence
  derived and/or modified sequence opt3 from anti-HIV-1_HeavyChain
caggcccaccuggagcaaagcggcgcuggggugaagaaacccggagcauccgucagaguuucuugcuggaccucagaagacaucuucgagaggacagaacucauucauugggugcggcaggccccuggucagggccuugaguggauaggguggguaaagacugugaguggagcggucaacuuuggcagcccaaauuuccgccaccgagugucccugacgcgugauagagacuuguuuaccgcucauauggauaucagggguuuaacacagggggacacugccaccuacuucugugcacggcaaaaauuugaacgcggaggccagggcugguauuucgaucugugggggagaggaacacuaauuguugugucuucggccucaaccaaggguccgagcgucuuuccccacgaccucagg

SEQ ID NO: 26617 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuacggcagccugaauuuucgcucccgaaucucuuugacccgugauagagacuuauucacagcgcacauggauauuaggggucugacugaaggggacaccgcuacauauuuuugugcccggcagaaauucuacgcaggaggccaaggcugguauuuugaucuaugggggcgcggaacccucaucgugguuucgucagccagcacuaaggguccaaguguguucccgcaugaccugaga

SEQ ID NO: 26618 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugccucgcaagugaagacaucuucgagaggaccgaacuuauucauugggugcggcaggccccuggucagggccuggaguggauaggguggguaaagacagugacuggagcggucaacuuuggcagcccaaauuuccgccaccgaguguccuugacgcgugauagagacuuauuuaccgcucauauggauaucaggggucugacacagggggacacugccaccuacuucugugcacggcaaaaauuugaacgcggaggccagggcugguauuucgaucuaugggggagaggaacacucauuguugugucuucggccucaaccaaggguccgagcgucuuuccccacgaccugagg

SEQ ID NO: 26619 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaacgcggaggccagggcuggaucuucgaccuaugggggagaggaacacucauugcagugucgucagccagcaccaaggguccaaguguuuuuccgcacgaucugagg

SEQ ID NO: 26620 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccagcgagugucccugacccgugauagagacuuguuuacagcgcacauggauaucagggguuuaacucaaggggacaccgcuacauacuucugugcccggcagaaauuugaacgcggaggccagggcugguauuucgaucugugggggagaggaacccuaauuguugugucuucggcaucaacuaaggguccgagcgucuuuccccaugaccucagg

SEQ ID NO: 26621 - RNA, 417 nt, Artificial Sequence
  derived and/or modified sequence opt3 from anti-HIV-1_HeavyChain
caggugcaccuggagcaaagcggcuccggggucaagaaacccggagccucuguuagagugucaugcuggaccagugaagacaucuucgagaggacagaacucauucauuggguacggcaggcuccuggucagggccuugaguggauagggugggugaagacugucacgggagcagugaacuuuggcagcccaaauuuccgccaccgaguuucccugacccgugauagagacuuguuuacagcccauauggauaucagggguuuaacucagggggacaccgcgacauacuucugugcucggcaaaaauuugaacgcggaggccagggcugguauuucgaucugugggggagaggaacccuaauuguggucucuucggccucaacuaaggguccgagcguguuuccccacgaccucagg

SEQ ID NO: 26622 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccagcgagugucucugacgcgugauagagacuuguuuaccgcgcacauggauaucagggguuuaacacaaggggacacugcuaccuaccugugugcccggcagaaauucgaacgcggaggccagggcuggauuuuugaucuaugggggagaggaacacucaucgcaguuucgucagccagcaccaaggguccgaguguguucccccaugaccugagg

SEQ ID NO: 26623 - RNA, 417 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgacaucgugucucacugaccagagacagggauuuguuuacagcccacauggacauccggggcuuaacucagggugauaccgcgacauauuucugugcucgccagaaauuuuacaaagggggacaaggcugguauuucgaccuguggggcagagggacccuaauugugguuagcagugccuccacuaagggaccaucuguguuuccgcaugaucucagg

SEQ ID NO: 26624 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgccagaccgagauuuguuuaccgcgcacauggacauccgugguuuaacacaaggggauacugcuaccuacuucugugccagacagaaguuuuaugcaggaggccagggcugguacuucgaccugugggggaggggaacacuaauuguugugucaagcgccaguaccaaagguuccucugucuuuccgcaugaucuccgg

SEQ ID NO: 26625 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgccagaccgagauuuguuuaccgcgcacauggacauccgugguuuaacacaaggggauacugcuaccuacuucugugccagacagaaguuuuaugcaggaggccagggcugguacuucgaccugugggggaggggaacacuaauuguugugucaagcgccaguaccaaagguccguccgucuuuccccaugaucuccgg

SEQ ID NO: 26626 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugcccgcggggaucagggaugguucuuugaccucuggggcagaggcacccugauuguugugucaagcgcuaguacaaaggggccuuccgucuucccacacgaucuuagg

SEQ ID NO: 26627 - RNA, 417 nt, Artificial Sequence
  derived and/or modified sequence opt3 from anti-HIV-1_HeavyChain
caggugcaccuggagcaaagcggcuccggggucaagaaacucggagccucuguuagagugucaugcuggaccagugaagacaucuucgagaggacagaacuuauucauuggguacggcaggcucccggucagggccuggaguggauagggugggugaaggcagucagcggagccgugaacuacggcuccuuggauuuucgccaccgaguuucuuuaacucgugacagagaucuguucacggcgcauauggacaucaggggucuaacccaggaugacacagcuacuuauuuuugugcccggcaaaaauucgcacgcggggaucagggaugguuuuucgaccucuggggcagaggcacccugauuguggucucgucagccagcacaaaggggccuaguguguuuccacacagguccacc

SEQ ID NO: 26628 - RNA, 420 nt, Artificial Sequence
  derived and/or modified sequence opt3 from anti-HIV-1_HeavyChain
cagguguacauggagcaagccggcgcuggggucaagaaacccggagcaagcguuacccuguccugcaagacagccgacgaagauguguucgacgcggcuuauaugcacuggguaagacaggccccuggucagacuuuugaguggcucggcuggaugaaaccagugacgggggcagucucuuacgccaggaaguuccagggacgggugucauuuuauaugacccgcgaacuuggcauggcuuacauggaucugcgaaacuugcguuucgacgauacagcaguuuauuuuugugccagaaaaacugcuggugacgugaguggggauaauaggggauacuucuuugacuuauggggccggggcagccgcgucaucguguccucugccucgaccaaggggccgucaguauucacaauuuauguu

SEQ ID NO: 26629 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccacuuauuuuugugcacggcaaaaauucgcccgcggggaucagggaugguuuuucgaccucuggggcagaggcacccugauuguugugucgucagcuagcacaaaggggccuagugucuuuccacacgauccggca

SEQ ID NO: 26630 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugcccgcggggaucagggaugguucuuugaccucuggggcagaggcacccugauuguugugucaagcgcuaguacaaaggggccuuccguccuuccaccgaggucuacc

SEQ ID NO: 26631 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaaggccguguccggagcggucaacuacggcucucuggauuuucgccaccgagugucguugacacgugacagagauuuauucacugcucauauggacaucaggggucugacgcaggaugacaccgccacauauuuuugugcacggcaaaaauucgcccgcggggaucagggaugguuuuucgaccuauggggcagaggcacucucauuguugugucaagcgcuaguaccaaggggccauccgucuuuccgcacgaucugagg

SEQ ID NO: 26632 - RNA, 417 nt, Artificial Sequence
  derived and/or modified sequence opt3 from anti-HIV-1_HeavyChain
caggcccaccuggagcaaagcggcuccgaauggaagaaacucggggcuucugugagagucucaugcuggaccagugaggacaucuucgaaaggacagagcuuauucauuggguucggcaggcacccggacagggucuggaauggauaggcugggugaaggccguaagcggggcggugaacuacggauccuuggauuuucgccaccgagucucuuuaacucgugacagagaucugucgacggcucauauggacaucaggggccuaacccaggaugacacagccacuuauuucugugcacggcaaaaauuugcccgcggugaucaggggugguucuuugaccucuggggaagaggcacccugauugugguuucaagcgcuaguacaaagggcccuuccguguucccacacgaucuuagg

SEQ ID NO: 26633 - RNA, 417 nt, Artificial Sequence
  derived and/or modified sequence opt3 from anti-HIV-1_HeavyChain
caggcccaccuggagcaaagcggcuccgaagugaagaaacccggggcuucugucagaguuucaugcuggaccagugaggacaucuucgaaaagagcgagcucauucauugggugaggcaggcaccuggacagggucuugaauggauaggcuggguaaaaacagugacuggggccgucaacuuuggauccucugauuuccggcagcgcgugucgcugacgcgagaccgugauuuguuuaccgcgcacauggacaucagaggcuuaacacaaggugauacugcuaccuacuucugugccaggcagaaguuuuaugcagggggacagggcugguacuucgaccuguggggccgggggacacuaauuguugugucaagcgccaguaccaaaggaccauccgucuuuccgcaugaucuccgc

SEQ ID NO: 26634 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaagacugugacgggagccgucaacuuuggcagcccuaauuuccgccaccgaguguccuugacccgugauagagacuuauuuacagcgcauauggauaucaggggucugacucagggggacaccgcuacauacuucugugcccggcaaaaauuugaacgcggaggccagggcugguauuucgaucuaugggggagaggaacccucauuguugugucuucggcaucaacuaaggguccaagcgucuuuccgcacgaccugagg

SEQ ID NO: 26635 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacauccucaggaaaagcgagcuuauucauugggugcggcaggcaccuggucagggccuggaauggauaggguggguaaagacagugacuggagccgucaacuucggcuccucugauuuucgccagcgagugucguugacgcgugacagagauuuauucaccgcgcacauggacaucaggggucugacacaaggggauacugcuaccuacuuuugugcccggcagaaguucuaugcaggaggccagggcugguacuuugaccuaugggggcgcggaacacucauuguugugucaagcgccaguaccaaagguccauccgucuucccgcaugaucugaga

SEQ ID NO: 26636 - RNA, 417 nt, Artificial Sequence
  derived and/or modified sequence opt3 from anti-HIV-1_HeavyChain
caggcccaccuggagcaaagcgcuuccggcgugaagagacccggggcaucugucaggguuucaugccucgccagugaagacaucuucgagcggagcgaacuuauuuacugggugcgccaggcgccuggacagggucuggaguggauaggcuggguaaaaaucguguccggggcugucaacuuuggaucuccaaauuuccgacagcgugugucguugaccagagauagggacuuauuuacagcccauauggauauucggggccugacucaaggugacacggcaaccuauuucugugcccgccagaaguuugaaagagggggacagggcuggaucuucgaucuauggggcagggggacacucauugcuguuucaagcgcaaguacuaaaggaccguccguguuuccccacgaccugcgg

SEQ ID NO: 26637 - RNA, 417 nt, Artificial Sequence
  derived and/or modified sequence opt3 from anti-HIV-1_HeavyChain
caggcccaccuggagcaaagcggcuccggggugaagagacccggagcuucugucaggguuucaugcuggaccagugaagacaucuucgagacaacugaacucauucauugggugcggcaggcaccuggucagggccuugaguggauaggguggguaaaaacggugaccggagccgucaacuuuggcagcgcguacuuccgccaccgagugucccugacacgugauagagacuuguuuacugcucauauggauaucagggguuuaacccagggggacacagccaccuauuucugugcacggcaaaaguuuuacaaaggaggccagggcugguauuucgaucugugggggcgcggaacucuaauuguugugucuucggccucaacaaaggguccaagcgucuuuccgcacgaccucaga

SEQ ID NO: 26638 - RNA, 417 nt, Artificial Sequence
  derived and/or modified sequence opt3 from anti-HIV-1_HeavyChain
caggcccaccuggagcaaagcgcuuccggcgugaagagacccggggcaucugucaggguuucaugcuggaccagugaagacaucuucgagcggagcgaacucauuuacugggugcgccaggccccuggacagggucuugaguggauaggcuggguaaaaacaguguccggggcggucaacuuuggaucuacugauuuccgacaucgugugucgcugacgagagacagggauuuguuuaccgcucacauggacauccggggcuuaacacagggugauacugccaccuauuucugugcacgccaaaaguuugaaagagggggacagggcugguacuucgaccuguggggcagggggacacuaauuguugugucaagcgccaguaccaaaggaccauccgucuuuccgcaugaucuccgg

SEQ ID NO: 26639 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugcccgcggggaucagggaugguucuuugaccucuggggcagaggcacccugauuguugugucaagcgcuaguacaaaggggccuuccggacuuccaccgaggucugca

SEQ ID NO: 26640 - RNA, 417 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacagggcgacacugcuaccuauuuuugugccaggcaaaaauucgagcggggugggcagggauggauuuuugaucuauggggccgcggcacacucaucgcagucaguuccgccucuaccaaggggccaagcguguucccgcugagauccgcu

SEQ ID NO: 26641 - RNA, 423 nt, Artificial Sequence
  derived and/or modified sequence opt3 from anti-HIV-1_HeavyChain
caggugcaaauggagcaggccggcgcugggaugaagaaacccggagcaagcaugaccgucuccugcaagacagccgacgaagauaucuucgacgcggcuuacaugcacuggguuagacaggccccuggucagacuuuugaguggcugggcuggaugaaaccagugacgggggcaguaaacuaugccaggcaauuccagggacgggcuucuuuuuaccgcacccgagaacucggcauugcauauauggaucuucgugaccugaaguucgaugacacagccguguacuuuugugcuagaaaaacuaagggugaugucucaggggacgauaggggauucuuuuucgacuuguggggccggggcacccgcgugauaguuaguagcgccuccacaaaggggccgucuguguuuccccaugauuuaaga

SEQ ID NO: 26642 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuuuauaagggaggccagggcugguacuucgaccuaugggggcgcggaacacucaucgugguuucgucagcaagcaccaaagguccaaguguguuuccgcagauuugcaga

SEQ ID NO: 26643 - RNA, 414 nt, Artificial Sequence
  derived and/or modified sequence opt3 from anti-HIV-1_HeavyChain
caggcccaccuggagcaaagcggcgcuggggugaagaaacccggagcauccgucagaguuucuugcuggaccucagaagacaucuucgagaagagugaacucauucauugggugaggcaggccccuggucagggccuugaguggauaggguggguaaaaacagugacuggagcggucaaccuggugcaccagaucagcgaucggguuuccuugacgcgcgaccgagauuuaucuaccgcucauauggacauucguggccugacacaagaugacacugccaccuacuuuugugcaagacagaaguucgccaggggugaucaggggugguuuuucgaccuauggggacggggcacacucaucguggucucgucagcuagcaccaaaggcccaaguguguuuccgcacgaucugcgc

SEQ ID NO: 26644 - RNA, 420 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugcccgcggggaucagggaugguucuuugaccucuggggcagaggcacccugauuguugugucaagcgcuaguacaaaggggccuuccggacuuccaccgaggcugugcguc

SEQ ID NO: 26645 - RNA, 417 nt, Artificial Sequence
  derived and/or modified sequence opt3 from anti-HIV-1_HeavyChain
caggccagacuggagcaaagcggcuccggggugaagaaacccggagcuucugucaggguuucaugcuggaccagugaagacaucuucgaggguagcgaacucauucacugggugcggcaggcaccuggccaggggcuugaguggauaggauggguaaagacagugacuggcgccgucaacuuugguuccgcguacuuccgccaucgagugucucugacgcgugauagagacuuguuuaccgcucacauggauaucaggggguuaacacagggagacacugccaccuauuucugugcacggcaaaaauuugcccgcggcgaucagggcugguucuuugaccugugggggagaggaacacuaauuguugugucgucagcuagcaccaaggguccaagugucuucccgcaugauuccgca

SEQ ID NO: 26646 - RNA, 414 nt, Artificial Sequence
  derived and/or modified sequence opt3 from anti-HIV-1_HeavyChain
caggugcaacugguccagagcggcgccgagguuaagaaacccggguccucugugaagguaucaugcaaagugaguggaggugucuucaccagcuacgcugugacauggguuagacaggcaccuggccaggggcucgaauggaucggaugggugaaggccgucuccggcgcggugaacuaugguucucuugacuuuaggcaccggguaucgcugacucgcgaucgagacuuguucacggcucauauggauauucguggguuaacccaagacgauacagccauauacuuuugugcaagacagaaauucgccaggggagaccagggcugguuuuucgaucuguggggccgggggacucuaaucguugugucaagcgcuaguaccaagggaccauccgucuuuccgcacgaccuccgc

SEQ ID NO: 26647 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccagcgagugucucugacgcgugauagagacuuguuuaccgcgcacauggauaucagggguuuaacacaaggggacacugcuaccuacuucugugcccggcagaaauuugaacgcggaggccagggcuggauuuucgaucugugggggagaggaacacuaaucgcaguuucgucagccagcaccaaggguccgaguguguuuccccaugaccucagg

SEQ ID NO: 26648 - RNA, 417 nt, Artificial Sequence
  derived and/or modified sequence opt3 from anti-HIV-1_HeavyChain
cagagccaccuggagcaauccggcucugccaugaagaaacccggggcuucagugaccgucaguugcuggacaagcgaagacaucuucgauacuacggagcucauuuacuggguuagacaggcaccuggacagggucuugaauggauaggcugggugaagaucguauccgggaccgugaacuuugccucucuggacuucaggaaucggauuucguugucacgcgaucgagacuuaagcacagcgcauauggauauccguggacugacucaggacgauaccgcuacauauuuuugugccagacaaaaauucgcaaguagguacuccggcgaccaggguucuuauuuugaucuaugggggcggggaacccucauuaucgucagcuccgccucaacuaagggcccaagugacgaucugcgc

SEQ ID NO: 26649 - RNA, 414 nt, Artificial Sequence
  derived and/or modified sequence opt3 from anti-HIV-1_HeavyChain
caggugcaacugguccagagcggcgccgagguuaagaaacccggggcuuccgugaagguaucuugcaaaucaaguggauacagcuucaccagauuugacaucacaugggugaggcaggcaccuggucagggccucgaauggauugggugggucaagacuguguccggagccguuaacuucggcucucuuaauuuucggcaccgcgugucgcugacgcgagaucgugacuuguucaccgcgcauauggauauaagagguuuaacacaaggggacacugcuaccuauuuuugugccaggcagaaauucgcacggggagaucagggcugguuuuucgaccuguggggccgcgggacacuaaucgucgugucaagcgccaguaccaagggaccauccguauuuccgcacgaucucaga

SEQ ID NO: 26650 - RNA, 420 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuguugugucaagcgccaguaccaaagguccaaucggccucccgccccgccugugcguc

SEQ ID NO: 26651 - RNA, 417 nt, Artificial Sequence
  derived and/or modified sequence opt3 from anti-HIV-1_HeavyChain
caggcccaccuggagcaaagcggcgcuggggugaagaaacccggagcauccgucagaguuucuugcuggaccucagaagacaucuucgagaggacagaacucauucauugggugcggcaggccccuggucagggccuugaguggauaggguggguaaagacugugacgggagcggucaacuuuggcaguccaaauuuccgccaccgagugagccugacccgugauagagacuuguuuacagcucauauggauaucagggguuuaacucagggggacaccgccacauacuucugugcacggcaaaaauuugaacgcggaggccagggcugguauuucgaucugugggggagaggaacccuaauuguuguguccucugccucgacuaaggguccgucagucuuuccccacgaccucagg

SEQ ID NO: 26652 - RNA, 420 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccacuuauuuuugugcacggcaaaaauucgcccgcggggaucagggaugguuuuucgaccucuggggcagaggcacccugauuguugugucgucagcuagcacaaaggggccuaguggaccauccccggaaaucugcguc

SEQ ID NO: 26653 - RNA, 417 nt, Artificial Sequence
  derived and/or modified sequence opt3 from anti-HIV-1_HeavyChain
caggcccaccuggagcaaagcggcgcuggggugaagagacccggagcauccgucaggguuucuugcuggaccucagaagacaucuucgagacaacugaacucauucauugggugcggcaggccccuggucagggccuugaguggauaggguggguaaaaacggugaguggagcggucaacuuuggcagccugaauuuccgccaccgaguguccuugacccgugauagagacuuauuuacagcucauauggauaucaggggucugacucagggggacaccgccacauacuucugugcacggcaaaaguuugcccgcggagaucagggcugguucuuugaccuauggggcagagggacccucauuguugugucuucggcuucaacuaaaggaccaagcgucuucccgcacgaucugagg

SEQ ID NO: 26654 - RNA, 417 nt, Artificial Sequence
  derived and/or modified sequence opt3 from anti-HIV-1_HeavyChain
agagcccaccuggagcagagcggcuccggggugaagaaacucggagcuucugucaggguuucaugcuggaccagugaagacaucuucgagcggacagaacuuauucauugggugcgccaagcacccggucagggccuggaguggauaggguggguaaaggccgugagcggagcggcuaacuacggcuccccuaauuuucgacagcgugucucuuugacuagagauagggacuuauucacggcccacauggauauccggggucugacccagggggacacagcaacuuauuuuugugcccgccaaaaauucgaaagaggaggccagggcuggauuuuugaucuaugggggaggggaacccucaucgcugugucgucagcaagcacaaaggguccaaguguuuucccgcaugaccugcgg

SEQ ID NO: 26655 - RNA, 417 nt, Artificial Sequence
  derived and/or modified sequence opt3 from anti-HIV-1_HeavyChain
caggugcaccuggagcaaagcggcuccggggucaagaaacucggagccucuguuagagugucaugcuggaccagugaagacaucuucgagaggacagaacuuauucauuggguacggcaggcucccggucagggccuggaguggauagggugggugaaggcagucagcggagccgugaacuacggcuccuuggauuuucgccaccgaguuucuuuaacucgugacagagaucuguucacggcgcauauggacaucaggggucuaacccaggaugacacagcuacuuauuuuugugcccggcaaaaauucgcacgcggggaucagggaugguuuuucgaccucuggggcagaggcacccugauuguggucucgucagccagcacaaaggggccuaguguguuuccacacgaucuuagg

SEQ ID NO: 26656 - RNA, 417 nt, Artificial Sequence
  derived and/or modified sequence opt3 from anti-HIV-1_HeavyChain
agagcccaccuggagcagagcggcuccggggugaagaaacccggagcuucugucaggguuucaugcuggaccagugaagacaucuucgagcggacagaacucauucauugggugcgccaagcaccuggucagggccuugaguggauaggguggguaaagaucgugagcggagccgucaacuuuggcuccccaaauuuccgacagcgugcgucucugacuagagauagggacuuguuuacggcucacauggauauucgggguuuaacccagggggacacagccacuuacuucugugcacgccaaaaauuugaaagaggaggccagggcuggaucuucgaucugugggggaggggaacccuaauugccgugucgucagcuagcacaaaggguccgaguguuuuucccaccaucuaugug

SEQ ID NO: 26657 - RNA, 414 nt, Artificial Sequence
  derived and/or modified sequence opt3 from anti-HIV-1_HeavyChain
caggugcaacugguccagagcgaggccgaaguuaagaaacccggcgcuuccgugaagaucucuugcgcaaccucaggguacgccuucacacucuauuaccuucacuggguaagacaggcgccuggacagggucuggaguggauuggcugggugaaaacugucacgggggcugugaacuuuggaagugccuauuucaggcaucggguuagcuugacccgcgaccgagauuuauuuacagcacacauggacauacguggccugacucaaggugauaccgccacauacuucugugcuagacagaaguuuuauaaagggggacagggcugguacuucgaccuauggggcagggggacccucaucguggucuccucugcaucgacuaagggaccaucaguguuuccgcaugaucugcgg

SEQ ID NO: 26658 - RNA, 420 nt, Artificial Sequence
  derived and/or modified sequence opt3 from anti-HIV-1_HeavyChain
caggcccaccccgagcaaagcggcuccggggugaagaaaccuggagcuucugucagaguuucaugcuggaccagugaagacaucuucgagaggacagaacugauucauugggugcggcaggcaccaggucagggccucgaguggauaggguggguaaagaucgugagcggagccgucaacuuuggcuccccgaauuuccgccagcgagugucucuuacucgugauagagaccuguuuacggcgcacauggauauuagggguuugacccaaggggacacagcuacuuacuucugugcccggcagaaauuugaacgcggaggccagggcuggaucuucgauuuaugggggagaggaacccugauugcaguuucgucagccagcacaaagggucccaguggccuaccuccaaggcucugcgug

SEQ ID NO: 26659 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugaacgcggaggccagggcugguauuucgaucugugggggagaggaacacuaauuguugugucgucagcaagcaccaaggguccgagugucuuucccccuagguccacu

SEQ ID NO: 26660 - RNA, 417 nt, Artificial Sequence
  derived and/or modified sequence opt3 from anti-HIV-1_HeavyChain
caggcccaccuggagcaaagcggcuccggggugaagagacccggagcuucugucaggguuucaugcuggaccagugaagacaucuucgagaaaagcgaacucauucauugggugcggcaggcaccuggucagggccuugaguggauaggguggguaaagacagugacuggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugaacgcggaggccagggcugguauuucgaucugugggggagaggaacacuaauuguugugucgucagcaagcaccaaggguccgagugucuuuccccacgaccucagg

SEQ ID NO: 26661 - RNA, 417 nt, Artificial Sequence
  derived and/or modified sequence opt3 from anti-HIV-1_HeavyChain
ggcgcccaccuggagcagagcggguccggagugaagaaacccggugcuucugucagaguuucaugcuggaccagugaagacaucuucgaaaagagcgagcucauucauugggugaggcaagcaccuggccaggggcuugaguggauaggauggguaaaaacagugacuggcgccgucaacuuugguuccucugauuuccggcagcgcgugucgcugacgcgagaccgugauuuguuuaccgcgcacauggacaucagaggguuaacacagggagauacugcuaccuacuucugugccaggcaaaaguuuuaugcaggcggccaggggugguacuucgaccuguggggacgggguacacuaauuguugugucaagcgccaguaccaaaggcccauccgucuuuccgcaugaucuccgc

SEQ ID NO: 26662 - RNA, 417 nt, Artificial Sequence
  derived and/or modified sequence opt3 from anti-HIV-1_HeavyChain
agacacgaccuggagcagagcggcuccggggugaagaaacccggagccucugucaggguuucaugcuggaccagugaagauaucuucgagcggacagaacucauucauugggugcgccaagcuccuggucagggccuugaguggauaggguggguaaagaucgugagcggagcagucaacuuuggcuccccaaauuuccgacagcgugugucucugacuagagacagggauuuguuuacggcccacauggacauucgggguuuaacccagggggauacagcgacuuacuucugugcucgccaaaaauuugaaagaggaggccagggcuggaucuucgaccugugggggaggggaacccuaauugccguuucgucagcaagcacaaaggguccgaguguguuuccccaugaucuccgg

SEQ ID NO: 26663 - RNA, 420 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaaucgcgcuauacaggaggccagggcugguacuucgaccuaugggggagaggaacccacaucgugguuucaagcgcaaguacuaaggguccauccgugacaauuuauguc

SEQ ID NO: 26664 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuguugugucaagcgccaguccagguccgaucggccccuccccucgcucugcu

SEQ ID NO: 26665 - RNA, 417 nt, Artificial Sequence
  derived and/or modified sequence opt3 from anti-HIV-1_HeavyChain
caggcccaccuggagcaaagcgcuuccggcgugaagagacccggggcaucugucaggguuucaugcuggaccagugaagacaucuucgagcggacagaacucauucauugggugcgccaggccccuggacagggucuugaguggauaggcuggguaaaaacugugacgggggcggucaacuuuggaagcuccgauuuccgacagcgugugucucugaccagagacagggauuuguuuacagcucacauggacauccggggcuuaacucaaggugauaccgccacauacuucugugcacgccagaaguuuuaugccgggggacagggcugguacuucgaccuguggggcagagggacccuaauuguugugucgucagcuagcacuaaaggaccaagugucuuuccgcaugaucucagg

SEQ ID NO: 26666 - RNA, 417 nt, Artificial Sequence
  derived and/or modified sequence opt3 from anti-HIV-1_HeavyChain
caggugcaacugguccagagcggcgccgagguuaagaaacccggggcuuccgugagaguaucuugcuggaccucagaagacaucuucgagaagagugaacucauucacugggugaggcaggcaccuggacagggucuugaguggauaggcugggucaaaacagugacuggggccguuaacuuuggaagcuccgauuuccggcaacgcgugucucugacgcgagaccgugauuuguuuaccgcgcauauggacaucagaggcuuaacacagggugauacugcuaccuacuucugugccaggcagaaguuuuaugcagggggacagggcugguacuucgaccuguggggccgggggacacuaauugucgugucgucagccagcaccaaaggaccaaguguauuuccgacuaucuauguu

SEQ ID NO: 26667 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugagcgcauaggguggguaaagacugugacgggagccgucaacuuuggcagcccaaauuuccgacaccgugugucccugaccagagauagggacuuguuuacagcgcauauggauauccgggguuuaacucagggggacaccgcuacauacuucugugcccgccaaaaauuugaaagaggaggccagggcugguauuucgaucugugggggaggggaacccuaauuguugugucuucggcaucaacuaaggguccgagcgucuuucccacaaucugcgug

SEQ ID NO: 26668 - RNA, 420 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauucauuggguuaggcaggcaccuggacagggucuugaauggauaggcugggugaagacgguauccggggccgugaacuuuggaucucugaauuuccggcaccgcgucucguugacccgagaccgugauuuauuuacagcgcauauggacaucagaggccugacucagggugauaccgcuacauacuucugugccaggcaaaaauuugcacgcggggaccagggaugguucuuugaucuauggggccggggcacccucauugugguuucaagcgccaguacuaacgggccaaucggaccgucccccacagaccugaga

SEQ ID NO: 26669 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucagugggugcggcaggcacccggucagggccuggaguggaugggguggguaaaggccgugagcggagcggucaacuacggcuccuuggauuuucgccaucgagugucuuuaacucgugacagagaucuguucacggcucacauggacauaaggggucuaacccaagaugacacagccacuuauuuuugugcacggcagaaauucgcccgcggggaucagggaugguuuuucgaccucuggggcagaggcacccugaucguugugucgucagcuagcacaaaggggccuagugucuuuccacaugaucuuagg

SEQ ID NO: 26670 - RNA, 417 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaaggccguauccggggcggugaacuauggaucucuggacuuucggcaucgcgucucguugacgcgagaucgugacuuaucaaccgcucacauggauaucagaggccugacacaggacgauacugccaccuacuucugugcaaggcaaaaauuugcccggggugaccaggggugguucuuugaucuauggggacgcggcacacucauugugguuagcagugcuuccaccaagggcccaucuguguucccgcaugaccugaga

SEQ ID NO: 26671 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugcccgcggggaucagggaugguucuuugaccucuggggcagaggcacccugauuguugugucaagcgcuaguacaaaggggccuuccgucuucccaaccaucuacgug

SEQ ID NO: 26672 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugaacgcggaggccagggcugguauuucgaucugugggggagaggaacccuaauuguugugucuucggcaucaacuaaggguccgagcgucuuuccccacgacccuagg

SEQ ID NO: 26673 - RNA, 423 nt, Artificial Sequence
  derived and/or modified sequence opt3 from anti-HIV-1_HeavyChain
cagguguacauggagcaagccggcgcugggaugaagaaacccggagcaagcaugaccgucuccugcaagacagccgacgaagauaucuucgacgcggcuuauaugcacuggguuagacaggccccuggucagacuuuugaguggcugggcuggaugaaaccagugacgggggcaguaaacuacgccaggcaguuccaaggacgggugucuuuuuaucgcacccgagaacucggcauugcuuacauggaucuucgugaccugaaguucgaugacacagcagucuauuuuugugccagaaaaacuaagggugaugugucaggggacgauaggggauucuuuuucgacuuguggggccggggcacccgcguuauagugaguagcgcuuccacaaaggggccgucugucuuuccccaugauuuaaga

SEQ ID NO: 26674 - RNA, 423 nt, Artificial Sequence
  derived and/or modified sequence opt3 from anti-HIV-1_HeavyChain
cagguguacauggagcaagccggcgggggaaugaagaaacccggugcuagcaugaccgucuccugcaagacagcagacgaagauaucuucgacgccgcguauaugcacuggguuagacaggcuaggggccagacuuuugaguggcugggguggaugaaaccugugacgggagccguaaacuacgcacggcaguuccaaggccgcgugucuuuuuaucgaacccgugaacucgguauugccuacauggaucuuagagaccugaaguucgaugacacagcugucuauuuuugugcaaggaaaacuaagggggaugugucaggagacgaucggggcuucuuuuucgacuuguggggccgcgggaccagaguuauagugaguagcgccuccacaaagggaccaucugucuuuccgaccaucuacgug

SEQ ID NO: 26675 - RNA, 423 nt, Artificial Sequence
  derived and/or modified sequence opt3 from anti-HIV-1_HeavyChain
cagguguacauggagcaagccggcgcuggggucaagaaacccggagcaagcguuacccuguccugcaagacagccgacgaagauguguucgacgcggcuuauaugcacuggguaagacaggccccuggucagacuuuugaguggcucggcuggaugaaaccagugacgggggcagucucuuacgccaggaaguuccagggacgggugucauuuuauaugacccgcgaacuuggcauggcuuacauggaucugcgaaacuugcguuucgacgauacagcaguuuauuuuugugccagaaaaacugcuggugacgugaguggggauaauaggggauacuucuuugacuuauggggccggggcagccgcgucaucguguccucugccucgaccaaggggccgucaguauuccccacaauuuauguu

SEQ ID NO: 26676 - RNA, 423 nt, Artificial Sequence
  derived and/or modified sequence opt3 from anti-HIV-1_HeavyChain
cagguguacagcggcgccgggagaggaggugucaagaaacccggcgcuuccguuacccugucuugcaagacagcagacgaggauguguucgacgccgcguauaugcacuggguaaggcaagcuccugggcagacuuuugaauggcucggauggaugaaaccagugacgggcgccgucaacuacgcacggaaguuccagggucgcgugucauuuuaucgaacccgugagcuugggaucgccuacauggaucugagaaauuugagguucgacgauacagcuguuuauuuuugugcacggaaaacugccggagacgugaguggcgauaagcgcggcuucuuuuucgacuuaugggggagaggaagcagggucauuguguccucugcuucgaccaaggguccgucaguauuucccacaauauacguu

SEQ ID NO: 26677 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugaacgcggaggccagggcugguauuucgaucugugggggagaggaacacuaauuguugugucgucagcauuuaccaaggguccgagcgucuucccccacgaccucagg

SEQ ID NO: 26678 - RNA, 414 nt, Artificial Sequence
  derived and/or modified sequence opt3 from anti-HIV-1_HeavyChain
caggugcaacugggccagagcggggccgagaugaagaaacccggauccucugucaagguuucaugcaaagcuagugguggcaccuucagacacagcccuaucuccugggugaggcaggcaccagggcagggacucgaauggauuggcuggguaaaggccgugucuggugcggucaacuacgggucgcuugacuuucggcaucgcgugucacugacacgagaucgugacuugagcacugcucacauggauauaagaggauuaacgcaagacgauaccgccacauauuucugugcaaggcagaaauuugcccggggcgaccagggcugguucuuugaucugugggggcgcggaacucuaaucguugugaguuccgcuucuaccaaggguccgagcgucuucccccaugaccucaga

SEQ ID NO: 26679 - RNA, 417 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagacgguaaccggggccgugaacuuuggauccccaaauuuccggcaucgcgucucucugacacgagaccgugauuuguuuacugcgcacauggacaucagaggcuuaacccagggugauacagcuaccuauuucugugccaggcaaaaauuugagcgcgggggacagggcugguacuucgaccuguggggccgggggacucuaauugugguuucgucagcaagcacaaagggaccgaguguguuuccccaugaucucaga

SEQ ID NO: 26680 - RNA, 423 nt, Artificial Sequence
  derived and/or modified sequence opt3 from anti-HIV-1_HeavyChain
cagguguacauggagcaagccggcgcuggggucaagaaacccggagcaagcguuacccuguccugcaagacagccgacgaagauguguucgacgcggcuuauaugcacuggguaagacaggccccuggucagacuuuugaguggcucggcuggaugaaaccagugacgggggcagucucuuacgccaggaaguuccagggacgggugucauuuuauaugacccgcgaacuuggcauggcuuacauggaucugcgaaacuugcguuucgacgauacagcaguuuauuuuugugccagaaaaacugcuggugacgugaguggggauaauaggggauacuucuuugacuuauggggccggggcagcugggucaucguguccucugccucgaccaaggggccgucaguauucccccaugaucugcgc

SEQ ID NO: 26681 - RNA, 423 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucaacuacgcaaggaaguuccagggccgggugucuuuuuaucgcacccgagaacuugguaucgccuacauggaucugcguaauuugagauucgacgauacagcuguuuauuuuugugcaaggaaaacugccggggacgugucaggagauaagcggggcuucuuuuucgacuuauggggccgcgggaguagagucauugugagcuccgcuucuaccaagggaccgucgguauuucccacaauaugcguu

SEQ ID NO: 26682 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucgcggccuggaguggauaggguggguaaaggccgugagcggagcggucaacuacggcuccuuggauuuucgacaccgugugucuuuaacuagagacagggaucuguucacggcucauauggacauccggggucuaacccaggaugacacagccacuuauuuuugugcacgccagaaauucgccagaggggaucaaggaugguuuuucgaccucuggggcaggggcacccugauuguugugucgucagcuagcacaaaggggccuagugucuuuccacacgaucuucgg

SEQ ID NO: 26683 - RNA, 423 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucaacuacgcaaggaaguuccagggccgggugucuuuuuaucgcacccgagaacuugguaucgccuacauggaucugcguaauuugagauucgacgauacagcuguuuauuuuugugcaaggaaaacugccggggacgugucaggagauaagcggggcuucuuuuucgacuuauggggccgcgggaguagagucauugugagcuccgcuucuaccaagggaccgucgguauuucccacaauauacguu

SEQ ID NO: 26684 - RNA, 423 nt, Artificial Sequence
  derived and/or modified sequence opt3 from anti-HIV-1_HeavyChain
cagguguucauggagcaagccggcgcugggaugaagaaacccggagcaagcaugaccgucuccugcaagacagccgacgaagauguuuuugacgcggcuuacaugcacugggugagacaggccccuggucagacuuucgaguggcugggcuggaugaaaccaguaacgggggcagugaacuaugccaggaaguuucagggacgggucucuuucuaccgcacccgagaacucggcaucgcuuauauggaucuucguaaucugagauuugacgauacagcaguguacuucugugccaggaaaacugcuggugacguuucaggggauaagcggggauuuuucuuugacuuguggggccgcggcaguagagugauugucagcuccgccucuaccaaggggccgucgguguucccccaugauuuaagg

SEQ ID NO: 26685 - RNA, 423 nt, Artificial Sequence
  derived and/or modified sequence opt3 from anti-HIV-1_HeavyChain
cagguguacauggagcaagccggcgcuggggucaagaaacccggagcaagcguuacccuguccugcaagacagccgacgaagauguguucgacgcggcuuauaugcacuggguaagacaggccccuggucagacuuuugaguggcucggcuggaugaaaccagugacgggggcagucaacuacgccaggaaguuccagggacgggugucuuuuuaucgcacccgagaacuuggcaucgcuuacauggaucugcguaauuugagauuagacgauacagcaguuuauuucugugccaggaaaacugcuggugacgugucaggggauaagcggggauuuuucuuugaccuguggggccgcggcaguagagucauugugagcuccgccucuaccaaggggccgucgguauucccccaugaucuaagg

SEQ ID NO: 26686 - RNA, 420 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaauucgaaagucuguacuccgaugaccaagguucuuauuuugaucuaugggggagaggaacccucaucauugucagcuccgccucaacuaagggcccaaguguguucccgacaauc

SEQ ID NO: 26687 - RNA, 423 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucucuuacgcaaggaaguuccagggccgggugucauuuuauaugacccgcgaacuugguauggccuacauggaucugcgaaacuugcguuucgacgauacagcuguuuauuuuugugcaagaaaaacugccggggacgugaguggagauaauaggggcuacuucuuugacuuauggggccgggggagccgcgucaucguguccucugcuucgaccaagggaccgucaguauuccccacaauuugcguu

SEQ ID NO: 26688 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguauuacgcaggaggccagggcugguauuuugaccugugggggcggggaacacuaauuguugugucaagcgccaguaccaaagguccauccgucuucccgcaugaucuccgc

SEQ ID NO: 26689 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaaucgcgcuauacaggaggccagggcugguacuucgaccuaugggggagaggaacccacaucgugguuucaagcgcaaguacuaaggguccauccguguuuccgcaugaucucagg

SEQ ID NO: 26690 - RNA, 423 nt, Artificial Sequence
  derived and/or modified sequence opt3 from anti-HIV-1_HeavyChain
cagguguacaugggcgccgggagaggaggugucaagaaacccggcgcuagcguuacccuguccugcaagacagcagacgaggauguguucgacgccgcguauaugcacuggguaaggcaagcuccugggcagacuuuugaauggcucggauggaugaaaccagugacgggcgccgucaacuacgcacggaaguuccagggucgcgugucuuuuuaucgaacccgugagcuugggaucgccuacauggaucugagaaauuugagguucgacgauacagcuguuuauuuuugugcacggaaaacugccggagacgugucaggcgauaagcgcggcuucuuuuucgacuuaugggggagaggaaguagggucauugugagcuccgcuucuaccaaggguccgucgguauuucccacaauauacguu

SEQ ID NO: 26691 - RNA, 423 nt, Artificial Sequence
  derived and/or modified sequence opt3 from anti-HIV-1_HeavyChain
cagguguacauggagcaagccggcgggggaaugaagaaacccggugcuagcaugaccgucuccugcaagacagcagacgaagauaucuucgacgccgcguauaugcacuggguuagacaggcuccuggccagacuuuugaguggcugggguggaugaaaccagugacgggagccguaaacuacgcaaggcaguuccaaggccgggugucuuuuuaucgcacccgagaacucgguauugccuacauggaucuucgugaccugaaguucgaugacacagcugucuauuuuugugcaagaaaaacuaagggggaugugucaggagacgauaggggcuucuuuuucgacuuguggggccgggggacccgcguuauagugaguagcgccuccacaaagggaccgucugucuuucccaccaucugcgug

SEQ ID NO: 26692 - RNA, 423 nt, Artificial Sequence
  derived and/or modified sequence opt3 from anti-HIV-1_HeavyChain
cagguguacauggagcaagccggcgggggaaugaagaaacccggugcuagcaugaccgucuccugcaagacagcagacgaagauaucuucgacgccgcguauaugcacuggguuagacaggcuccuggccagacuuuugaguggcugggguggaugaaaccagugacgggagccguaaacuacgcaaggcaguuccaaggccgggugucuuuuuaucgcacccgagaacucgguauugccuacauggaucuucgugaccugaaguucgaugacacagcugucuauuuuugugcaagaaaaacuaagggggaugugucaggagacgauaggggcuucuuuuucgacuuguggggccgggggacccgcguuauagugaguagcgccuccacaaagggaccgucugucuuuccccaugauuuaaga

SEQ ID NO: 26693 - RNA, 423 nt, Artificial Sequence
  derived and/or modified sequence opt3 from anti-HIV-1_HeavyChain
cagguguacauggagcaagccggcgcuggggucaagaaacccggagcaagcguuacccuguccugcaagacagccgacgaagauguguucgacgcggcuuauaugcacuggguaagacaggccccuggucagacuuuugaguggcucggcuggaugaaaccagugacgggggcagucaacuacgccaggaaguuccagggaaaagugucuuuuuaucggacccgcgaacuuggcaucgcuuacauggaucugcgaaauuugcguuucgacgauacagcaguuuauuuuugugccagaaagacugcuggugacgugucaggggauaagaggggauucuuuuucgacuuauggggccggggcagucgcgucauugugagcuccgccucuaccaaagggccgucgguauuuccccaugaucugaga

SEQ ID NO: 26694 - RNA, 423 nt, Artificial Sequence
  derived and/or modified sequence opt3 from anti-HIV-1_HeavyChain
cagguguacauggagcaagccggcgcuggggucaagaaacccggagcaagcguuacccuguccugcaagacagccgacgaagauguguucgacgcggcuuauaugcacuggguaagacaggccccuggucagacuuuugaguggcucggcuggaugaaaccagugacgggggcagucaacuacgccaggaaguuccagucucgggugucauuuuauggaacccgcgaacuuggcaucgcuuacauggaucugcgaaauuugcguuucgacgauacagcaguuuauuuuugugccagaaaaacugcuggugacgugaguggggauaagaggggauucuuuuucgacuuauggggccggggcagccgcgucauuguguccucugccucgaccaaggggccgucaguauuuccccaugaucugaga

SEQ ID NO: 26695 - RNA, 420 nt, Artificial Sequence
  derived and/or modified sequence opt3 from anti-HIV-1_HeavyChain
cagggccacaccguggagcaaagcggguccggagucaagaaacugggugccucuguuagagugucaugcuggacaagugaagacaucuucgagacuacggaacucauucauuggguaaggcaggcucccggccaggggcuugaguggauaggaugggugaagaccgucagcggcgcagugaacuuugguucccugaauuuccggcaccgcguuucuuugacacgagaucgugacuuauuuacugcccauauggauaucagagggcugacccagggagacacagcgaccuacuucugugcuaggcaaaaauuugcccggggcgaucagggcugguucuuugaccuaugggggcgcggaacucucauuguggucucgucagcaagcacaaaggguccuaguguguucccacacgaucugaga

SEQ ID NO: 26696 - RNA, 420 nt, Artificial Sequence
  derived and/or modified sequence opt3 from anti-HIV-1_HeavyChain
caggccacccccuggagcaaccugggcagaggggugaagaaacucggagcuuccgucaggguuucuugcuggacaucagaggacaucuucgaacggacugagcuuauucacugggugcgccaagcaccuggucagggccuggaauggauaggguggguaaagacggugaccggagccgucaauuuuggcaguccaaacuuccgacaucgugugagcuugacaagagauagggacuuauuuacugcgcacauggauauccggggucugacccagggggacacagcuaccuacuucugugcccgccagaaauuugagagaggaggccaaggcugguauuucgaucuaugggggaggggaacucucauuguuguguccucugcaucgacaaaggguccgucagucuuuccccaugaccugcgg

SEQ ID NO: 26697 - RNA, 423 nt, Artificial Sequence
  derived and/or modified sequence opt3 from anti-HIV-1_HeavyChain
cagguguucauggagcaagccggcgcugggaugaagaaacccggagcaagcaugaccgucuccugcaagacagccgacgaagauguuuuugacgcggcuuauaugcacugggugagacaggccccuggucagacuuucgaguggcugggcuggaugaaaccaguaacgggggcagugucuuaugccaggaaguuucagggacgggucucauucuacaugacccgcgaacucggcauggcuuauauggaucuucgaaaccugcguuuugacgauacagcaguguacuucugugccagaaaaacugcuggugacguuaguggggauaauaggggauacuuuuucgacuuguggggccggggcagccgcgugaucgucuccucugccucgaccaaggggccgucaguguuuccccaugauuuaaga

SEQ ID NO: 26698 - RNA, 423 nt, Artificial Sequence
  derived and/or modified sequence opt3 from anti-HIV-1_HeavyChain
cagguguacauggagcaaagcggcgggggagucaagaaacccggugccuccguuacccugucuugcaagacagcugacgaagauguguucgacgcagccuauaugcacuggguaagacaggcgccuggccagacuuuugaguggcucggguggaugaaaccagugacgggagcugucucauacgccaggaaguuccagggccgggugaguuuuuaucgcacccgagaacuugguaucgcauacauggaucugcguaacuugagauucgacgauacagccguuuauuuuugugcuaggaaaacugcaggggacgugagcggagauaagcggggcuucuuuuucgacuuauggggccgcggguccagagucauugugucuucggccucaaccaagggaccgagcguauuuccccaugaucugagg

SEQ ID NO: 26699 - RNA, 423 nt, Artificial Sequence
  derived and/or modified sequence opt3 from anti-HIV-1_HeavyChain
cagguguacauggagagaggcaggggaggggucaagaaacccggugccagcguuacccuguccugcaagacagcugacgaagauguguucgacgcagccuauaugcacuggguacggcaagcgccuggccagacuuuugaguggcucggguggaugaaaccagugacgggagcugucaacuacgcccgcaaguuccagggccgagugucuuuuuaucguaccagagaacuugguaucgcauacauggaucugaggaauuugcgguucgacgauacagccguuuauuuuugugcucgcaaaacugcaggggacgugucaggagauaagagaggcuucuuuuucgacuuauggggcagggggagucgggucauugugagcuccgccucuaccaagggaccgucgguauuuccccaugaucugcgc

SEQ ID NO: 26700 - RNA, 423 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucucuuacgcaaggcgguuccagggccgcgugucauuuuauaugacccgagaacuugguauggccuacauggaucugcguaacuugagauucgacgauacagcuguuuauuuuugugcaaggaagacugccggggacgugaguggagauaaucggggcuacuucuuugacuuauggggccgcgggagcagagucaucguguccucugcuucgaccaaaggaccgucaguauuccccacaauuugcguu

SEQ ID NO: 26701 - RNA, 423 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucucuuacgcaaggaaguuccagggccgggugucauuuuauaugacccgcgaacuugguauggccuacauggaucugcgaaacuugcguuucgacgauacagcuguuuauuuuugugcaagaaaaacugccggggacgugaguggagauaauaggggcuacuucuuugacuuauggggccgggggagccgcgucaucguguccucugcuucgaccaagggaccgucaguauucccccaugaucugaga

SEQ ID NO: 26702 - RNA, 423 nt, Artificial Sequence
  derived and/or modified sequence opt3 from anti-HIV-1_HeavyChain
cagguguucauggagcaagccggcgggggaaugaagaaacccggugcuagcaugaccgucuccugcaagacagcagacgaagauaucuuugacgccgcguacaugcacuggguuagacaggcuccuggccagacuuucgaguggcugggguggaugaaaccagugacgggagccguaaacuaugcaaggcaguuucaaggccgggugucuuucuaccgcacccgagaacucgguauugccuauauggaucuucgugaccugaaguuugaugacacagcugucuacuucugugcaagaaaaacuaagggggaugugucaggagacgauaggggcuuuuucuuugacuuguggggccgggggacccgcguuauagugaguagcgccuccacaaagggaccgucugucuucccccaugauuuaaga

SEQ ID NO: 26703 - RNA, 423 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagccuggauuuccgccaccgaaucuccuugacccgugacagagauuuauuuacagcgcauauggacauuaggggucugacucagggggauaccgcuacauacuucugugcccggcaaaaauuugcaucucgcuauucgggagaccagggcucauacuucgaucuauggggcagagggacccucaucgugguuagcagugccuccacuaagggaccaucuguguuuccgcacgaccug

SEQ ID NO: 26704 - RNA, 423 nt, Artificial Sequence
  derived and/or modified sequence opt3 from anti-HIV-1_HeavyChain
cagguguucauggagcaagccggcgcugggaugaagaaacccggagcaagcaugaccgucuccugcaagacagccgacgaagauguuuuugacgcggcuuacaugcacugggugagacaggccccugguccagaucuggaguggcucggcuggaugaaaccgguaacuggggcagugaacuaugccaggaaguuccagggacgggucucuuuuuaccgcacgcgagaacuuggcaucgcuuauauggaccugcgugauuugagauucgacgauaccgcaguguacuuuugugccaggaaaacagcuggugacguuucaggggauaagcggggauucuuuuucgacuuauggggccgcggcaguagagugauugucagcuccgccucuacuaaggcgcauaggucgucacccaccauaugcgug

SEQ ID NO: 26705 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgaaucucccugacccgugauagagacuuguuuacagcgcauauggauauuagggguuuaacucagggggacaccgcuacauacuucugugcccggcaaaaauuugaaucucgcuauaccggaggccagggcugguacuucgaucugugggggagaggaacucacaucgugguuucgucagcaagcacaaaggguccgaguguguuuccccaugaccuaagg

SEQ ID NO: 26706 - RNA, 423 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucucuuacgcaaggaaguuccagggccgggugucauuuuauaugacccgcgaacuugguauggccuacauggaucugcgaaacuugcguuucaaugacacagcuguuuauuuuugugcaagaaaaacugccggggaugugaguggagacaacaggggcuacuucuuugauuuauggggccgggggagccgcgucaucguguccucugcuucgaccaagggaccgucaguauucccccaugaccugaga

SEQ ID NO: 26707 - RNA, 423 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucaacuacgcaaggaaguuccagggccgggugucuuuuuaucgcacccgagaacuugguaucgccuacauggaucugcguaauuugagauucgacgauacagcuguuuauuuuugugcaaggaaaacugccggggacgugucaggagauaaccggggcuacuucuuugacuuauggggccgcgggaguagagucauugugagcuccgcuucuaccaagggaccgucgggucugccccaugaucuaagg

SEQ ID NO: 26708 - RNA, 423 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucaacuacgcaaggaaguuccagggccgggugucuuuuuaucgcacccgagaacuugguaucgccuacauggaucugcguaauuugagauucgacgggacagcuguuuauuuuugugcaaggaaaacugccggagaugugucaggcgacaagcggggcuucuuuuucgauuuaugggggcgcggaaguagagucauugugagcuccgcuucuaccaaggguccgucgguauuuccccaugaccugagg

SEQ ID NO: 26709 - RNA, 423 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucaacuacgcaaggaaguuccagggccgggugucuuuuuaucgcacccgagaacuugguaucgccuacauggaucugcguaauuugagauucgacgauacagcuguuuauuuuugugcaaggaaaacugccggggacgugucaggagauaagcggggcuucuuuuucgacuuauggggccgcgggaguagagucauugugagcuccgcuucuaccaagggaccgucgguauuuccccaugaucugagg

SEQ ID NO: 26710 - RNA, 423 nt, Artificial Sequence
  derived and/or modified sequence opt3 from anti-HIV-1_HeavyChain
caggugcaacugguccagagcggcgccgagguuaagaaacccggggcuucccucaaggugucuugcaaagcaucaggauacaccuucacagacuauuacauccacuggguaagacaggccccuggucagggccuugaauggauugggugggugaagauagucaguggaacugugaacuuugcgagccuggauuucaggaaucggaucuccuugucucgcgaccgagauuuaucgacggcuuauauggacauucguggccugacccaagaugacacagccacuuacuuuugugcaagacagaaauucgccucaagguauagcggugaucaggggaguuacuuugaccuauggggacggggcacccucaucguuguguccucugcuagcacaaagggcccauccgucuucccgcaugaucugcgc

SEQ ID NO: 26711 - RNA, 423 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaaucgcgcuauacaggaggccagggcugguacuucgaccuaugggggagaggaacccucaucgugguuucaagcgcaaguacuagggcccaccgguccccacaugaucugcgc

SEQ ID NO: 26712 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccagcgagugucccugacccgugauagagacuuguuuacagcgcacauggauaucagggguuuaacucaaggggacaccgcuacauacuucugugcccggcagaaauuugaaucucgcuauaccggaggccagggcugguacuucgaucugugggggagaggaacucauauuguugugucgucagcaagcacaaaggguccgagugucuuuccccacgaccuaagg

SEQ ID NO: 26713 - RNA, 426 nt, Artificial Sequence
  derived and/or modified sequence opt3 from anti-HIV-1_HeavyChain
caggugcaacugguccagagcggcgccgagguuaagaaacccggggcuuccgugagaguaucuugcuggaccucagaagacaucuucgauacaacugagcucauuuacugggugaggcaggcaccuggacagggucuugaauggauaggcugggucaagaucgugagugggacgguuaacuuugccagccuggacuuccggaaucgcauuuccuugucucgagaucgugacuuaucgaccgcguauauggauaucagaggacugacacaagacgauacugcuaccuacuuuugugccaggcagaaauucgcaucacgguauagcggcgaccaggguaguuacuuugaucuaugggggcgcggaacacucauuguggucuccucugccagcaccaagggcccauccguguucccgcagaucugcgua

SEQ ID NO: 26714 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcuggaugaagacuguguccgggacgguaaacuuuggaucuucggauuuccgaaaucguaucucacugaccagagacagggauuugagcacagcccauauggacauucggggcuuaacucaggaugacaccgcgacauauuuuugugcucgccagaaauucgaaagucuguacuccgaugaccaagguucuuauuuugaucuaugggggagaggaacccucaucauugugagcuccgccucaacuaaggcacacaggaguagcccaacaacccugcgg

SEQ ID NO: 26715 - RNA, 423 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgcaagucgguacuccggcgaccaggguucuuauuuugaucuaugggggcgcggaacacucauuaucgucagcuccgccucaaccaagggcccaaguguguucccgagaagcgcu

SEQ ID NO: 26716 - RNA, 423 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggccaccagaucuccgaucgggugucucugucgcgcgaccgagauuugucaacggcguacauggacauucgugguuuaacccaagaugacacagcuacuuauuucugugccagacagaaguuugcaagcagguacaguggggaucagggauccuauuucgaccuguggggccggggcacccuaaucguugugucuagcgccuccacaaaagggccaucagucuuuccgcaugaucuccgc

SEQ ID NO: 26717 - RNA, 423 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgcaagucgguacuccggcgaccaggguucuuauuuugaucuaugggggcgcggaacacucauuaucgucagcuccgccucaaccagagcucacaggaguagcccacggucugca

SEQ ID NO: 26718 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcaccgcaucucgcugacgcgagaccgugauuuguuuaccgcgcauauggacauuagagguuuaacacagggggauacugcuaccuacuucugugccaggcaaaaguuugaaucacgguauacaggaggccagggcugguacuucgaccugugggggcgcggaacccacaucgugguuagcagugcauccacuaaagguccaucuguguuuccgcaugaucuaaga

SEQ ID NO: 26719 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuuggaucuucggacuuccggaaucgcauuucacugacccgagaucgugacuugagcacagcccauauggauaucagaggcuuaacucaggacgauaccgcgacauauuuuugugcuaggcaaaaauucgagagucuguacuccgacgaucaggguucuuauuuugaccuaugggggcggggaacccucauuaucgucagcuccgccucaacuaagggcccaaguguguucccgacaauauacguu

SEQ ID NO: 26720 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcguauauggauaucagaggacugacacaggacgauacugcuaccuacuuuugugccaggcaaaaauucgcaagucgguauuccggcgaccaggguucuuacuuugaucuaugggggcgcggaacacucauugucgugagcuccgccucaaccaagggcccaaguguuuucccgcaugaccugaga

SEQ ID NO: 26721 - RNA, 423 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgcaagucgguacuccggcgaccaggguucuuauuuugaucuaugggggcgcggaacacucauuaucgucagcuccgccucaaccaagggcccaaguguguucccgacuauaugc

SEQ ID NO: 26722 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuugucuacagcgcauauggauaucagggguuuaacucaggacgauaccgcuacauacuuuugugcccggcaaaaauucgcacgcggggaccagggaugguuuuucgaucuguggggcagaggcacccuaauuguugugucgucagcccuccaccaggggccgaucggacugcccccuaggagcacu

SEQ ID NO: 26723 - RNA, 423 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucaacuacgcaaggaaguuccagggccgggugucuuuuuaucgcacccgagaacuugguaucgccuacauggaucugcguaauuugagauucgacgauacagcuguuuauuuuugugcaaggaaaacugccggggacgugucaggagauaagcggggcuucuuuuucgacuuauggggccgcgggaguagagucauugugagcuccgcuucuaccaagggaccgucgguacugcccccuaggucagcc

SEQ ID NO: 26724 - RNA, 423 nt, Artificial Sequence
  derived and/or modified sequence opt3 from anti-HIV-1_HeavyChain
caggugcaacugguccagagcggcgccgagguuaagaaacccggggcuuccgugaagaucucuugcaaagcaucaggauacaccuucauuagacacgguauacauuggcucaggcagguaccuggccagcggccagaauggaugggguggauccgcccgaagacaggagcccgaaaccaagcgcgucaguuucagcccagaauuagucuugcuagggaccgggcccugagcacugcauauuuggauuuaaauucccugacgucugccgacucgggcaccuacuucugugcucgccagacauuuaaaccugauuucuauuuugcagaccaagguuggucauucaaccuaugggggagaggagcccacuuuaucgugagcagugcucuccaucagggcccaauuggccugcccccuagguccacu

SEQ ID NO: 26725 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacagggucuugaguggauaggcugggugaagaucguauccgggacugugaacuuugccucucuggauuuccgcaaucgaauuucguugucacgugacagagauuuaagcacggcguauauggacaucaggggacugacccaggaugacacagcuacuuacuuuugugcccggcaaaaauucgcaagucgcuauuccggcgaucaggguucuuacuuugaccuaugggggagaggaacccucauugucgugagcuccgccucaacaaagggcccaaguguuuucccgcaugaucugagg

SEQ ID NO: 26726 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagccuggauuuccgccaccgaaucuccuugacccgugacagagauuuauuuacagcgcauauggacauuaggggucugacucagggggauaccgcuacauaccuaugugcccggcaaaaauucgaaucucgcuauaccggaggccagggcugguacuuugaccucugggggagaggaacucacaucgugguuucgucagcaagcacaaaggguccaaguguguucccgaccauuugcguc

SEQ ID NO: 26727 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgauacaacugagcucauuuacugggugaggcaggcaccuggucagggccuugaauggauaggguggguaaagaucgugagcggaacggucaacuuugccucccuggacuuccggaaucgcauuucuuugucgcgagaucgugacuuaucaaccgcguauauggauaucagaggccugacacaggacgauacugcuaccuacuuuugugccaggcaaaaauucgcaagccgguauaguggugaccagggguccuacuuugaucuauggggacgcggcacacucauugugguuucuagcgccuccaccaagggcccaucaguguucccgcagaucugcguc

SEQ ID NO: 26728 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagccuggauuuccgccaccgaaucuccuugacccgugacagagauuuauuuacagcgcauauggacauuaggggucugacucagggggauaccgcuacauacuucugugcccggcaaaaauuugaaucucgcuauaccggaggccagggcugguacuucgaccuaugggggagaggaacucacaucgugguuucgucagcaagcacaaaggguccaaguguguuuccgaccauuugcguc

SEQ ID NO: 26729 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugaaucacuguauagcgacgaucagggaaguuacuucgaccuauggggccggggcacacucauuaucguuuccucugcaagcaccaaagggccauccguguuuccgacuauuugcguc

SEQ ID NO: 26730 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugaaucgcgcuauacaggaggccagggcugguacuucgaucugugggggagaggaacccacauuguugugucaagcgcaaguacuaaggguccguccgucuuuccccaugaccuaagg

SEQ ID NO: 26731 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgcaagucgguacuccggcgaccaggguucuuauuuugaucuaugggggcgcggaacacucauuaucgucagcuccgccucaaccaagggcccaaguguguucccgacuauaugcguu

SEQ ID NO: 26732 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggaaccgucaacuuuggcagccugaauuuccgccagcgaguguccuugacacgugauagagacuuauuuacugcccacauggauaucaggggucugacccaagacgauacagcgaccuacuucugugcucggcagaaauuugccucucgcuauucgggggaccagggaucauacuucgaucuauggggcagaggcacucucauuguugugagcagugcauccacaaaggggccaucugucuuuccgaccaucugcgug

SEQ ID NO: 26733 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgcaagucgguacuccggcgaccaggguucuuauuuugaucuaugggggcgcggaacacucauuaucgucagcuccgccucaaccaagggccacagaaguagcccaacuauaugcgug

SEQ ID NO: 26734 - RNA, 423 nt, Artificial Sequence
  derived and/or modified sequence opt3 from anti-HIV-1_HeavyChain
cagguguacauggagcaagccggcgcugggaugaagaaacccggagcaagcaugaccgucuccugcaagacagccgacgaagauguuuucgacgcggcuuauaugcacugggugagacaggccccuggucagacuuuugaguggcugggcuggaugaaaccaguaacgggggcagugaacuacgccaggaaguuccagggacgggucucuuuuuaucgcacccgagaacucggcaucgcuuacauggaucuucguaaucugagauucgacgauacagcaguguauuuuugugccaggaaaacugcuggugacguuucaggggauaagcggggauucuuuuucgacuuguggggccgcggcaguagagugauugucagcuccgccucuaccaaggggccgucgguguuucccacaauauacgua

SEQ ID NO: 26735 - RNA, 423 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucuacuggguuaggcaggcaccuggacagggucuugaauggauuggcugggugaagauaguauccgggacggugaacuuugccucucuggacuuccggaaucgcaucucguugucacgagaucgugacuuaagcaccgcguauauggauauuagaggacugacacaggacgauacugcuaccuacuuuugugccaggcaaaaauucgcaagucgguauuccggcgaccaggguucuuacuuugaucuaugggggcgcggaacacucaucgucgugagcuccgccucaaccaagggcccaaguguuuucccgcaugaccugaga

SEQ ID NO: 26736 - RNA, 423 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugcccggcaguuccaaggacgcgucucuuuuuaucgaacccgugagcugggcauugcguacauggacuugagagauuuaaaauucgacgauacagcuguguauuuuugugccaggaagacuaaaggugacguuucgggggaugaccggggauucuuuuucgaucuguggggccgcggcaccagagugaucgucucaagcgcaaguacaaaggggccauccguguuuccgcaugaccccgcc

SEQ ID NO: 26737 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugaaucacgguauacaggaggccagggcugguacuucgaccugugggggcgcggaacccauauuguugugagcagugcauccacuaaagguccaucugucuuuccgacaaucugcgug

SEQ ID NO: 26738 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggagcgaacucauucauugggugcggcaggcaccuggucagggccuugaguggauaggguggguaaagacagugacuggagccgucaacuuuggcuccccaaauuuccgccagcgagugucucugacgcgugauagagacuugucgaccgcgcacauggauaucagggguuuaacacaagacgauacugcuaccuacuuuugugcccggcagaaauucgaaucacuguauagcgacgaucaggggaguuacuuugaccuauggggacgcggcacacucauuaucguuuccucugcaagcaccaagggcccguccguguuccccacuauuugcguc

SEQ ID NO: 26739 - RNA, 426 nt, Artificial Sequence
  derived and/or modified sequence opt3 from anti-HIV-1_HeavyChain
caggcccaccuggagcaaagcgcuuccggcgugaagagacccggggcaucugucaggguuucaugcuggaccagugaagacaucuucgagcggacagaacucauuuacugggugcgccaggccccuggacagggucuugaguggauaggcuggguaaaaacugugagcggggcggucaacuuuggaucccaggauuuccgagaccguuuuucucugacgagagauagggacuuguucaccgcucauauggauauccggggcuuaacacaaggugacacugccaccuauuuuugugcacgccagaaguucgccucgagauacucaggggaucagggaagcuauuuugaccuguggggcaggggcacacuaauugugguuaguuccgcuucuaccaaagggccaagcguguucccgacuaucugcguc

SEQ ID NO: 26740 - RNA, 426 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccacuuauuuuugugcacggcaaaaauucgaaucgcgcuacaccgggggacagggcugguauuuugaucucuggggcagagggacacacauuguugugucaagcgccaguaccaagggaccuuccgucuucccaacuaucugcgug

SEQ ID NO: 26741 - RNA, 423 nt, Artificial Sequence
  derived and/or modified sequence opt3 from anti-HIV-1_HeavyChain
caggugcacauggagcaagccggcgggggaaugaagaaacccggugcuagcaugaccgucuccugcaagacagcagacgaagauaucuucgacgccgcguacaugcauuggguuagacaggcuccuggccagacuuuugaguggcugggguggaugaaaccagugacgggagccguaaacuaugcaaggcaguuccaaggccgggugucuuuucuccaggaucaggguauucgcauagccuacauggaccuucgagaucugaaguucgacgauaccgcugucuauuuuugugcacguaaaacaaagggggacgugucaggagaugacagaggcuucuuuuucgauuuguggggcagggggacucggguuaucgugaguagcuccuuacaccagggaccgauuggucugcccccucgcucugcc

SEQ ID NO: 26742 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcaccgcaucucgcugacgcgagaccgugauuuguuuaccgcgcauauggacauuagagguuuaacacagggggauacugcuaccuacuucugugccaggcaaaaguuugaaucacgguauacaggaggccagggcugguacuucgaccugugggggcgcggaacccacaucgugguuagcagugcauccacuaaagguccaucuguguuuccgacaauuuauguc

SEQ ID NO: 26743 - RNA, 426 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucaacuacgcaaggaauuuccagggccgggugucuuuuuaucgcacccgagaacuugguaucgccuacauggaucugcguaacuugagauucgacgauacagcuguuuauuuuugugcaaggaagacuaaaggggacgugucaggagaugaccggggcuucuuuuucgauuuauggggccgcgggaccagagucauugugaguagcggacugcaucaaagggcccaccgguccucuccgacaauaugcgua

SEQ ID NO: 26744 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcguauauggauaucagaggacugacacaggacgauacugcuaccuacuuuugugccaggcaaaaauucgcaagucgguauuccggcgaccaggguucuuacuuugaucuaugggggcgcggaacacucauugucgugagcuccgccucaaccaagggcccaaguguuuucccgacuaucugcgug

SEQ ID NO: 26745 - RNA, 423 nt, Artificial Sequence
  derived and/or modified sequence opt3 from anti-HIV-1_HeavyChain
cagguguacauggagcaagccggcgucgggguuaagaaacccggagcuagcgugacccuguccugcaagacagcagacgaagauguauucgacgccgcguauaugcacugggugagacaggcuccugguccagaucucgaguggcuuggcuggaugaaaccggucacuggggccgugaacuacgcaaggaaguuucagggacggguuucuuucuaucgcacgcgagaacugggcaucgccuacauggacuugcguaauuuaagauuugaugacaccgcuguguauuucugugcaaggaaaacagccggugaugucucaggggacaagcggggauuuuucuuugaucuguggggccgcggcaguagagugauuguaagcuccgcuucuacuaaggggcccucgguuuucccuaccauaugcgug

SEQ ID NO: 26746 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgcaagucgguacuccggcgaccaggguucuuauuuugaucuaugggggcgcggaacacucauuaucgucagcuccgccucaaccaagggcccaaguguguucccgcacgaccugaga

SEQ ID NO: 26747 - RNA, 426 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugacuggagcggucaacuuuggcagcuuggauuuccgccaccgaaucuccuuaacgcgugacagagaucuguuuaccgcucauauggacauuaggggucuaacacagggggauacugccaccuacuucugugcacggcaaaaauuugaaucucgcuauacaggaggccagggcugguacuucgaccucugggggagaggaacccacaucgugguuucgucagccagcacuaaggguccuaguguguuuccacaugaucugagg

SEQ ID NO: 26748 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugagcgcauaggguggguaaagacugugacgggagccgucaacuuuggcagccuggauuuccgacaccguaucuccuugaccagagacagggauuuauuuacagcgcauauggacauucggggucugacucagggggauaccgcuacauacuucugugcccgccaaaaauuugaaucuagauauaccggaggccagggcugguacuucgaccuaugggggaggggaacucacaucgugguuucgucagcaagcacaaaggguccaaguguguuuccgaccauuugcguc

SEQ ID NO: 26749 - RNA, 423 nt, Artificial Sequence
  derived and/or modified sequence opt3 from anti-HIV-1_HeavyChain
gagguguacauggaaagaggcaggggaggggucaagaaacccggugccagcgcuacccuguccugcaagacagcagacgaggauguuuucgacgccgcguauaugcacugggugcggcaggcuccuggccaaacuuuugaauggcucggguggaugaaaccaguaacgggagccgugucuuacgcacgcaaguuccagggccgagucucauuuuauaugacccgugagcuugguauggccuacauggaucugagaaacuugagguucgacgauacagcuguguauuuuugugcacggaaaacugccggggacguuaguggagauaaucgcggcuacuucuuugacuuauggggcagagggagcagggugaucgucuccucugcuucgaccaagggaccgucaguguucccccaugaucugcgg

SEQ ID NO: 26750 - RNA, 426 nt, Artificial Sequence
  derived and/or modified sequence opt3 from anti-HIV-1_HeavyChain
caggcccaccuggagcaaagcggcuccggggugaagaaacccggagcuucugcaagagucucaugcuggaguagcgaagacaucuucgagaggauugaacucauacauuggguucggcaggccccuggucagggccuugaguggaucgggugggugaagaccguagcgggagcugugaacuuuggcucccuggauuuccgccaccgaauuucuuugacacgugacagagauuuauuuacugcccauauggacaucaggggucugacgcagggggauaccgcaacauacuucugugcccggcaaaaauuugaaucgcgcuauacuggaggccagggcugguacuucgaccuaugggggagaggaacccacauugucgugucaagcgcuaguacaaaggguccauccguuuuuccgcaugaucucagg

SEQ ID NO: 26751 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugaggcaggacgauacagcuacuuauuuuugugcccggcaaaaauucgagagucgcuacuccggcgaccaggguucuuauuuugaucuaugggggagaggaacccucauuaucgucagcuccgcaucaacaaagggcccaaguguguucccgaccauauacguu

SEQ ID NO: 26752 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaauggaauuucguugucacgcgaucgagacuuaagcaccgcguauauggauauccguggccugacacaggacgauacugcuaccuacuuuugugccagacaaaaauucgcaaguagguauuccggugaccaggggucuuacuuugaucuauggggacggggcacacucauugucgugagcuccgccucaaccaagggcccaaguguuuucccgcaugaccugcgc

SEQ ID NO: 26753 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgcaagucgguacuccggcgaccaggguucuuauuuugaucuaugggggcgcggaacacucauugucgugagcuccgccucaaccaagggcccaaguguuuucccgcacgaccugaga

SEQ ID NO: 26754 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccaguggugacauccucaggaaaagcgaacuuauucauugggugcggcaggcaccuggccaggggcuggaguggauaggauggguaaagacagugacuggcgccgucaacuucgguuccuuggauuuucgccaccgaaucucuuuaacgcgugacagagaucuguucaccgcgcauauggacauuagggggcuaacacagggagauacugcuaccuacuuuugugcccggcaaaaguucgaaucgcgcuauacaggcggccaggggugguacuuugaccucuggggaagagguacccacaucgugguuucaagcgcaaguacuaaaggcccauccguguucccgcaugaucugagg

SEQ ID NO: 26755 - RNA, 426 nt, Artificial Sequence
  derived and/or modified sequence opt3 from anti-HIV-1_HeavyChain
caggugcaccuggagcaaagcggcuccggggucaagaaacccggagccucuguuagagugucaugcuggaguagcgaagacaucuucgagaggaccgaacucauucauuggguacggcaggcuccuggucagggccuugaguggauagggugggugaagacagucacuggagcagugaacuuuggcucccuggauuuccgccaccgaaucucuuugacgcgugacagagauuuauuuaccgcccauauggacauuaggggucugacacagggggauacugcgaccuacuucugugcucggcaaaaauuugaaucgcgcuauacaggaggccagggcugguacuucgaccuaugggggagaggaacccacaucguugugucaagcgccugcacuaaggguccaagugucuuuccgcaugaucucagg

SEQ ID NO: 26756 - RNA, 426 nt, Artificial Sequence
  derived and/or modified sequence opt3 from anti-HIV-1_HeavyChain
caggcccaccuggagcaaagcugguccggcgugaagaaacccggggcuucugucagaguuucaugcuggaguagcgaagacaucuucgagaggaccgaacucauucauugggugcggcaggcaccuggacagggucuugaguggauaggcuggguaaagacagugacuggggccgucaacuuuggaucccuggauuuccgccaccgaaucucuuugacgcgugacagagauuuauuuaccgcgcauauggacauuaggggccugacacagggugauacugcuaccuacuucugugcccggcaaaaauuugaaucgcgcuauacagggggacagggcugguacuucgaccuauggggcagagggacccacaucgugguuucaagcgcaaguacuaagggaccauccguguuuccgcaugaucucagg

SEQ ID NO: 26757 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcgguccagaguggauaggcugggugaagacuguauccgggacggugaacuuuggaucuucggauuuccgaaaucguaucucacuuaccagagacagggaucugagcacagcccauauggacauucggggcuugacucaggaugacaccgcgacauauuuuugugcucgccagaaauucgaaaguuuauacuccgaugaccaagguucuuauuuugaucugugggggagaggaacccuaaucauugucagcuccgccucaacuaagggcccgaguguguucccccacgaccucagg

SEQ ID NO: 26758 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaaucgcgcuauacaggaggccagggcugguacuucgaccuaugggggagaggaacccacaucgugguuucaagcgcaaguacuaaggguccauccguguuuccgacaauucucagg

SEQ ID NO: 26759 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaauucgaaagucuguacuccgaugaccaagguucuuauuuugaucuaugggggagaggaacccucaucgccgucagcuccgcaucaacuaagggcccaaguguguucccgcacgaccugagg

SEQ ID NO: 26760 - RNA, 426 nt, Artificial Sequence
  derived and/or modified sequence opt3 from anti-HIV-1_HeavyChain
cagagccaccugaagcaauccggcucugccaugaaaaagcccggggcuucagugagagucaguugcuggaccagcgaggacaucuucgaaaggacagagcucauuuacuggguucggcaggcaccuggacgcggucuugaauggauaggcugggugaaaacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaguucgagagucuguacuccgaugaccaagguucuuauuuugaucuaugggggagaggaacccucaucauugucagcuccgccucaacuaaaggcccaaguguguucccgcacgaccugagg

SEQ ID NO: 26761 - RNA, 426 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauagaauggguaaaggccgugagcggggcggucaacuacggauccuuggauuuucgccaccgagugucuuuaacucgugacagagaucuguucacggcucauauggacaucaggggccuaacccaggaugacacagccacuuauuuuugugcacggcaaaaauucgagucgcgcuacaccggugggcagggaugguauuuugaucucuggggcagaggcacacacauuguugugucaagcgccaguaccaaggggccuuccgucuucccacaugaccugagg

SEQ ID NO: 26762 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgagagucgguacuccggcgaccaggguucuuauuuugaucuaugggggcgcggaacacucauuaucgucagcuccgcaucaaccaagggcccaaguguguucccgcacgaccugaga

SEQ ID NO: 26763 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcucccuggauuuccggaaucgcaucucuuugucgcgagaccgugauuuaucaacggcguacauggacauuagaggucugacccaggaugacacagcuacuuauuuuugugccaggcaaaaguucgcaagccgguacaguggggaucagggauccuauuuugaccuauggggccgcggcacccucaucgugguuucuagcgccuccacaaaagggccaucaguguucccgcacgaucugaga

SEQ ID NO: 26764 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggagcgaacucauucauugggugcggcaggcaccuggucagggccuugaguggauaggguggguaaagacagugacuggagccgucaacuuuggcuccccaaauuuccgccagcgagugucucugucgcgugauagagacuugucaacggcgcacauggauaucagggguuuaacccaagacgauacagcuacuuacuuuugugcccggcagaaauucgcaagccgcuauaguggggaccagggauccuacuuugaucuguggggcagaggcacccuaauuaucguuucuagcgccuccacaaaggggccgucaguguucccccaugaccucagg

SEQ ID NO: 26765 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaauucgaaagucuguacuccgaugaccaagguucuuauuuugaucuaugggggagaggaacccucaucauugucagcuccgccucaacuaagggcccaaguguguucccgcacgaccugagg

SEQ ID NO: 26766 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucgcggccuugaguggauaggguggguaaagacugugagcggaacggucaacuuuggcuccucugauuuccgaaaucguaucucgcugaccagagacagggauuugucaacagcccacauggacauucgggguuuaacucaggaugacaccgcgacauacuuuugugcucgccagaaauucgaaagccuguauagugaugaccaaggguccuacuuugaucuauggggaagaggcacccucaucauugugucuagcgccuccacuaagggcccaucaguuuucccgcaugaccugagg

SEQ ID NO: 26767 - RNA, 426 nt, Artificial Sequence
  derived and/or modified sequence opt3 from anti-HIV-1_HeavyChain
caggugcaccuggagcaaagcggcuccggggucaagaaacccggagccucuguuagagugucaugcuggaguagcgaagacaucuucgagaggaccgaacucauucauuggguacggcaggcuccuggucagggccuugaguggauagggugggugaagacagucacuggagcagugaacuuuggcucccuggauuuccgccaccgaaucucuuugacgcgugacagagauuuauuuaccgcccauauggacauuaggggucugacacagggggauacugcgaccuacuucugugcucggcaaaaauuugaaucgcgcuauacaggaggccagggcugguacuucgaccuaugggggagaggaacccacaucguugugucaagcgccaguacuaaggguccauccgucuuuccgcaugaucucagg

SEQ ID NO: 26768 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugaggcaggacgauacagcuacuuauuuuugugcccggcaaaaauucgagagucgcuacuccggcgaccaggguucuuauuuugaucuaugggggagaggaacccucauuaucgucagcuccgcaucaacaaagggcccaaguguguucccgcacgaccugagg

SEQ ID NO: 26769 - RNA, 423 nt, Artificial Sequence
  derived and/or modified sequence opt3 from anti-HIV-1_HeavyChain
cagguguacauggagcaagccggcgcuggggucaagaaacccggagcaagcguuacccuguccugcaagacagccgacgaagauguguucgacgcggcuuauaugcacuggguaagacaggccccuggucagacuuuugaguggcucggcuggaugaaaccagugacgggggcagucucuuacgccaggaaguuccagggacgggugucauuuuauaugacccgcgaacuuggcguugcuuacauggaucugcgaaacuugcguuucgacgauacagcaguguauuuuugugccagaaaaacugcuggugacgucaguggggauaauaggggauacuucuuugacuuauggggccggggcagccgcgugaucguauccucugccucgaccaaggggccgucaguuuucccccaugaucugaga

SEQ ID NO: 26770 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucguaacuuaagcaccgcgcauauggacaucagaggacugaggcaggaugacacagcuacuuauuuuugugcccggcaaaaauucgagagucgcuacuccggcgaucaggguucuuauuuugaccuaugggggagaggaacccucauuaucgucagcuccgcaucaacaaagggcccaaguguguucccgcacgaucugagg

SEQ ID NO: 26771 - RNA, 423 nt, Artificial Sequence
  derived and/or modified sequence opt3 from anti-HIV-1_HeavyChain
caggugcaacugguccagagcggcgccgagguuaagaaacccggggcuuccgugacccucucuugcaagacagcagacgaagauguauucgacgccgcguacaugcacugggugagacaggcuccuggacagacuuuugaguggcuugguuggaugaaaccagucacgggcgccgugucauaugcaaggaaguuccaagggcggguuaguuuuuacaugacccgcgaacugggaauggccuauauggauuugcgaaacuuacguuucgacgauacagcuguguacuuuugugcaagaaaaacugccggcgacgucagcggugauaauaggggguauuucuuugaccuguggggacggggcucccgcgugaucguaucuucggcuucaaccaagggcccgagcguuuuccccacaauuuacgug

SEQ ID NO: 26772 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucgugcauuggguacggcaggcaccuggucagggccuugaguggauugggugggugaagacugucacgggagccgugaacuuuggcagcccaaauuuccgccagcgaguuucccugacccgugauagagacuuguuuacagcgcacauggauauaagggguuuaacucaagacgauaccgcuacauacuucugugcccggcagaaauuugcaucucgcuauucgggggaccagggaucauacuucgaucuguggggcagaggcacccuaaucguggucagcagugccuccacuaaggggccgucuguguuuccccaugaccucagg

SEQ ID NO: 26773 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcguauauggauaucagaggacugacacaggacgauacugcuaccuacuuuugugccaggcaaaaauucgcaagucgguauuccggcgaccaggguucuuacuuugaucuaugggggcgcggaacacucauuaucgucagcuccgccucaaccaagggcccacugggccuuccgcaugaccugaga

SEQ ID NO: 26774 - RNA, 426 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugccucacgcuacagcggggaucagggaaguuauuucgaccucuggggcagaggcacccugauuguuguguccucugcuagcacaaaggggccuuccgucuuuccacacgaucuuagg

SEQ ID NO: 26775 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauuuacugggugcggcaggcaccuggucagggccuugaguggauaggguggguaaagaucgugagcggaacugucaacuuugccucccuggauuuccgcaaucgaauuucuuugucgcgugacagagauuuaucaacggcgcauauggacaucaggggccugacccaggaugacacagcuacuuauuuuugugcccggcaaaaauucgcaagccgcuacaguggugaucagggguccuauuuugaccuauggggaagaggcacccucauuaucgugucuagcgccuccacaaagggcccaucaguuuucccgcacgaucugagg

SEQ ID NO: 26776 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgcaaccgaaucucccugacccgugauagagacuugucuacagcgcacauggauauuagggguuuaacucaggacgauaccgcuacauacuuuugugcccggcaaaaauucgaaucgcuguauucagacgaucaggggagcuacuuugaccuauggggacgcggcacccucaucauugugaguuccgcaucuacuaagggcccgagcguuuucccccaugaucugaga

SEQ ID NO: 26777 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugaaucacuguauagcgacgaucagggaaguuacuucgaccuauggggccggggcacacucauuaucguuuccucugcaagcaccaaagggccauccguguuuccgcaugaucugcgc

SEQ ID NO: 26778 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcuccgauuuccgcaaucgaaucucucugacccgugacagagauuugucgacagcgcacauggacauuagggguuuaacucaggaugacaccgcuacauacuuuugugcccggcaaaaauucgaaucacuguauagcgaugaccaggggaguuacuuugaucuauggggacgcggcacccucaucauuguguccucugcaagcacuaagggcccauccguuuucccgcaugaccugaga

SEQ ID NO: 26779 - RNA, 426 nt, Artificial Sequence
  derived and/or modified sequence opt3 from anti-HIV-1_HeavyChain
cagagccaccuggagcaauccggcucugccaugaagaaacccggggcuucagcaagagugaguugcuggaccagcgaagacaucuucgauacaacugagcucauuuacugggucaggcaggccccuggacagggucuugaauggauaggcuggguuaagaucguguccgggacgguaaacuuugcgucucuggacuuccggaaucgcauuucguugucacgagaucgugacuuaagcaccgcucauauggauaucagaggacugacacaggacgauacugccaccuauuuuugugcaaggcaaaaauucgccagucgguacuccggcgaccaggguucuuauuuugaucuaugggggcgcggaacacacauuguggucagcuccgcuucaaccaagggcccaaguguguucccgcaugaccucaga

SEQ ID NO: 26780 - RNA, 426 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccacuuauuuuugugcacggcaaaaauucgaaucgcgcuacaccgggggacagggcugguauuuugaucucuggggcagagggacacacauuguugugucaagcgccaguaccaagggaccuuccgucuucccacaugaccugagg

SEQ ID NO: 26781 - RNA, 426 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugaaucacgcuacaccgggggacagggcugguauuucgaucucuggggcagagggacacacauuguugugagcagugccuccaccaagggaccuucugucuuuccacaugaccugagg

SEQ ID NO: 26782 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaauucgccaguagauacuccggugaucaagggucuuauuuugaccuguggggaaggggcacccuaaucauugucagcuccgcaucaacuaagggcccaaguguguucccgcacgaucuccgg

SEQ ID NO: 26783 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccggauggacauucgcggcuuaacucaggaugacaccgcgacauauuuuugugcuagacagaaauucgaaagucuguacuccgaugaccaagguucuuauuuugaucuaugggggaggggaacccucaucauugucagcuccgccucaacuaagggcccaaguguguucccgacagaccugcgg

SEQ ID NO: 26784 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaagaugacacugcuaccuacuucugugccaggcagaaguuugcaucacgguauagcggggaucagggaaguuacuucgaccuguggggccgcggcacacuaauuguuguguccucugccagcaccaaagggccauccgucuuuccgcaugaucucaga

SEQ ID NO: 26785 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaauucgaaagucuguacuccgaugaccaagguucuuauuuugaucuaugggggagaggaacccucaucauugucagcuccgccucaacuaacggcccaaucggccugccgcacgaccuuagg

SEQ ID NO: 26786 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugaaucacgguauacaggaggccagggcugguacuucgaccugugggggcgcggaacccauauuguugugagcagugcauccacuaaagguccaucugucuuuccgcacgaucuaaga

SEQ ID NO: 26787 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucaggacgauaccgcuacauacuucugugcccggcaaaaauuugcaucucgcuauucgggggaccagggaucauacuucgaucuguggggcagaggcacccuaauuguugugagcagugccuccacuaaggggccgucugucuuuccccacgaccucagg

SEQ ID NO: 26788 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacaggacucauuuacuggguucggcaggcaccuggucgcggccuugaauggauagggugggugaagacuguauccggaacggugaacuuugguucuucggauuuccgaaaucguaucucacugaccagagacagggauuugagcacagcccauauggacauucggggcuuaacucaggaugacaccgcgacauauuuuugugcucgccagaaauucgagagucuguacuccgaugaccaagggucuuauuuugaucuauggggaagaggcacccucaucauugucagcuccgccucaacuaagggcccaaguguguucccgcacgaccugagg

SEQ ID NO: 26789 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagccagaucuuccgccaccgaauuucccugacccgugauagagacuuguuuacagcgcauauggauaucagggguuuaacucaaggggacaccgcuacauacuucugugcccggcagaaauuugaaucucgcuauaccggaggccagggcugguacuucgaucugugggggagaggaacucacauugugguuucgucagcaagcacaaaggguccaaguguguuuccgcaugaccuaagg

SEQ ID NO: 26790 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauucauuggguuaggcaggcaccuggacagggucuugaauggauaggcugggugaagacgguaaccggggccgugaacuuuggaucccuggacuuccggcaccgcaucucuuugacacgagaucgugacuuauuuacugcgcauauggauauuagaggccugacccagggugacacagcuaccuacuucugugccaggcaaaaauuugagucgcgguauacugggggacagggcugguacuucgaucuauggggccgcgggacacacaucgucgugucaagcgcaaguaccaagggaccauccguuuuuccgcaugaccucaga

SEQ ID NO: 26791 - RNA, 426 nt, Artificial Sequence
  derived and/or modified sequence opt3 from anti-HIV-1_HeavyChain
cagagccaccuggagcaauccggcucugaagugaagaaacccggggccucagucagaguuaguugcuggaccagcgaggacaucuucgaaaggacagagcucauuuacugggugcggcaggcuccuggacgcggucuugaauggauaggcuggguaaagacuguguccgggacggucaacuuuggaucuucggauuuccgaaaucguaucucacugaccagagacagggauuugagcacagcacauauggacauucggggcuuaacucaggaugacaccgccacauauuuuugugcgcgccagaaauucgagagucuguacuccgaugaccaagguucuuauuuugaucuaugggggagaggaacccucaucauugugagcuccgcuucaacuaagggcccaaguguuuucccgcacgaccugagg

SEQ ID NO: 26792 - RNA, 423 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauaucuucgacgccgcguauaugcacugggugagacaggcuccuggccagacuuuugaguggcucggguggaugaaaccaguaacgggagccgugaacuacgcaaggcaguuccaaggccgggucucuuuuuaucgcacccgagaacuugguauugccuacauggaucugcgugacuugaaguucgaugacacagcuguguauuuuugugcaagaaaaacuaagggggauguuucaggagacgauaggggcuucuuuuucgacuuauggggccgggggacccgcgugauagucaguagcgccuccacaaagggaccgucuguguuuccccaugaucugaga

SEQ ID NO: 26793 - RNA, 426 nt, Artificial Sequence
  derived and/or modified sequence opt3 from anti-HIV-1_HeavyChain
cagagccaccuggagcaauccggcucugaagugaagaaacccggggccucagucagaguuaguugcuggaccagcgaggacaucuucgauacaacugaacucauuuacugggugaggcaggcuccuggacagggucuugaguggauaggcuggguaaagaucguguccgggacggucaacuuugcaucucuggacuuccggaaucgcauuucguugucacgagaucgugacuuaagcaccgcccauauggauaucagaggacugacacaggacgauacugcgaccuauuuuugugcuaggcaaaaauucgccagucgguacuccggcgaccaggguucuuauuuugaucuaugggggcgcggaacacucauuaucgugagcuccgcaucaaccaagggcccaaguguuuucccgcacgaccugaga

SEQ ID NO: 26794 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugucgcgugauagagacuugucaacggcguacauggauaucagggguuuaacccaggacgauacagcuacuuauuuuugugcccggcaaaaauucgcaagccgcuacaguggggaccagggauccuauuuugaucuguggggcagaggcacccuaauuguugugucuagcgccuccacaaaggggccgucagucuucccccaugaccucagg

SEQ ID NO: 26795 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaaucgcgcuauacaggaggccagggcugguacuucgaccuaugggggagaggaacccacaucgugguuucaagcgcaagugccaaggguccauccguguuuccgcaugaucucagg

SEQ ID NO: 26796 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgagaggacagaacucauuuacuggguucggcaggcaccuggacgcggucuugaguggauaggcugggugaagacuguauccgggacggugaacuuuggaucuucggauuuccgaaaucguaucucacugaccagagacagggauuugagcacagcccauauggacauucggggcuuaacucaggaugacaccgcgacauauuuuugugcucgccagaaauucgaaagucuguacuccgaugaccaagguucuuauuuugaucuaugggggagaggaacccucaucgucgugagcuccgccucaacuaagggcccaaguguuuucccgcccaggagcgca

SEQ ID NO: 26797 - RNA, 426 nt, Artificial Sequence
  derived and/or modified sequence opt3 from anti-HIV-1_HeavyChain
caggugcacauggagcaagccggcgggggagucaagaaacccggugcuagcguuacccuguccugcaagacagcagacgaagauguguucgacgccgcguacaugcauuggguaagacaggcuccuggccagacuuuugaguggcucggguggaugaaaccagugacgggagccgucaacuaugcaaggaaguuccagggccgggugucuuuuuaccgcacccgagaacuugguaucgccuauauggaucugcguaauuugagauucgacgauacagcuguuuacuuuugugcaaggaaaacuaagggggacgugucaggagaugaccggggcuucuuuuucgauuuauggggccgcgggaccagagucauugugaguagcgccuccacaaagggaccgcugaggucuuuuccccggcgcucggcu

SEQ ID NO: 26798 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaaucgcgcuauacaggaggccagggcugguacuucgaccuaugggggagaggaacccacaucgugguuucaagcgcaaguacuaaggguccauccguguuuccgacaauuuauguc

SEQ ID NO: 26799 - RNA, 426 nt, Artificial Sequence
  derived and/or modified sequence opt3 from anti-HIV-1_HeavyChain
gagagccaccuggaacaguccggcucugccaugaagaaacccggggcuucagugagagucaguugcuggaccagcgaggacaucuucgauacaacugaacucauuuacuggguuaggcaagcaccuggacagggucuugaguggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcagaaauucgcaagucgguacuccggcgaccaagguucuuauuuugaucuaugggggcgcggaacacucauuaucgucagcuccgccucaaccaagggcccaaguguguucccgcacgaccugaga

SEQ ID NO: 26800 - RNA, 429 nt, Artificial Sequence
  derived and/or modified sequence opt3 from anti-HIV-1_HeavyChain
caggcccaccucgagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaagacgauacagcuacuuacuucugugcccggcagaaauuugcaucgcgcuauucaggggaccagggaagcuacuucgaucuguggggcagaggcacccuaaucguugugaguuccgccucuacaaaggggccgagcggacugcccccuagguccugcguc

SEQ ID NO: 26801 - RNA, 423 nt, Artificial Sequence
  derived and/or modified sequence opt3 from anti-HIV-1_HeavyChain
caggugcaccugguccaaagcggcgccgagguuaagaaacccggggcuuccgugaagguaucuugcaaagcaucaggauacaccuucacaacgagugguauccauuggcucagacaggugccuggccagaggccagaauggaugggguggauucggccgaagacuggagcccgcaaccaggcgcgacaauuucagccccguauaagccuuaccagagacagggcucuguccacagccuauuuggauuuaaauucucugacuucggcagacucaggcaccuacuucugugcccggcagacauuuaaaccugauuucuauuuugcugaccaggguuggagcuucaaccuaugggggcgcggagcacacuuuaucgucaguuccgccucuaccaagggcccaagcguguucccccaugaucucaga

SEQ ID NO: 26802 - RNA, 429 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaaucgcgcuauacaggaggccagggcugguacuucgaccuaugggggagaggaacccacaucgugguuucaagcgcaaguacucaggguccaauuggccucccgcccaggcugugcgug

SEQ ID NO: 26803 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgcaagucgguacuccggcgaccaggguucuuauuuugaucuaugggggcgcggaacacucauuaucgucagcuccgccucaaccaagggcccaauaggccugccgcccagaaguacu

SEQ ID NO: 26804 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcucccuggauuuccggcaccgcaucucuuugacgcgagaccgugauuuauuuaccgcgcauauggacauuagaggucugacacagggggauacugcuaccuacuucugugccaggcaaaaguuugaaucgcgguauacaggaggccagggcugguacuucgaccuaugggggcgcggaacccacaucgugguuucaagcgcaaguacuaaagguccauccguguuuccgacaauuugcguc

SEQ ID NO: 26805 - RNA, 426 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccagggggauacagccacuuauuuuugugcacggcaaaaauucgaaucgcgcuacaccggaggccagggcugguauuuugaccucugggggagaggaacacacauuguugugucaagcgcccugcaucaggguccuaucggccuuccaccgaggaguacc

SEQ ID NO: 26806 - RNA, 429 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcgucucguugucacgagaucgugacuuaagcaccgcguauauggauauuagaggacugacacaggacgauacugcuaccuacuuuugugccaggcaaaaauucgcaagucgguauuccggcgaccaggguucuuacuuugaucuaugggggcgcggaacacucaucgugguuagcuccgcccugcaucagggcccaauuggcccgucacccaccauccuuaga

SEQ ID NO: 26807 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgcaagucgguacuccggcgaccaggguucuuauuuugaucuaugggggcgcggaacacucauuaucgucagcuccgccucaaccaagggcccaaguguguucccgacuauauacguu

SEQ ID NO: 26808 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcguauauggauaucagaggacugacacaggacgauacugcuaccuacuuuugugccaggcaaaaauucgagagucgguauacaggcggucaggggugguacuuugaccuauggggacgcggcacccauauugucguguccucugcaagcacuaagggcccauccguuuucccgacaaucugcgug

SEQ ID NO: 26809 - RNA, 426 nt, Artificial Sequence
  derived and/or modified sequence opt3 from anti-HIV-1_HeavyChain
caggugcaacugguccagagcggcgccgagguuaagaaacccggggcuuccgugagaguaucuugcuggaccucagaagacaucuucgauacaacugagcucauuuacugggugaggcaggcaccuggacagggucuugaauggauaggcugggucaagaucgugagugggacgguuaacuuugccagccuggacuuccggaaucgcauuuccuugucucgagaucgugacuuaucgaccgcgcacauggauaucagaggacugacacaagacgauacugcuaccuauuuuugugccaggcagaaauucgagucacgguacacaggcggucaggggugguauuuugaccuauggggacgcggcacccauauuguggucagcagugcauccacuaagggcccaucuguguucccgacaaucugcgua

SEQ ID NO: 26810 - RNA, 426 nt, Artificial Sequence
  derived and/or modified sequence opt3 from anti-HIV-1_HeavyChain
agaaggcaccuggagcagagcggcuccggggugaagaaacccggagccucuguccggguuucaugcuggaguagcgaagacaucuucgagcgcaccgaacucauucauugggugcgacaagcuccuggucagggccuugaguggauaggguggguaaagacagugacuggagcagucaacuuuggcucccuggauuuccgucacagaaucucuuugacgagggaccgggauuuauuuaccgcccauauggacauucgcggucugacacagggggauacugcgaccuacuucugugcuagacagaaauuugaaucgagguauacaggaggccaaggcugguacuucgaccuaugggggcggggaacccacaucgugguuucaagcgccaguacuaaggguccauccguguuuccgcaugaucuccgc

SEQ ID NO: 26811 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcguauauggauaucagaggacugacacaggacgauacugcuaccuacuuuugugccaggcaaaaauucgagagucgguauuccggcgaccaggguucuuacuuugaucuaugggggcgcggaacacucauuaucgucagcuccgcaucaaccaagggcccaaguguguucccgacuauaugcguu

SEQ ID NO: 26812 - RNA, 429 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagccuggauuuccgccaccgaaucuccuugacccgugacagagauuuauuuacagcgcauauggacauuaggggucugacucagggggauaccgcuacauacuucugugcccggcaaaaauuugaaucucgcuauaccggaggccagggcugguacuucgaccuaugggggagaggaacucacaucgugguuucgucagcaagcacaaaggguccacauccgguguuuccccacgaucucccu

SEQ ID NO: 26813 - RNA, 426 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauuuacugggugcggcaggcacccggucagggccuggaguggauaggguggguaaagaucgugagcggaacugucaacuuugccuccuuggauuuccgcaaucgaauuucuuuaucgcgugacagagaucugucaacggcguauauggacaucaggggccuaacccaggaugacacagcuacuuacuuuugugcccggcaaaaauucgcaagccgcuauaguggugaucagggguccuacuuugaccucuggggaagaggcacccugauugugguuucuagcgccuccacaaagggcccuucaguguucccaaccaucuauguc

SEQ ID NO: 26814 - RNA, 429 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggcacggcaggccccuggucagggccuugaguggauagggugggugaagacuguaacgggagcggugaacuuuggcagccuggauuuccgccaccgaaucuccuugacccgugacagagauuuauuuacagcucauauggacauuaggggucugacucagggggauaccgccacauacuucugugcacggcaaaaauuugaaucucgcuauaccggaggccagggcugguacuucgaccuaugggggagaggaacucacaucgucgugucgucagccagcacaaaggguccacucggccugccgcccaggcuuagucgg

SEQ ID NO: 26815 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcgcauauggauaucagaggacugacacaggacgauacugcuaccuauuuuugugccaggcaaaaauucgcaagucgguacuccggcgaccaggguucuuauuuugaucuaugggggcgcggaacacucauuaucgucagcuccgccucaaccaagggcccaaguggccugccgcccagaagcgcu

SEQ ID NO: 26816 - RNA, 426 nt, Artificial Sequence
  derived and/or modified sequence opt3 from anti-HIV-1_HeavyChain
caggugcaacugguccagagcggcgccgagguuaagaaacccggggcuuccgugagaguaucuugcuggaccucagaagacaucuucgauacaacugagcucauuuacugggugaggcaggcaccuggacagggucuugaauggauaggcugggucaagaucgugagugggacgguuaacuuugccagccuggacuuccggaaucgcauuuccuugucucgagaucgugacuuaucgaccgcgcacauggauaucagaggacugaggcaagacgauacagcuacuuauuuuugugcccggcagaaauucgagucacgcuacagcggcgaccaggguaguuauuuugaucuaugggggagaggaacccucauuaucguguccucugcaagcacaaagggcccauccgucuucccgcaugaccugagg

SEQ ID NO: 26817 - RNA, 426 nt, Artificial Sequence
  derived and/or modified sequence opt3 from anti-HIV-1_HeavyChain
gaggcccaccuggaacagagcggcuccggggugaagaaacccggagcuucugucagaguuucaugcuggaccagugaggacaucuucgaaaggacagagcucauucauugggugcggcaagcaccuggucagggccuugaauggauaggguggguaaagaucgugagcggaacugucaacuuugccucccuggauuuccgcaaucgaauuucuuugucgcgugacagagauuuaucaacggcguacauggacaucaggggccugacccaggaugacacagcuacuuauuuuugugcccggcagaaauucgcaagccgcuacaguggugaucaaggguccuauuuugaccuauggggaagaggcacccucauugugguuucuagcgccuccacaaagggcccaucaguguucccgcacgaucugagg

SEQ ID NO: 26818 - RNA, 423 nt, Artificial Sequence
  derived and/or modified sequence opt3 from anti-HIV-1_HeavyChain
caggugcaacugguccagagcggcgccgagguuaagaaacccggggcuuccgugaagguaucuugcagagcaucaggauacaccuucgguaaccacgccaucaguugggugaggcaggcgccuggccaggggcucgaauggaugggauggauucggccaaaaacaggcgcucgcaaucaagcccgacaguuucagccgcguauaagccuuacuagagacagggcacuguccacggccuauuuggauuuaaacucucugaccucggcugacucagguacauacuucugugcacggcagacuuuuaagcccgauuucuauuuugccgaccaaggguggagcuucaaucuauggggacgcggcgcucauuuuaucgucaguuccgccucuaccaaaggcccuagcguguucccacacgaucucaga

SEQ ID NO: 26819 - RNA, 429 nt, Artificial Sequence
  derived and/or modified sequence opt3 from anti-HIV-1_HeavyChain
cagggccacaaccuggagcaaagcggguccgaagugaagaaacccggagccucugucagaguuucaugcuggaccagugaggacaucuucgaaaggacagagcucauucauugggugcggcaggcuccuggucagggccuugaauggauaggguggguaaagacugugacgggagcagucaauuuuggcagccuggauuuccgccaccgaaucuccuugacccgugacagagauuuauuuacagcccauauggacauuaggggucugacucagggggauaccgcgacauacuucugugcucggcaaaaauuugagucucgcuauaccggaggccagggcugguacuucgaccuaugggggagaggaacucacaucgugguuucgucagccagcacaaaggguccaaguguguuuccgcaugaucucagg

SEQ ID NO: 26820 - RNA, 426 nt, Artificial Sequence
  derived and/or modified sequence opt3 from anti-HIV-1_HeavyChain
cccaccacauggaacaagagcggcuccgacgugaaaaagccuggggccucugucagaguuucaugcuggacgagugaggauaucuucgaaaggacugagcugauucacugggugcggcaggcuccaggacaaggucucgaauggauaggcuggguaaaaaccgugacaggggcagucaauuuuggaagcccgaacuuccgccaucgagugucccuuacucgugacagagaucugucuaccgcccacauggacaucaggggcuugacacaggaugacaccgcgacuuacuuuugugcucggcagaaguucgagucguuauauucagaugaccaggguagcuacuuugaucugugggggcgcggaacacuaauuaucguuaguuccgccucuaccaaaggccccagcguguucccucaugaccucaga

SEQ ID NO: 26821 - RNA, 432 nt, Artificial Sequence
  derived and/or modified sequence opt3 from anti-HIV-1_HeavyChain
cacgugacccccuggaacgaguacgucggcagagccaugaagaaaccugggaggagcguucggguguccugcuggacaucugaagacaucuucgauacuacggagcugauuuauuggguacgccaggcuccaggacaaggucucgaauggauaggcugggugaagaucgucucagggaccgugaauuuugcaagucuugacuuccgaaaccguauuagccuguccagagauagggacuugucuacagccuacauggauauccggggauuaacucaggacgauaccgcgacauauuuuugugcucgccagaaauucgccucgagauacucaggcgaccaggguagcuauuuugaucugugggggaggggaacccuaauuguugugaguuccgcaucuacuaagggcccgagcgucuucccccaugaccuccgg

SEQ ID NO: 26822 - RNA, 372 nt, Artificial Sequence
  derived and/or modified sequence opt3 from anti-HIV-1_HeavyChain
caggugcaacugguccagagcggcgccgagguuagaaggcccggggcuuccgugaagguaucuugcaaagcaucaggauucaguuuucucggucacuacauccauugggugcggcaggccccuggccaggggcuugaauggauuggaugggucaaggcggugagcggcgcuguuaacuaugguucccuggacuuccgccaccgagugucuuugacccgugauagagacuuaucgacagcccauauggauauaagggggcugacucaagacgauacggcaaccuacuuuugugcccggcagaaauucgcucgcggagaccagggcugguuuuucgaucuauggggcagagggacacucaucgucgugucaagc

SEQ ID NO: 26823 - RNA, 372 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacaaguuaugguaucagcugggugagacaggccccuggccaggggcucgaauggauuggaugggucaagauaguguccggcgcgguuaacuuugguucuccaaauuucaggcaacgggugucgcuuacucgcgaccgagaucuguuuacggcucacauggacauccguggguugacccagggagauacagccacuuacuucugugcaagacagaaauuugagaggggcggccagggguggauuuucgacuuauggggacgggguacccugaucgccgucucaagc

SEQ ID NO: 26824 - RNA, 372 nt, Artificial Sequence
  derived and/or modified sequence opt3 from anti-HIV-1_HeavyChain
caggugcaacugguccagagcgaggccgaaguuaagaaacccggcgcuuccgugaagaucucuugcgcaaccucaggguacgccuucacacucuauuaccuucacuggguaagacaggcgccuggacagggucuggaguggauuggcugggugaaaacugucacgggggcugugaacuuuggaagugccuauuucaggcaucggguuagcuugacccgcgaccgagauuuauuuacagcacacauggacauacguggccugacucaaggugauaccgccacauacuucugugcuagacagaaguuuuauaaagggggacagggcugguacuucgaccuauggggcagggggacccucaucguggucuccucu

SEQ ID NO: 26825 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucaagacagagcucauucauugggugaggcaggcaccuggucagggccuugaauggauaggguggguaaaaacugugacgggagccgucaacuuuggcagcccaaauuuccggcaccgcgugucccugacccgagaucgugacuuguuuacagcgcauauggauaucagagguuuaacucagggggacaccgcuacauacuucugugccaggcaaaaguuugagcggggaggccagggcugguauuucgaucugugggggcgcggaacccuaauuguugugucuucg

SEQ ID NO: 26826 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucgcggccuggaguggauaggguggguaaaggccgugagcggagcggucaacuacggcuccuuggauuuucgacaccgugugccuuuaacuagagacagggaucuguucacggcucauauggacauccggggucuaacccaggaugacacagccacuuauuuuugugcacgccagaaauucgccagaggggaucaaggaugguuuuucgaccucuggggcaggggcacccugauuguugugucuucg

SEQ ID NO: 26827 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccccugaagacaucuucgagaggacagaacucauucauugggugcggcaggcaccaggucagggccuugaguggauaggguggguaaagaucgugaguggagccgucaacuuuggcagcccgaauuuccgccagcgagugucccugacucgugauagagacuuguuuacggcgcacauggauauuagggguuuaacccaaggggacacagcuacuuacuucugugcccggcagaaauuugaacgcggaggccagggcuggaucuucgaucugugggggagaggaacccuaauugcaguuucuucg

SEQ ID NO: 26828 - RNA, 375 nt, Artificial Sequence
  derived and/or modified sequence opt3 from anti-HIV-1_HeavyChain
caggcccaccuggagcaaagcgcuuccggcgugaagagacccggggcaucugucaggguuucaugcuggaccagugaagacaucuucgagggaagcgaacucauucauugggugcggcaggccccuggucagggccuugaguggauaggguggguaaaaacagugacuggagcggucaacuuuggcuccgcuuacuuccgccaccgagugucucugacgcgugauagagacuuguuuaccgcccauauggauaucagggguuuaacacagggggacacugcaaccuauuucugugcccggcaaaaguuuuacaaaggaggccagggcugguauuucgaucugugggggcgcggaacacuaauuguugugucguca

SEQ ID NO: 26829 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuuuaugcaggaggccagggcugguacuucgaucugugggggcgcggaacacuaauuguugugucguca

SEQ ID NO: 26830 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagagggcagaacucauucauugggugcggcaggccccuggucagggccuugaguggauaggguggguaaagaccgugacaggagcggucaacuuuggcuccccaaauuuccgccagcgagugucucugacucgugauagagacuuguuuacggcucacauggauaucagggguuuaacccaaggggacacagccacuuacuucugugcacggcagaaauuugaacgcggaggccagggcuggauuuucgaucugugggggagaggaacccuaaucgccguuucguca

SEQ ID NO: 26831 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagccuggauuuccgccaccgaaucuccuugacccgugacagagauuuauuuacagcgcauauggacauuaggggucugacucagggggauaccgcuacauacuucugugcccggcaaaaauuugaacgcggaggccagggcugguauuucgaccuaugggggagaggaacccucaucgugguuucuucg

SEQ ID NO: 26832 - RNA, 375 nt, Artificial Sequence
  derived and/or modified sequence opt3 from anti-HIV-1_HeavyChain
caggugcaccuggagcaaagcggcuccggggucaagaaacucggagccucuguuagagugucaugcuggaccagugaagacaucuucgagaggacagaacuuauucauuggguacggcaggcucccggucagggccuggaguggauagggugggugaaggcagucagcggagccgugaacuacggcuccuuggauuuucgccaccgaguuucuuuaacucgugacagagaucugucgacggcgcauauggacaucaggggucuaacccaggaugacacagcuacuuauuucugugcccggcaaaaauuugcacgcggggaucagggaugguucuuugaccucuggggcagaggcacccugauuguggucucaagc

SEQ ID NO: 26833 - RNA, 375 nt, Artificial Sequence
  derived and/or modified sequence opt3 from anti-HIV-1_HeavyChain
caggccuaccuggagcaaagcggcuccaucaugaagaaacccggggcuucugugagagucucaugcuggaccagugaagacauuuucgauaggacagagcucauauauuggguucggcaggcaccuggacagggucuugaauggaucggcugggugaagauuguaagcggggccgugaacuuuggaucccuggacuuccgcaaucgagucucuuugacucgugauagagacuuauuuacggcgcacauggauaucaggggccugacccagggugacacagcuacuuacuucugugcccggcaaaaauuugagcgcgggggacagggcugguauuucgaucuauggggcagagggacccucauugugguuucguca

SEQ ID NO: 26834 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauuaacugggugcggcaggcaccuggucagggccuugaguggauaggguggguaaaggccgugagcggagcggucaauuacggcucccuggauuuucgccaucgagugucuuugacucgugacagagauuuaucgacggcucacauggacaucaggggucugacccaggaugacacagccacuuauuucugugcacggcaaaaauuugcccgcggggaucagggaugguucuuugaccuauggggcagaggcacccucauuguugugucaagc

SEQ ID NO: 26835 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaacgcggaggccagggcugguauuucgaccuaugggggagaggaacacucaucgugguuucguca

SEQ ID NO: 26836 - RNA, 375 nt, Artificial Sequence
  derived and/or modified sequence opt3 from anti-HIV-1_HeavyChain
caggcccaccuggagcaaagcggcuccggggugaagaaacccggaaccucugucagaguuucaugcuggacaagugaagacaucuucgagaggacugaacucauucauugggugcggcaggcuccuggucagggccuugaguggauaggguggguaaagaucgugagcggagcagucaacuuuggcuccccaaauuuccgccagcgagugucucugacgcgugauagagacuuguuuaccgcccacauggauauuagggguuuaacacaaggggacacugcgaccuacuucugugcucggcagaaauuugaacgcggaggccagggcuggaucuucgaucugugggggagaggaacacuaauugccguuucguca

SEQ ID NO: 26837 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccaguggugacaucuucgaaaggacagagcuuauucauugggugcggcaggcacccggccaggggcuggaauggauaggauggguaaaggccgugagcggcgcggucaacuacgguuccuuggauuuucgccaccgagugucuuuaacucgugacagagaucuguucacggcucauauggacaucagggggcuaacccaggaugacacagccacuuauuuuugugcacggcaaaaauucgcccgcggagaucagggcugguuuuucgaccucuggggcagagggacccugauuguugugucguca

SEQ ID NO: 26838 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacaccgauauuagggguuuaacacaaggggacacugcuaccuacuucugugcccggcagaaauuugaacgcggaggccagggcugguauuucgaucugugggggagaggaacacuaaucguugugucguca

SEQ ID NO: 26839 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugccucgcaagugaagacaucuucgagaggaccgaacuuauucauugggugcggcaggccccuggucagggccuggaguggauaggguggguaaagacagugacuggagcggucaacuuuggcagcccaaauuuccgccaccgaguguccuugacgcgugauagagacuuauuuaccgcucauauggauaucaggggucugacacagggggacacugccaccuacuucugugcacggcaaaaauuugaacgcggaggccagggcugguauuucgaucuaugggggagaggaacacucauuguugugucuucg

SEQ ID NO: 26840 - RNA, 375 nt, Artificial Sequence
  derived and/or modified sequence opt3 from anti-HIV-1_HeavyChain
caggcccaccuggagcaaagcggcgcuggggugaagagacccggagcauccgucaggguuucuugcuggaccucagaagacaucuucgagacaacugaacucauucauugggugcggcaggccccuggucagggccuugaguggauaggguggguaaaaacggugaguggagcggucaacuuuggcagccugaauuuccgccaccgaguguccuugacccgugauagagacuuauuuacagcucauauggauaucaggggucugacucagggggacaccgccacauacuucugugcacggcaaaaguuugcccgcggagaucagggcugguucuuugaccuauggggcagagggacccucauuguugugucuucg

SEQ ID NO: 26841 - RNA, 375 nt, Artificial Sequence
  derived and/or modified sequence opt3 from anti-HIV-1_HeavyChain
agacacaccuggaacaagagcggcuccggggugaaaaagcccggagccucugucaggguuucaugcuggacaagugaggacaucuucgagaaaagcgaacugauucauugggugcggcaggcuccuggucaaggccucgaauggauaggguggguaaagacugugacgggagcagucaauuuuggcuccucugauuuccgccagcgagugucgcuuacccgugacagagaucuguuuacagcccacauggacaucagggguuugacucagggggauaccgcgacauacuucugugcucggcagaaauuuuaugccggaggccaaggcugguacuucgacuuaugggggcgcggaacccugauuguugugucaagc

SEQ ID NO: 26842 - RNA, 375 nt, Artificial Sequence
  derived and/or modified sequence opt3 from anti-HIV-1_HeavyChain
ggcacccccgggagcgaguccggaucuggugugaagaaaccuggcgccucagucagaguuaguugcuggacaagcgaagacaucuucgagaggacugaacugauucacugggugcggcaggcuccagggcaaggacucgaguggauaggcuggguaaagaucguguccggugcagucaacuuugggucuccgaauuuccgccagcgagugucgcuuacgcgugauagagaccuguuuaccgcccauauggauauuaggggauugacacagggcgacacugcgaccuacuucugugcucggcagaaauuugaacgcggcgggcaaggauggaucuucgauuuaugggguagaggcacacugauugccguuucaagc

SEQ ID NO: 26843 - RNA, 378 nt, Artificial Sequence
  derived and/or modified sequence opt3 from anti-HIV-1_HeavyChain
caggugcaacugguccagagcggcaccgagguucagaagcccggggccuccgugaaaguaucuugcaaggcuuucggauacucauuuacagacuauuacguguauugggucagacaggcaccuggucaaggccucgaauacguggccuggaucaacccaaguaauggguauacuaaauacgcgcagaaguuccaggauuggguuacgcuuaccagggacagcuccauuaacacagcuuaucugcaguuggcccgggugacuucugaugacaccgcaauauacuacugugcccgccaaaaauuugcuucgcgauauucaggagaucagggcagcuacuucgacuuauggggucgugggacacugaucgucgugaguucc

SEQ ID NO: 26844 - RNA, 378 nt, Artificial Sequence
  derived and/or modified sequence opt3 from anti-HIV-1_HeavyChain
caggugcaacugguccagagcggcgccgcuguuaagaaacccggguccucugugaagguaucaugcaaagcaaguggauacaucuucaccgguuauuacauucacuggauaagacaggccccuggccaggggcucgaguggaugggauggaucaacccaagcacaggcgacacuaaguuugcgaggcaauuccagggucggguguccuuuuaucgcacgcgagaacuugggauugcuuacauggaucugcgugacuugaaauucgaugacaccgccgucuauuuuugugcaagaaagacaaagggagaugugucuggcgacgauaggggcuucuuuuucgacuuaugggggcggggaacucgcguuaucgugucguca

SEQ ID NO: 26845 - RNA, 381 nt, Artificial Sequence
  derived and/or modified sequence opt3 from anti-HIV-1_HeavyChain
cagguguacauggagcaagccggcgcugggaugaagaaacccggagcaagcaugaccgucuccugcaagacagccgacgaagauaucuucgacgcggcuuauaugcacuggguuagacaggccccuggucagacuuuugaguggcugggcuggaugaaaccagugacgggggcaguaaacuacgccaggcaguuccaaggacgggugucuuuuuaucgcacccgagaacucggcauugcuuacauggaucuucgugaccugaaguucgaugacacagcagucuauuuuugugccagaaaaacuaagggugaugugucaggggacgauaggggauucuuuuucgacuuguggggccggggcacccgcguuauagugaguagc

SEQ ID NO: 26846 - RNA, 381 nt, Artificial Sequence
  derived and/or modified sequence opt3 from anti-HIV-1_HeavyChain
cagguguucauggagcaagccggcgggggaaugaagaaacccggugcuagcaugaccgucuccugcaagacagcagacgaagauguuuuugacgccgcguacaugcacugggugagacaggcuccuggccagacuuucgaguggcugggguggaugaaaccaguaacgggagccgugaacuaugcaaggaaguuucagggccgggucucuuucuaccgcacccgagaacucgguaucgccuauauggaucuucgugaccugaaauuugaugacacagcuguguacuucugugcaagaaagacuaagggggauguuucaggagacgauaggggcuuuuucuuugacuuguggggccgggggacccgcgugauugucaguagc

SEQ ID NO: 26847 - RNA, 381 nt, Artificial Sequence
  derived and/or modified sequence opt3 from anti-HIV-1_HeavyChain
cagguguucauggagcaagccggcgggggaaugaagaaacccggugcuagcaugaccgucuccugcaagacagcagacgaagauguuuuugacgccgcguacaugcacugggugagacaggcuccuggccagacuuucgaguggcugggguggaugaaaccaguaacgggagccgugaacuaugcaaggcaguuucaaggccgggucucuuucuaccgcacccgagaacucgguaucgccuauauggaucuucgugaccugaaguuugaugacacagcuguguacuucugugcaagaaaaacuaagggggauguuucaggagacgauaggggcuuuuucuuugacuuguggggccgggggacccgcgugauugucaguagc

SEQ ID NO: 26848 - RNA, 381 nt, Artificial Sequence
  derived and/or modified sequence opt3 from anti-HIV-1_HeavyChain
caggugcacauggagcaagccggcgggggagucaagaaacccggugcuagcguuacccuguccugcaagacagcagacgaagauguguucgacgccgcguacaugcauuggguaagacaggcuccuggccagacuuuugaguggcucggguggaugaaaccagugacgggagccgucucuuaugcaaggaaguuccagggccgggugucauuuuacaugacccgcgaacuugguauggccuauauggaucugcgaaacuugcguuucgacgauacagcuguuuacuuuugugcaagaaaaacugccggggacgugaguggagauaauaggggcuauuucuuugacuuauggggccgggggagccgcgucaucguguccucu

SEQ ID NO: 26849 - RNA, 381 nt, Artificial Sequence
  derived and/or modified sequence opt3 from anti-HIV-1_HeavyChain
cagguguacauggagcaagccggcgggggaaugaagaaacccggugcuagcaugaccgucuccugcaagacagcagacgaagauaucuucgacgccgcguauaugcacuggguuagacaggcuccuggccagacuuuugaguggcugggguggaugaaaccagugacgggagccguaaacuacgcaaggcaguuccaaggccgggugucuuuuuaucgcacccgagaacucgguauggccuacauggaucuucguaaucugagauucgacgauacagcugucuauuuuugugcaaggaagacugccggggacgugucaggagauaaccggggcuacuucuuugacuuguggggccgcgggaguagaguuauugugagcucc

SEQ ID NO: 26850 - RNA, 381 nt, Artificial Sequence
  derived and/or modified sequence opt3 from anti-HIV-1_HeavyChain
cagguguacauggagcaagccggcgggggagucaagaaacccggugcuagcguuacccuguccugcaagacagcagacgaagauguguucgacgccgcguauaugcacuggguaagacaggcuccuggccagacuuuugaguggcucggguggaugaaaccagugacgggagccgucucuuacgcaaggaaguuccagggccgggugucauuuuauaugacccgcgaacuugguauggccuacauggaucugcgaaacuugcguuucgacgauacagcuguuuauuuuugugcaagaaaaacugccggggacgugaguggagauaauaggggcuacuucuuugacuuauggggccgggggagcugggucaucguguccucu

SEQ ID NO: 26851 - RNA, 381 nt, Artificial Sequence
  derived and/or modified sequence opt3 from anti-HIV-1_HeavyChain
caggugcaacugguccagagcggcgccgagguuaagaaacccggggcuuccgugacccucucuugcaagacagcagacgaagauguauucgacgccgcguacaugcacugggugagacaggcuccuggacagacuuuugaguggcuugguuggaugaaaccagucacgggcgccgugaacuaugcaaggaaguuccaagggcggguuucauuuuaccgcacccgagaacugggaaucgccuauauggauuugcguaauuuaagauucgacgauacagcuguguacuuuugugcaaggaaaacugccggcgacgucaguggugauaagcggggguucuuuuucgaccuguggggacgcggcagcagagugauuguauccucu

SEQ ID NO: 26852 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucguggauuaagcaccgcguauauggacaucagaggccugacacaggaugacacugcuaccuacuuuugugccaggcaaaaauucgcaagucgguauuccggugaucaggggucuuacuuugaccuauggggacgcggcacacucauugucgugagcucc

SEQ ID NO: 26853 - RNA, 384 nt, Artificial Sequence
  derived and/or modified sequence opt3 from anti-HIV-1_HeavyChain
caggcccaccuggagcaaagcgcuuccggcgugagaaggcccggggcaucuguccggguuucaugcuggaccagugaagacaucuucgagcgcagcgaacucauuuacugggugcgacaggccccuggacguggucuugaguggauaggcuggaucaagcugguauccggggcggugaacuuuggaucugucgauuucagagacagggugucguugacacgggaucgcgacuuauuuacugcucauauggauauuagaggccugacgcagggugacaccgccacauauuucugugcaaggcagaaauuugaaucacgguacacugggggacaaggcugguauuucgaucuauggggccgcgggacccacaucguugugagcagu

SEQ ID NO: 26854 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuacggcagccugaauuuucgcucccgaaucucuuugacccgugauagagacuuauucacagcgcacauggauauuaggggucugacucagggggacaccgcuacauauuuuugugcccggcaaaaauucgaaucgcgcuacaccggaggccagggcugguauuuugaucuaugggggagaggaacucauaucgugguuucaagc

SEQ ID NO: 26855 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugaaucgcgcuauacaggaggccagggcugguacuucgaucugugggggagaggaacccacauuguugugucaagc

SEQ ID NO: 26856 - RNA, 384 nt, Artificial Sequence
  derived and/or modified sequence opt3 from anti-HIV-1_HeavyChain
caggugcaccuggagcaaagcggcuccggggucaagaaacccggagccucuguuagagugucaugcuggaguagcgaagacaucuucgagaggaccgaacucauucauuggguacggcaggcuccuggucagggccuugaguggauagggugggugaagacagucacuggagcagugaacuuuggcucccuggauuuccgccaccgaaucucuuugacgcgugacagagauuuauuuaccgcccauauggacauuaggggucugacacagggggauacugcgaccuacuucugugcucggcaaaaauuugaaucgcgcuauacaggaggccagggcugguacuucgaccuaugggggagaggaacccacaucguugugucaagc

SEQ ID NO: 26857 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugggacgagaucgugacuuaucaaccgcguauauggauaucagaggccugacacaggacgauacugcuaccuacuuuugugccaggcaaaaauucgcaagccgguauaguggugaccagggguccuacuuugaucuauggggacgcggcacacucauugucgugucuagc

SEQ ID NO: 26858 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggaaccgucaacuuuggcagccugaauuuccgccagcgaguguccuugacacgugauagagacuuauuuacugcccacauggauaucaggggucugacccaaggggacacagcgaccuacuucugugcucggcagaaauuugaaucucgcuauacuggaggccagggcugguacuucgaucuaugggggagaggaacacauauuguugugucguca

SEQ ID NO: 26859 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaaggaaucuucgacacaacugagcucauuuacuggguuaggcaggcaccuggucagggccuugaauggauagggugggugaagaucguauccggaacggugaacuuugccucucuggauuuccggaaucgcauuucguugucacgagaccgugauuuaagcaccgcguauauggacaucagaggccugacacaggaugacacugcuaccuacuuuugugccaggcaaaaauucgcaagucgguauuccggugaucaggggucuuacuuugaccuauggggacgcggcacacucauugucgugagcucc

SEQ ID NO: 26860 - RNA, 384 nt, Artificial Sequence
  derived and/or modified sequence opt3 from anti-HIV-1_HeavyChain
cagagcagacuggagcaauccggcucugccaugaagaaacccggggcuucagugagggucaguugcuggaccagcgaagacaucuucgauacaacugagcucauuuacuggguucggcaggcaccuggacagggucuugaauggauaggcugggugaagaucguauccgggacggugaacuuugccucucuggacuuccgcaaucgaauuucguugucacgugauagagacuuaagcaccgcgcacauggauaucaggggacugacacaggacgauacugcuaccuauuuuugugcccggcaaaaauucgcaagucgcuacuccggcgaccaggguucuuauuuugaucuaugggggagaggaacacucauuaucgucagcucc

SEQ ID NO: 26861 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuugaaucacgguauacaggaggccagggcugguacuucgaccugugggggcgcggaacccauauuguugugagcagu

SEQ ID NO: 26862 - RNA, 384 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucuucggacuuccggaaucgcauuucacugagccgagaucgugacuugaguaccgcguauauggauaucagaggauuaacacaggacgauacugcuaccuacuuuugugccaggcaaaaauucgcaucccgguauucuggcgaccaggguagcuacuuugaucugugggggcgcggaacacuaauuaucgucuccuca

SEQ ID NO: 26863 - RNA, 384 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggaacugucaacuuugccucccuggauuuccgcaaucgaauuucuuugucgcgugacagagauuuaucaacggcguacauggacaucaggggccugacccaggaugacacagcuacuuauuuuugugcccggcaaaaauucgcaagccgcuacaguggugaucagggguccuauuuugaccuauggggaagaggcacccucauugugguuucuagc

SEQ ID NO: 26864 - RNA, 384 nt, Artificial Sequence
  derived and/or modified sequence opt3 from anti-HIV-1_HeavyChain
agacacaccugggagcagagcggcuccggggugaagaaacccggagccucugucaggguuucaugcuggaguagcgaagacaucuucgagcggacagaacugauucauugggugcgccaagcuccuggucagggccucgaguggauaggguggguaaagacugugacgggagcagucaacuuuggcucccuugauuuccgacaccguaucucucugaccagagacagggauuuguuuacagcccauauggacauucgggguuuaacucagggggauaccgcgacauacuucugugcucgccagaaauuugaaucgagauauaccggaggccaaggcugguacuucgaccugugggggaggggaacucacaucgugguuucaagc

SEQ ID NO: 26865 - RNA, 384 nt, Artificial Sequence
  derived and/or modified sequence opt3 from anti-HIV-1_HeavyChain
agacacaccugggagcagagcggcuccggggugaagaaacccggagccucugucaggguuucaugcuggacaagugaagacaucuucgagcggacugaacugauucauugggugcgccaagcuccuggucagggccucgaguggauaggguggguaaagacggugaccggagcagucaacuuuggcagccuugauuuccgacaccguaucucccugacaagagacagggauuuguuuacugcccauauggacauucgggguuuaacccagggggauacagcgaccuacuucugugcucgccagaaauuugaaucuagauauacuggaggccaaggcugguacuucgaccugugggggaggggaacacacaucgugguuucguca

SEQ ID NO: 26866 - RNA, 414 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggagcgaacucauucauugggugcggcaggcaccuggucagggccuugaguggauaggguggguaaagacagugacuggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauauuacgcaggaggccagggcugguauuuugaucugugggggcgcggaacacuaauuguugugucgucagccagcaccaaggguccgagugucuuccacgaccucaga

SEQ ID NO: 26867 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuugaacgcggaggccagggcuggaucuucgaucugugggggagaggaacccuaauugcaguuucgucagccagcacaaaggguccgaguguguuucccaccaucugcguc

SEQ ID NO: 26868 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaagccguguccggagcggucaacuacggcucucuggauuuucggcaccgcgugucguugacacgagaccgugauuuauucacugcucauauggacaucagaggucugacgcaggaugacaccgccauuuauuuuugugcaaggcaaaaguucgcccgcggggaucagggaugguuuuucgaccuauggggccggggcacacucaucguugugucaagcgcuaguacuaaagggccauccgucuuuccgcacgaucugaga

SEQ ID NO: 26869 - RNA, 417 nt, Artificial Sequence
  derived and/or modified sequence opt3 from anti-HIV-1_HeavyChain
caggcccaccuggagcaaagcggcuccggggugaagaaagucggagcuucuguuagagugucaugcuggaccagugaagacaucuucgagaggacagaacucauucauuggguacggcaggcacccggucagggccuugaguggauagggugggugaaggccgucagcggagcggugaacuacggcucccuggauuuucgccaccgaguuucuuugacucgugacagagauuuauucacggcucauauggacaucaggggucugacccaggaugacacagccauuuauuuuugugcacggcaaaaauucgcccgcggggaucagggaugguuuuucgaccuauggggcagaggcacucucaucguggucucgucagcuagcaccaaggggccuaguguguuuccacacgaucugagg

SEQ ID NO: 26870 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccagggggauacagccacuuauuuuugugcacggcaaaaauucuacgccggaggccagggcugguauuuugaccucugggggcgcggaacccugauuguugugucgucagcuagcacaaaggguccuagugucuucccacacgaucuuaga

SEQ ID NO: 26871 - RNA, 423 nt, Artificial Sequence
  derived and/or modified sequence opt3 from anti-HIV-1_HeavyChain
cagguguacauggagcaagccggcgcuggggucaagaaacccggagcaagcguuacccuguccugcaagacagccgacgaagauguguucgacgcggcuuauaugcacuggguaagacaggccccuggucagacuuuugaguggcucggcuggaugaaaccagugacgggggcagucucuuacgccaggaaguuccagggacgggugucauuuuauaugacccgcgaacuuggcauggcuuacauggaucugcgaaacuugcguuucgacgauacagcaguuuauuuuugugccagaaaaacugcuggugacgugaguggggauaauaggggauacuucuuugacuuauggggccggggcagccgcgucaucguguccucugccucgaccaaggggccgucaguauucccccaugaucugaga

SEQ ID NO: 26872 - RNA, 426 nt, Artificial Sequence
  derived and/or modified sequence opt3 from anti-HIV-1_HeavyChain
cagagccaccuggagcaauccggcucugccaugaagaaacccggggcuucagugagagucaguugcuggaccagcgaagacaucuucgauacaacugagcucauuuacuggguuaggcaggcaccuggacagggucuugaauggauaggcugggugaagaucguauccgggacggugaacuuugccucucuggacuuccggaaucgcauuucguugucacgagaucgugacuuaagcaccgcguauauggauaucagaggacugacacaggacgauacugcuaccuacuuuugugccaggcaaaaauucgcaagucgguauuccggcgaccaggguucuuacuuugaucuaugggggcgcggaacacucauugucgugagcuccgccucaaccaagggcccaaguguuuucccgacuaucuaugug

SEQ ID NO: 26873 - RNA, 372 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggagguacccucaguagcuacgccaucuccugggugagacaggcgccuggccaggggcuugaauggauuggaugggucaagacagugacuggcgcuguuaacuucgguucugccuguuuuaggcaccgggugucgcugacgcgcgaccgagauuuguucaccgcacauauggacauacguggguuaacacaaggagauacugccaccuauuuuugcgcuagacagaaauucuacaagggcggccaggggugguauuuugaccuguggggaagggguacacuaaucgucgugucaagc

SEQ ID NO: 26874 - RNA, 372 nt, Artificial Sequence
  derived and/or modified sequence opt3 from anti-HIV-1_HeavyChain
cacgugagacugguccagagcggcgccgagguugaaaagcccggggcuuccgugaaaguaucuugcgagaccucaaacuacccuuucaauauguauggaaugacaugggugaggcaagcaccaggucagggccucgaauggaucgggugggucaagauugugaguggagccguuaacuuuggcagcccgaauuuccggcagcgcgugucccuuacucgagaccgugaucuguuuacggcgcauauggacauaagagguuugacccagggggauacagcuacuuacuucugugccaggcaaaaauuugagcggggaggccagggcuggaucuucgacuuaugggggcgcggaacccugauugcagucucuucg

SEQ ID NO: 26875 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacguguucgagaggacagaacuuauccauuggguacggcaggcacccggucagggccuggaguggauugggugggugaaggccgucagcggagcggugaacuacggcuccuuggauuuucgccaccgaguuucuuuaacucgugacagagaucuguucacggcucauauggacauaaggggucuaacccaggaugacacagccacuuauuuuugugcacggcaaaaauucuacgccgggggacagggcugguauuuugaucucuggggccgcgggacccugaucguggucucguca

SEQ ID NO: 26876 - RNA, 375 nt, Artificial Sequence
  derived and/or modified sequence opt3 from anti-HIV-1_HeavyChain
agacacaccugggagcagagcggcuccggggugaagaaacccggagccucugucaggguuucaugcuggaguagcgaagacaucuucgagcggacagaacugauucauugggugcgccaagcuccuggucagggccucgaguggauaggguggguaaagacugugacgggagcagucaacuuuggcucccuugauuuccgacaccguaucucucugaccagagacagggauuuguuuacagcccauauggacauucgggguuuaacucagggggauaccgcgacauacuucugugcucgccagaaauuugaaagaggaggccaaggcugguauuucgaccugugggggaggggaacccuaaucgugguuucguca

SEQ ID NO: 26877 - RNA, 375 nt, Artificial Sequence
  derived and/or modified sequence opt3 from anti-HIV-1_HeavyChain
agacacaccugggagcagagcggcuccggggugaagaggcccggagccucuguccggguuucaugcuggacaagugaagacaucuucgagacuacggaacugauucauugggugcgccaagcuccuggucagggccucgaguggauaggguggguaaaaaccgugagcggagcagucaacuuuggcucccuuaauuuccgacaccgugugucucugacaagagauagggacuugucgacugcccauauggauauccgggguuuaacccaggacgauacagcgaccuacuuuugugcucgccagaaguucgccagaggggaccaaggaugguuuuucgaucuguggggcaggggcacucuaauuguugugucaagc

SEQ ID NO: 26878 - RNA, 381 nt, Artificial Sequence
  derived and/or modified sequence opt3 from anti-HIV-1_HeavyChain
cagguguucauggagcaagccggcgcugggaugaagaaacccggagcaagcaugaccgucuccugcaagacagccgacgaagauguuuuugacgcggcuuacaugcacugggugagacaggccccuggucagacuuucgaguggcugggcuggaugaaaccaguaacgggggcagugaacuaugccaggcaguuucaaggacgggucucuuucuaccgcacccgagaacucggcaucgcuuauauggaucuucgugaccugaaguuugaugacacagcaguguacuucugugccagaaaaacuaagggugauguuucaggggacgauaggggauuuuucuuugacuuguggggccggggcacccgcgugauugucaguagc

SEQ ID NO: 26879 - RNA, 384 nt, Artificial Sequence
  derived and/or modified sequence opt3 from anti-HIV-1_HeavyChain
caggugcaccuggagcaaagcggcuccggggucaagaaacccggagccucuguuagagugucaugcuggaccagugaagacaucuucgagaggacagaacucauucauuggguacggcaggcuccuggucagggccuugaguggauagggugggugaagacugucacgggagcagugaacuuuggcagccuggauuuccgccaccgaaucuccuugacccgugacagagauuuauuuacagcccauauggacauuaggggucugacucagggggauaccgcgacauacuucugugcucggcaaaaauuugaaucucgcuauaccggaggccagggcugguacuucgaccuaugggggagaggaacucacaucguugugucguca

SEQ ID NO: 26880 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauuucugugcacggcaaaaauuugcccgcggggaucagggaugguucuuugaccucuggggcagaggcacccugauuguugugucaagcgcuaguacaaaggggccuuccgucuucccaaccaucugcgug

SEQ ID NO: 26881 - RNA, 417 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuguugugucaagcgccaguaccaaagguccauccgucuuuccgacuaucugcgug

SEQ ID NO: 26882 - RNA, 417 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacguguucgagaggacagaacuuauccauuggguacggcaggcacccggucagggccuggaguggauugggugggugaaggccgucagcggagcggugaacuacggcuccuuggauuuucgccaccgaguuucuuuaacucgugacagagaucuguucacggcucauauggacauaaggggucuaacccaggaugacacagccacuuauuuuugugcacggcaaaaauucuacgccgggggacagggcugguauuuugaucucuggggccgcgggacccugaucguggucucgucagcuagcacaaagggaccuaguguguucccacacgaccuuaga

SEQ ID NO: 26883 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuucugugcccggcagaaauuugaacgcggaggccagggcugguauuucgaucugugggggagaggaacccuaaucguugugucguca

SEQ ID NO: 26884 - RNA, 384 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaagacugugacgggagccgucaacuuuggcagcuuggauuuccgccaccgaaucuccuuaacccgugacagagaucuguuuacagcgcauauggacauuaggggucuaacucagggggauaccgcuacauacuucugugcccggcaaaaauuugaaucucgcuauaccggaggccagggcugguacuucgaccucugggggagaggaacucacaucgugguuucguca

SEQ ID NO: 26885 - RNA, 426 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaguagcgaagacaucuucgagaggaccgaacucauucauugggugcggcaggcaccuggucagggccuugaguggauaggguggguaaagacagugacuggagccgucaacuuuggcucccuggauuuccgccaccgaaucucuuugacgcgugacagagauuuauuuaccgcgcauauggacauuaggggucugacacagggggauacugcuaccuacuucugugcccggcaaaaauuugaaucgcgcuauacaggaggccagggcugguacuucgaccuaugggggagaggaacccacaucgugguuucaagcgcaaguacuaaggguccauccguguuuccgacaauuugcguc

SEQ ID NO: 26886 - RNA, 375 nt, Artificial Sequence
  derived and/or modified sequence opt3 from anti-HIV-1_HeavyChain
caggcccaccuggagcaaagcggcuccggggugaagaaacccggaaccucugucagaguuucaugcuggacaagugaagacaucuucgagaggacugaacucauucauugggugcggcaggcuccuggucagggccuugaguggauaggguggguaaagacggugaccggagcagucaacuuuggcagcccaaauuuccgccaccgagugucccugacacgugauagagacuuguuuacugcccauauggauaucagggguuuaacccagggggacacagcgaccuacuucugugcucggcaaaaauuugaacgcggaggccagggcugguauuucgaucugugggggagaggaacucuaauuguugugucuucg

SEQ ID NO: 26887 - RNA, 381 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuauacaacuuacggugugaguuggcucagacaggucccuggccagaggccagaauggaugggguggauccggccgaagacgggagcccgcaaccaagcgcgacaguuccagccccguauuagccuuaccagagacagggcucuguccacagccuauuuggauuuaaauucucugacuucggcagacucaggcaccuacuuuugugcccggcagacauucaaaccugauuuuuauuucgcugaccaagguuggagcuuuaaccuaugggggcgcggagcacacuucauagugaguucc

SEQ ID NO: 26888 - RNA, 384 nt, Artificial Sequence
  derived and/or modified sequence opt3 from anti-HIV-1_HeavyChain
agagcccaccuggagcagagcggcuccggggugaagaaacucggagcuucugucaggguuucaugcuggaccagugaagacaucuucgagcggacagaacuuauucauugggugcgccaagcacccggucagggccuggaguggauaggguggguaaaggccgugagcggagcggucaacuacggcuccuuggauuuucgacaccgugugucuuuaacuagagacagggaucuguucacggcucauauggacauccggggucuaacccaggaugacacagccacuuauuuuugugcacgccagaaauucgaaucgagauacaccgggggacaaggcugguauuuugaucucuggggcagggggacacacauuaccguuucaagc

SEQ ID NO: 26889 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagaucgugagcggagccgucaacuuuggcuccccaaauuuccgccagcgagugucucugacucgugauagagacuuguuuacggcgcacauggauauuagggguuuaacccaaggggacacagcuacuuacuauugugcccggcagaaauucgaacgcggaggccagggcuggaucuuugaucugugggggagaggaacccuaauugcaguuucguca

SEQ ID NO: 26890 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccacuuauuuuugugcacggcaaaaauucgcccgcggggaucagggaugguuuuucgaccucuggggccacggcacccugauuguugugucguca

SEQ ID NO: 26891 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuugaacgcggaggccagggcugguauuucgaucugugggggcacggaacccuaauuguugugucuucg

SEQ ID NO: 26892 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagacggugauuuguuuaccgcgcacauggacauccguggguuaacacaaggagauacugcuaccuacuucugugccagacagaaguuuuaugcaggcggccaggggugguacuucgaccuguggggaagggguacacuaauuaucguuucaagc

SEQ ID NO: 26893 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggccaccagaucuccgaucgggugucucugacgcgcgaccgagauuuguucaccgcgcauauggacauucgugguuuaacacaaggggauacugcuaccuacuuuugugccagacagaaguucuaugcaggaggccagggcugguacuuugaccugugggggcacggaacacuaaucguugugucguca

SEQ ID NO: 26894 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacacugcuaccuacuucugugcccggcaaaaauuugaacgcggaggccagggcugguauuucgaucugugggggcacggaacacuaauuguugugucguca

SEQ ID NO: 26895 - RNA, 375 nt, Artificial Sequence
  derived and/or modified sequence opt3 from anti-HIV-1_HeavyChain
caggcccaccuggagcaaagcggcgcuggggugaagaaacccggagcauccgucagaguuucuugcuggaccucagaagacaucuucgagaggacagaacucauucauugggugcggcaggccccuggucagggccuugaguggauaggguggguaaagacugugaguggagcggucaacuuuggcagcccaaauuuccgccaccgagugucccugacgcgugauagagacuuguuuaccgcucauauggauaucagggguuuaacacagggggacacugccaccuacuauugugcacggcaaaaauucgaacgcggaggccagggcugguacuuugaucugugggggagaggaacacuaauuguugugucuucg

SEQ ID NO: 26896 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucgcggccuggaguggauaggguggguaaaggccgugagcggagcggucaacuacggcuccuuggauuuucgacaccgugugucuuuaacuagagacagggaucuguucacggcucauauggacauccggggucuaacccaggaugacacagccacuuauuacugugcacgccagaaauuugaaagagggggacaaggcuggauuuucgaucucuggggcagggggacccugaucgccguuucguca

SEQ ID NO: 26897 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuauugugccaggcagaaguucuacgcaggaggccagggcugguauuuugaccugugggggcggggaacacuaauuguugugucaagc

SEQ ID NO: 26898 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuucugugcccggcaaaaauuuuauaagggaggccagggcugguacuucgaucugugggggcgcggaacccuaauuguugugucuucg

SEQ ID NO: 26899 - RNA, 372 nt, Artificial Sequence
  derived and/or modified sequence opt3 from anti-HIV-1_HeavyChain
uacguggagcugggcaccaacacagggcccgaagucagaaagccuggagccagcguuaaaaucuccugcaagacuucugguuauauuuucacggacaauuacuuucacuggcucaggcaggcuccagcagugggccuugaguggaugggguggauaaacucacauaauggauauaccaaaagugccaagaaauuccaaggccggaucacaaugacucgcgauaccgcgguagacacagcuuacauggaacugauugauuugaccagcgacgauacugccacauauuacugugcacgacagaaguuuuaugccggugggcagggaugguacuucgacuuauggggcugcggcacccugaucguggucuccucu

SEQ ID NO: 26900 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcggggaacacuaauuugcguuucaagc

SEQ ID NO: 26901 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcuccgauuuccgccagcgagugucucugacccgugacagagauuuguuuacagcgcacauggacaucagggguuuaacucaaggggauaccgcuacauacuauugugcccggcagaaauucuacgcaggaggccagggcugguauuuugaccugugggggcgcggaacccuaauuguugugucguca

SEQ ID NO: 26902 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagccagugacuggagccgucaacuuuggcagcccgaauuuccgccaccgagugucccugacgcgugauagagacuuguuuaccgcgcauauggauaucagggguuuaacacagggggacacugcuaccuacuucugugcccggcaaaaauuugaacgcggaggccagggcugguauuucgaucugugggggagaggaacacuaauuguugugucuucg

SEQ ID NO: 26903 - RNA, 375 nt, Artificial Sequence
  derived and/or modified sequence opt3 from anti-HIV-1_HeavyChain
caggugcaacugguccagagcggcgccgagguuaagaaacccggggcuuccgugagaguaucuugcuggaccucagaagacaucuucgagaagagugaacucauucacugggugaggcaggcaccuggacagggucuugaguggauaggcugggucaaaacagugacuggggccguuaacuuuggaagcuccgauuuccggcaacgcgugucucugacgcgagaccgugauuuguuuaccgcgcauauggacaucagaggcuuaacacagggugauacugcuaccuacuauugugccaggcagaaguucgaacgcgggggacagggcugguacuuugaccuguggggccgggggacacuaauugucgugucguca

SEQ ID NO: 26904 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucugucgacggcucauauggacaucaggggucuaacccaggaugacacagccacuuauucaugugcacggcaaaaauucgcccgcggggaucagggaugguuuuucgaccucuggggcagaggcacccugauuguugugagcagu

SEQ ID NO: 26905 - RNA, 375 nt, Artificial Sequence
  derived and/or modified sequence opt3 from anti-HIV-1_HeavyChain
caggcccaccuggagcaaagcggcuccggggugaagaaacccggaaccucugucagaguuucaugcuggacaagugaagacaucuucgagaggacugaacucauucauugggugcggcaggcuccuggucagggccuugaguggauaggguggguaaagacggugaccggagcagucaacuuuggcagcccaaauuuccgccaccgagugucccugacacgugauagagacuuguuuacugcccauauggauaucagggguuuaacccagggggacacagcgaccuacuauugugcucggcaaaaauucgaacgcggaggccagggcugguacuuugaucugugggggagaggaacucuaauuguugugucuucg

SEQ ID NO: 26906 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggaaccgucaacuuuggcagccugaauuuccgccagcgaguguccuugacacgugauagagacuuauuuacugcccacauggauaucaggggucugacccaaggggacacagcgaccuacuucugugcucggcagaaauuugcccgcggagaucagggcugguucuuugaccuauggggccaugggacucucauuguugugucuucg

SEQ ID NO: 26907 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacccguuuacagcgcauauggauaucagggguuugacucagggggacaccgcuacauacuucugugcccggcaaaaauuugaacgcggaggccagggcugguauuucgauuuaugggggcacggaacccugauuguugugucuucg

SEQ ID NO: 26908 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucugugguuuaacucagggggacaccgcuacauacuucugcgccaggcaaaaauuugaacggggaggccagggcugguauuucgaucugugggggcacggaacccuaauuguugugucuucg

SEQ ID NO: 26909 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccagcgagugucuuuaacucgugacagagaucuguucacggcucacauggacaucaggggucuaacccaaggggauacagccacuuauuacugugcacggcagaaauuuuaugccggaggccagggcugguacuucgaccucugggggcgcggaacccugauuguugugucguca

SEQ ID NO: 26910 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucaagagcgagcucauucauugggugaggcaggcaccuggucagggccuugaauggauaggguggguaaaaacagugacuggagccgucaacuuuggcuccucugauuuccggcagcgcgugucgcugacgcgagaccgugauuuguuuaccgcgcacauggacaucagagguuuaacacaaggggauacugcuaccuacuucugugccaggcagaaguuuuaugcaggaggccagggcugguacuucgaccugugggggcauggaacacuaauuguugugucaagc

SEQ ID NO: 26911 - RNA, 375 nt, Artificial Sequence
  derived and/or modified sequence opt3 from anti-HIV-1_HeavyChain
caggcccaccuggagcaaagcggcuccggggugaagaaacccggaaccucugucagaguuucaugcuggacaagugaagacaucuucgagaggacugaacucauucauugggugcggcaggcuccuggucagggccuugaguggauaggguggguaaagacggugaccggagcagucaacuuuggcagcccaaauuuccgccaccgagugucccugacacgugauagagacuuguuuacugcccauauggauaucagggguuuaacccagggggacacagcgaccuacuucugugcucggcaaaaauuugcccgcggagaucagggcugguucuuugaccuguggggccacgggacucuaauuguugugucuucg

SEQ ID NO: 26912 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccaggaugacacagccacuuauuacugugcacggcaaaaauuugcccgcggggaucagggaugguucuuugaccucuggggcagaggcacccugauuguugugucguca

SEQ ID NO: 26913 - RNA, 381 nt, Artificial Sequence
  derived and/or modified sequence opt3 from anti-HIV-1_HeavyChain
caggugcaacugguccagagcggcgccgagguuaagaaacccggggcuuccgugaagguaucuugcaaagcaucaggauacaccuucacagacuauuaccuccacugggugagacaggccccuggucagggccuugauugggucggguggaucaacccaaauaguggaggcacuaacuaugcgcaaaaguuucaggguaggguggcuaugacgcgggacaccagccuguccucuguuuacuuggauuuaaauucgcugacaucagccgacagcgggacuuauuucugugcacgccagaccuuuaaaccggauuucuacuuugccgaccagggauggaguuucaaccuauggggccaaggcucccauuuuauugugucuagc

SEQ ID NO: 26914 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcgggcaccuggucagggccuugaguggauaggguggguaaaaacagugacuggagccgucaacuuuggcuccucugauuuccgccagcgagugucgcugacgcgugacagagauuuguuuaccgcgcacauggacaucagggguuuaacacagggggauacugcuaccuacuauugugcccggcaaaaguucuacgcaggaggccagggcugguauuuugaccugugggggcgcggaacacuaauuguugugucaagc

SEQ ID NO: 26915 - RNA, 372 nt, Artificial Sequence
  derived and/or modified sequence opt3 from anti-HIV-1_HeavyChain
caggcccaccuggagcaaagcggcuccggggugaagaaacccggagcuucugucaccguuucaugcuggacaagugaagacaucuucgaaaagagcgagcucauucauugggugagacaggcaccuggucagggccuugaguggauaggguggguaaaaacugugacgggagccgucaaccugguguaccagaucuccgauaggguuucuuugacccgggaccgcggcuuauuuacagcgcacauggauauucgaggucugacucaaggggacaccgcuacauauuacugugcccgucagaaguucuaugcaggaggccagggcugguacuuugaucuaugggggagaggaacccucaucguggucucguca

SEQ ID NO: 26916 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaggguagcgaacucauucauugggugaggcaggcaccuggccaggggcuugaguggauaggauggguaaagacagugacuggcgccgucaacuuugguuccgcguacuuccggcaccgcgugucucugacgcgagaucgugacuuguuuaccgcucauauggauaucagaggguuaacacagggagacacugccaccuauuucugugcaaggcaaaaauuuuacaagggcggccaggggugguauuucgaucuguggggacacgguacacuaauuguugugucguca

SEQ ID NO: 26917 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuacggcagccugaauuuucgcucccgaaucucuuugacccgugauagagacuuauucacagcgcacauggauauuaggggucugacugaaggggacaccgcuacauauuuuugugcccggcagaaauucuacgcaggaggccaaggcugguauuuugaucuaugggggcauggaacccucaucgugguuucguca

SEQ ID NO: 26918 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugagcggagccgucaacuuuggcuccccaaauuuccgccaccgagugucucugacgcgugauagagacuuguuuaccgcgcauauggauaucagggguuuaacacagggggacauggcuacuuacuucugugcccggcaaaaauuugaacgcggaggccagggcugguauuucgaucugugggggcacggaacccuaauuguugugucguca

SEQ ID NO: 26919 - RNA, 375 nt, Artificial Sequence
  derived and/or modified sequence opt3 from anti-HIV-1_HeavyChain
caggcccaccuggagcaaagcggcuccggggugaaggaacccggaaccucugucagaguuucaugcuggacaagugaggacaucuucgaaaggacugagcucauucauugggugcggcaggcuccuggucagggccuugaauggauaggguggguaaaaacggugaccggagcagucaacuuuggcagcccaaauuuccgccaccgagugucccugacacgugauagagacuuguuuacugcccauauggauaucagggguuuaacccagggggacacagcgaccuacuucugugcucggcaaaaguuugagcgcggaggccagggcuggauuuucgaucugugggggagaggaacucuaaucgccguuucuucg

SEQ ID NO: 26920 - RNA, 375 nt, Artificial Sequence
  derived and/or modified sequence opt3 from anti-HIV-1_HeavyChain
caggugcaacuggagcagagcggcuccggggucaagaaacucggagccucuguuagagugucaugcuggaccagugaagacaucuucgguaggacagagcuuauucacuggguacggcaggcucccggccaggggcuggaauggauaggaugggugaaggcagucagcggcgccgugaacuacgguuccuuggauuuucgccaucgaguuucuuuaacucgugacagagaucuguucacggcgcacauggacaucagggggcuaacccaagaugacacagcuacuuauuacugugcccggcagaaauuugcacgcggagaucagggcugguucuuugaccucuggggcagagggacccugauuguggucucguca

SEQ ID NO: 26921 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugacgauaucuucaagacagaacucauucauugggugaggcaggcaccuggucagggccuugaguggauaggguggguaaaaacugugacgggagccgucaacuuuggcagcccaaauuuccggcagcgcgugucccugacccgagaccgugauuuguuuacagcgcacauggacaucagagguuuaacucaagaugacaccgcuacauacuucugugccaggcagaaguuugcacgcggggaucagggaugguucuuugaccuguggggccggggcacccuaauuguugugucuucg

SEQ ID NO: 26922 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgagaggacagaacucauucauugggugcggcaggcaccuggucagggccuugaguggauaggguggguaaagacugugacgggagccgucaacuuuggcagcccaaauuuccgccaccgagugucccugacccgugauagagacuuguuuacagcgcauauggauaucagggguuuaacucagggggacaccgcuacauacuauuguguucggcaaaaauucgaacgcggaggccagggcugguacuuugaucugugggggagaggaacccuaauuguggucucuucg

SEQ ID NO: 26923 - RNA, 375 nt, Artificial Sequence
  derived and/or modified sequence opt3 from anti-HIV-1_HeavyChain
caggugcaacugguccagagcggcgccgagguuaagaaacccggggcuuccgugaagguaucuugcuggaccucagaagacaucuucgagaaaagugaacucauucacugggugagacaggcaccuggacagggucuugaguggauaggcugggucaagacagugacuggggccguuaacuuuggaagcuccgauuucaggcaacgggugucucugacgcgcgaccgagauuuguuuaccgcgcauauggacauccguggcuuaacacagggugauacugcuaccuacuauugugccagacagaaauucuacgcagggggacagggcugguauuuugaccuguggggcagggggacacuaauugucgugucguca

SEQ ID NO: 26924 - RNA, 375 nt, Artificial Sequence
  derived and/or modified sequence opt3 from anti-HIV-1_HeavyChain
caggcccaccuggagcaaagcggcuccggggugaagaaacucggagcuucugucagaguuucaugcuggaccagugaagacaucuucgagaggacagaacuuauucauugggugcggcaggcacccggucagggccuggaguggauaggguggguaaaggccgugagcggagcggucaacuacggcuccuuggauuuucgccaccgagugucuuuaacucgugacagagaucuguucacggcucauauggacaucaggggucuaacccagggggauacagccacuuauuuuugugcacggcaaaaauucuacaagggaggccagggcugguauuuugaccucugggggcgcggaacccugauuguugugucguca

SEQ ID NO: 26925 - RNA, 372 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgaaaagagcgagcucauucauugggugaggcaggcaccuggucagggccuugaguggauaggguggguaaaaacagugacuggagccgucaacuuugcgcaccagaucuccgaucgggugucucugacgcgcgaccgagauuuguucaccgcucauauggacauucguggcuuaacacaaggugauacugccaccuacuauugugcaagacagaaguuuuacgccgggggacagggcugguauuucgaccuguggggcagggggacacuaaucguugugucguca

SEQ ID NO: 26926 - RNA, 375 nt, Artificial Sequence
  derived and/or modified sequence opt3 from anti-HIV-1_HeavyChain
caggcccaccuggagcaaagcggcuccggggugaagaaacccggagcuucugucagaguuucaugcuggaccagugaagacaucuucgguaggacagagcucauucauugggugcggcaggcaccuggccaggggcuugaauggauaggauggguaaagacugugagcggcgccgucaacuuugguuccccaaauuuccgccaccgagugucucugacgcgugauagagacuuguuuaccgcgcauauggauaucaggggguuaacacagggagacacugcuaccuacuucugugcccggcaaaaauuugagcgcggcggccaggggugguauuucgaucuguggggaagagguacacuaauuugcguuucguca

SEQ ID NO: 26927 - RNA, 636 nt, Artificial Sequence
  derived and/or modified sequence opt3 from anti-HIV_5CIN_LightChain
gagaucgugcugacccagagccccggcacacaaucccucucuccuggggaaagagccacucuuucaugcagggcuagucagagcgucggaaacaauaagcuggcaugguaccagcagcggccaggucaagccccgcgcuuguuaauuuauggcgcguccucucgacccucggggguugcugaccguuucucaggaagcggcagugguacggauuuuacccugacaauauccagacuagagccugaagacuucgccguguacuauugucagcaguacgggcagucucucagcacuuuuggacaaggcaccaaaguagaggugaagaggacagucgcagccccauccguguucaucuuucccccuucagaugaacagcugaaaaguggcaccgcuagcguugugugccuucugaacaauuucuauccacgggaggcaaagguccaguggaaaguggacaacgccuugcagucuggaaauucccaagagucaguaacugaacaggauagcaaggacaguacauacucucucuccagcacccugacgcugucgaaggcugauuaugagaaacacaagguuuacgccugugaagugacucaucaggggcucucuucccccgucaccaaaucauuuaaccgc

SEQ ID NO: 26928 - RNA, 672 nt, Artificial Sequence
  derived and/or modified sequence opt3 from anti-HIV_5CIN_HeavyChain
gugcagcugguccaaagcggcgccgagguuaagagacccggguccucugugaccguaucaugcaaagcuaguggagguagcuucuccacauacgcacucucuugggugaggcaggccccuggccgggggcuugaauggaugggaggcgucaucccacuguugacuauuacgaacuaugcgccgcgcuuucagggucgaauaaccaucacagcugaccguucgacuucaaccgccuacuuagagcugaauagccuaagacccgaagauacagcaguguauuacugugccagggaggggaccacuggaaguggcggcaagccuauuggggcuuucgcacacuggggacaggguacacucguuaccguguccucugccagcacgaaaggcccauccgucuuuccccuggcuccuucaaguaagagcacuucugggggaaccgccgcgcuuggcugccuggugaaagacuauuucccagaacccguaacaguuuccuggaacucaggugcauugacuagcggggugcauaccuuuccugccguccuccaaaguucuggacuguacucccugagcucgguggugacagucccaucuuccucacucggcacccagacguauaucuguaauguuaaccacaagccgaguaauacuaagguggauaaaaagguagagccc

SEQ ID NO: 26929 - RNA, 678 nt, Artificial Sequence
  derived and/or modified sequence opt3 from anti-HIV_5CIL_HeavyChain
gugcagcugguccaaagcggcgccgagguuaagagacccggguccucugugaccguaucaugcaaagcuaguggagguagcuucuccacauacgcacucucuugggugaggcaggccccuggccgggggcuugaauggaugggaggcgucaucccacuguugacuauuacgaacuaugcgccgcgcuuucagggucgaauaaccaucacagcugaccguucgacuucaaccgccuacuuagagcugaauagccuaagacccgaagauacagcaguguauuacugugccagggaggggaccacuggagacggcgaucucggcaagccuauuggggcuuucgcacacuggggacaggguacacugguuaccgugaguuccgccucuacgaaaggcccaagcgucuuuccccuugcuccuuccucaaagaguacuagcgggggaaccgccgcgcugggcugcuuggugaaagacuauuucccagaacccguaacaguuucuuggaacuccggugcacucacuucaggggugcauaccuuuccugccguccugcaaagcaguggacuguacucucucuccagcguggugacagucccaucgucuuccuuaggcacccagacguauaucuguaauguuaaccacaagccgucaaauacuaagguggauaaaaagguagagccc

SEQ ID NO: 26930 - RNA, 678 nt, Artificial Sequence
  derived and/or modified sequence opt3 from anti-HIV_5CIP_A-Chain
gugcagcugguccaaagcggcgccgagguuaagagacccggguccucugugaccguaucaugcaaagcuaguggagguagcuucuccacauacgcacucucuugggugaggcaggccccuggccgggggcuugaauggaugggaggcgucaucccacuguugacuauuacgaacuaugcgccgcgcuuucagggucgaauaaccaucacagcugaccguucgacuucaaccgccuacuuagagcugaauagccuaagacccgaagauacagcaguguauuacugugccagggaggggaccacuggauggggcuggcucggcaagccuauuggggcuuucgcacacuggggacaggguacacugguuaccgugaguuccgccucuacgaaaggcccaagcgucuuuccccuugcuccuuccucaaagaguacuagcgggggaaccgccgcgcugggcugcuuggugaaagacuauuucccagaacccguaacaguuucuuggaacuccggugcacucacuucaggggugcauaccuuuccugccguccugcaaagcaguggacuguacucucucuccagcguggugacagucccaucgucuuccuuaggcacccagacguauaucuguaauguuaaccacaagccgucaaauacuaagguggauaaaaagguagagccc

SEQ ID NO: 26931 - RNA, 681 nt, Artificial Sequence
  derived and/or modified sequence opt3 from anti-HIV_5CIP_HeavyChain
gugcagcugguccaaagcggcgccgagguuaagagacccggguccucugugaccguaucaugcaaagcuaguggagguagcuucuccacauacgcacucucuugggugaggcaggccccuggccgggggcuugaauggaugggaggcgucaucccacuguugacuauuacgaacuaugcgccgcgcuuucagggucgaauaaccaucacagcugaccguucgacuucaaccgccuacuuagagcugaauagccuaagacccgaagauacagcaguguauuacugugccagggaggggaccacuggauggggcuggcucggcaagccuauuggggcuuucgcacacuggggacaggguacacugguuaccgugaguuccgccucuacgaaaggcccaagcgucuuuccccuugcuccuuccucaaagaguacuagcgggggaaccgccgcgcugggcugcuuggugaaagacuauuucccagaacccguaacaguuucuuggaacuccggugcacucacuucaggggugcauaccuuuccugccguccugcaaagcaguggacuguacucucucuccagcguggugacagucccaucgucuuccuuaggcacccagacguauaucuguaauguuaaccacaagccgucaaauacuaagguggauaaaaagguagagcccaaa

SEQ ID NO: 26932 - RNA, 630 nt, Artificial Sequence
  derived and/or modified sequence opt3 from anti-HIV_4JKP_LightChain
gagaucgugcugacccagagccccgccacacucucccuuucuccuggcgaaacugcuauuauaucaugcagaacgagucaauacgggagccuggcaugguaucagcagaggccaggacaggccccgcgguuggucaucuacuccgguucuacccgcgcggcuggcauucccgaccgauucucggggucacguuggggagccgauuauaacuuaagcaucaguaaucuggaguccggcgacuuugguguuuacuauugucaacaguacgaguucuuugggcagggaacaaaggugcagguagauauuaaaagaacuguggcagccccuucugucuucaucuuuccacccagcgacgaacaacuaaaguccggcaccgcuucagugguuugccuccugaacaauuucuauccuagggaagcaaaagugcaguggaaggucgauaacgcccuucagaguggcaauagccaggagucugugacagagcaagacuccaaagauucaaccuacagccugaguucuacuuugacacucuccaaggcugacuacgaaaagcacaaaguauaugccugugagguuacccaucaggggcugagcucgccagugacgaagucuuuuaaccggggagaaugc

SEQ ID NO: 26933 - RNA, 678 nt, Artificial Sequence
  derived and/or modified sequence opt3 from anti-HIV_3TNN_E-Chain
gaggugcagcuggucgaaagcggcgggggacucguucaacccgguggcucccuuagacugucuugcgccgcuucaggguucaccuuuaguacauacgcaaugagcugggugaggcaggccccuggaaagggcuuggaguggguauccucuaucaacaauucgggucggaacacuuucucagcggacagcgugaaagggcgcuuuacgauuagucgagauaauuccaagaacaccuuauuccuggucaugaauagccuacgugcugaagacacagccguguauuacugugcaaaagaucucagacugggaggcggcucugacuauugggggcagggaacucuuguuaccguguccucagccaguacaaaggguccaagcgucuuuccgcuggcucccucuuccaaaucaaccagcggcgggacugcagccuugggaugccucgugaaggauuacuucccugagccaguaacaguuaguuggaacucuggcgcucugaccuccggugugcacacguuucccgccguccugcagagcucggggcucuauucuuuauccucaguggugacugucccuaguagcucccugggaacccaaacauacauauguaauguuaaccauaagccaucuaauacuaaaguggacaagaggguagaacccaaaagcugcgauaagacccac

SEQ ID NO: 26934 - RNA, 705 nt, Artificial Sequence
  derived and/or modified sequence opt3 from anti-HIV_3BQU_B-Chain
agaaucacccugaaggagagcgggcccccucucgugaaaccaacacagacucuuacgcugaccugcuccuucucuggcuuuucauugagugacuucggagucgguguuggcuggauuaggcaaccgcccgggaaggccuuagaauggcuggcuauaaucuacagcgaugacgauaaacgguauuccccuucucuaaacacacgccucacuauuaccaaggacacaucgaaaaaucaggugguacuggugaugacccgagucucaccaguggauacugcaacauacuuuugugcccaccguagaggacccaccacgcuuuucggcguuccuaucgcgagggguccagugaacgcuauggacgucugggggcagggaauuacugugaccaucagcaguacauccacuaagggccccucuguauuuccucuggccccaagcuccaagucaaccgcaggcggggccgcugcauugggaugccucguuaaagauuauuucccggagcccgugacagucaguuggaauagcggugcccugaccucuggcgugcauacguuuccugcugugcugcaguccucagggcucuacagcuuaaguucugucguuacugugccauccagcucgcugggaacacaaaccuauacuuguaacguaaaucacaagcccucuaacacaaaaguggacaagcgggucgaaccuaaauccugc

SEQ ID NO: 26935 - RNA, 642 nt, Artificial Sequence
  derived and/or modified sequence opt3 from anti-HIV_3BQU_A-Chain
gcccugcagcucacccaaagccccuccucucuuucagcuagugugggcgacagaaucacaauuacuugcagggcaagccagggggucacguccgcccuggcgugguaccggcagaagccuggaucuccaccgcaguuguuaauauaugaugcuucgucacuggagagcgguguucccagucgcuucuccggcucugggagcggaaccgaauuuacacuaacuaucuccacccuccgaccugaggacuucgccacauacuauugucaacagcugcacuuuuacccacauaccuucggcggugggacucguguggauguaagaaggacaguggcagcccccucagucuuuauuuucccuccaagugacgaacagcuuaaaagcggaaccgcuucugugguuugccuguugaacaauuuuuauccccgggaggcaaaggugcaguggaaagucgauaacgcccuccaauccggcaauucacaggaaagcgugacggagcaggacaguaaggauucuacuuacucccugagcucgacccugacacucucuaaagcugacuaugagaagcacaagguauacgaaugugagguuacucaucagggcuuauccucaccugugaccaaaaguuucaaccgcggggaaugc

SEQ ID NO: 26936 - RNA, 387 nt, Artificial Sequence
  derived and/or modified sequence opt3 from anti-HIV_IgG_VR-Chain
auggagacccccgcccagcuccuguuccuucuguuguuauggcugccugacacaacuggcgaaaucgugcuaacgcaaagcccagggacccucucccugucugcuggagagagagcaacacuuucaugcagggccagucagagcgucuccucucgguaccuggcgugguaucagcagaagccgggucaagcuccccgcuugcucauuuacggcgccucgucacgagcaacugggauaccugaucguuuuagcggaaguggcuccgguaccgacuucacacugaccaucucuagaguugaaccagaggauuuugccggguauuacugucagcaguaugacaacagcgugugcacuuucggacagggcacaaaacuggaaauuaagagg

SEQ ID NO: 26937 - RNA, 348 nt, Artificial Sequence
  derived and/or modified sequence opt3 from anti-HIV_IgG_HeavyChain
augaagcaccugugguucuuucuccuucugguggccgcucccagaugggucuugagccagguucaauuacaggaguccggcccugggcuggugaaaccaucugaaacccuaucacucacaugcacuguaaguggagguagcaucuccucucauuacuggucguggauuaggcagucaccgggcaaggggcugcaguggauaggauauaucuacuauagcggcaguacgaacuacucccccucucuuaaaagccgggugaccauuuccgucgagacaucaaagaaucaauucagucugaaauugacuagcaugaccgcagccgacacagcgguguauuacugugcucgc

SEQ ID NO: 26938 - RNA, 714 nt, Artificial Sequence
  derived and/or modified sequence opt3 from anti-HIV_4P9M_HeavyChain
cagauccaccuggugcaaagcggcaccgaggucaagaaacccggguccucuguuacagugucaugcaaggccuacggaguaaacacuuucggucucuaugcugugaauugggucagacaggcaccuggccagagucuugaauacauugggcagauauggagguggaaaagcuccgccucucaucacuuucggggacgcgugcugaucucggcgguugacuugacgggcucaagcccaccgauuaguuccuuagagaucaagaaccugaccucugaugacacagcuguguauuucuguacuaccacaagcaccuacgauaaaugguccggucuacaucacgacggggucauggccuuuucaaguuggggacaaggcacucucauuagcgugucugcagccuccacaaagggccccucaguauucccucuggcuccaagcaguaagucuaccuccgggggaacggcagcccuugguugccugguuaaagauuauuuucccgaaccugugacugucagcuggaacucgggcgcuuugaccucuggggugcauacauucccagccgugcuccaguccucaggacuguacagucugagcuccgucguuacugugcccucuagcucacucggcacccagacauauaucuguaauguaaaucacaagccuaguaacaccaaaguggacaagcgagucgagccaaaauccugcgauaagacg

SEQ ID NO: 26939 - RNA, 645 nt, Artificial Sequence
  derived and/or modified sequence opt3 from anti-HIV_4P9M_LightChain
gacauccagaugacccaaagccccuccacacugucugccucaauuggcgauacugugagaauaaguugcagggcuagccaguccaucacggggaacugggucgcaugguaccagcagcggccuggaaaggccccacgccuccuuauuuaucgaggugcggcucuguugggcgggguuccgucucguuucucgggaucagccgcaggcaccgacuuuacauuaacuaucgguaaucugcaagccgaggauuucgggaccuuuuacugucagcaguaugacacauaccccggaaccuucggccagggcacuaaaguggaaguaaagagaacaguggcugcaccuagcgucuuuauuuucccacccagugaugagcaacuaaaauccgggaccgccucugugguuugccuccugaacaauuuuuauccuagggaagcuaaggugcaguggaaagucgacaacgcccuucagagcggaaauucccaggagucagugacggaacaagauaguaaggacagcacuuacucucuguccucaaccuugacacucagcaaggcggauuaugagaaacacaagguauacgcaugugagguuacucaucagggucugaguucuccagugaccaaauccuucaaccggggcgaaugc

SEQ ID NO: 26940 - RNA, 558 nt, Artificial Sequence
  derived and/or modified sequence opt3 from anti-HIV_4P9H_C-Chain
aagaaagugguccugggcaagaaaggggacaccguugaacucacaugcacugccagccagaagaaauccauccaauuccacuggaagaacucuaaucagauuaagauacuuggaaaccaggguucauuucugacgaaaggccccaguaaguugaaugauagagcugacagcaggcgguccuuaugggaucaggggaacuucccucugaucauuaaaaaucuaaccaucgaagacucugauacauacauuugugagguggaagaccaaaaggaggaaguacagcuccugguguuuggacuuacugcaaacucggauacccaucuguugcagggccagucacucacacugacccuggagagcccaccggguaguucccccucuguccaaugccgcagcccucgagggaaaaauauccagggaggcaagacucucuccgugucacaguuagagcugcaggacaguggcacauggaccuguacgguucuucaaaaccagaagaaaguggaguucaagauagauaucgucguguuggccuuucagaaagcgauugacgggcgu

SEQ ID NO: 26941 - RNA, 462 nt, Artificial Sequence
  derived and/or modified sequence opt3 from anti-HIV_4YBL_A-Chain
gugcccgucuggaaggacgccgauaccacacuguucugcgcuagcgacgcaaaagcccacgagacugaaugucauaacguuugggcgacgcacgcuugcgugccuaccgauccaaauccgcaggagauccaucucgaaaacguaacagagaauuuuaacauguggaagaauaacaugguggaacaaaugcaggaggacgucauuucccuuugggaucagugucugcagcccggcggggccccuaaaauaucuuucgacccaauccccauucacuacugcacuccugcaggauaugugaucuugaaguguaaugauaaaaacuuuaaugguaccggcccaugcaagaacguuucaagugugcaauguacacaugggauuaagcccgucgugagcuccggaggcgguaauaucaaagacaacuggagaucugaguuauacaaguauaaaguaguucagauagaa

SEQ ID NO: 26942 - RNA, 1056 nt, Artificial Sequence
  derived and/or modified sequence opt3 from anti-HIV_4R4N_V-Chain
aucuggaaggacgccaacaccacacuguucugcgcuagcgaugcaaaagccuacgacacugaggugcacaaugucugggcgacgcaugcuuguguucccaccgauccuuccccacaggaacucaagauggagaacgugacagaagaguuuaauauguggaaaaacaauaugguagaacaaaugcacacugacauuauaucucuuugggaucagucacugaagccgugcgugcaguugaccggcgggagugccuuaacacaggcaugucccaaagucaccuucgagccuaucccaauucauuauugcgcccccgcuggauacgcaauccugaaguguaacgacaaggaguuuaaugguacuggccuaugcaaaaacgugagcacaguucaauguacccacgggauuagaccuguggucuccacgcagcuccugcuuaauggaucucuggccgaaggcaaggugaugaucaggucggagaacauaacuaauaacguuaaaaauaucauuguacaguugaacgaaucagugaccaucaauugcacacggccaaacaacggugggagcggaaguggcggcgauauucgccaggcucauuguaaugucuccgggucucaauggaacaagacucuccaccaggugguggagcagcugcgaaaauauuggaauaacaauaccaucauauucaacagcuccucaggaggugaccuggagauuacaacccacaguuuuaauugcggcggggaguucuuuuacuguaacacgagcggacucuucaauucuacuugggucaacggcacagccuccaucgaaaaugguaccauuacuuuacccugccguaucaagcagaucauuaacauguggcaaagaguugggcaggcgauauaugcaccuccaauccagggagugauuaggugcguaucaaauaucacaggccugauacuuacccgggauggcgggggaaacagcaaugaaaacgagacguuucgcccggguggcggggacaugagagauaacuggaggagugaauuguacaaguauaaaguggucaagauugag

SEQ ID NO: 26943 - RNA, 1065 nt, Artificial Sequence
  derived and/or modified sequence opt3 from anti-HIV_4JKP_G-Chain
guguggaaggacgccgauaccacacuguucugcgcuagcgacgcaaaagcccacgagacugaaugucauaacgucugggcgacgcacgcuugcguucccaccgauccuaauccacaggagauccaucucgaaaacgugacagagaauuuuaacauguggaagaauaacaugguagaacaaaugcaggaggacgugauuucccuuugggaucagugucugcagccgugcgucaaauugacuggcgggucugugauaaagcaagccugucccaaaaucucauucgacccuauuccaauccacuacugcacccccgcaggauauguuauuuuaaaguguaaugauaagaacuuuaaugguacaggcccuugcaaaaacgugaguagcguccaguguacccaugggaucaagccagugguauccacucagcugcuacucaauggaucucuggccgaggaagagauaaucauuagaucggaaaaccuuacaaauaacgcuaaaaccaucauuguucaccugaauaagucaguggagaucaacugcacgaggcccagcaacggcgguaguggguccggaggcgacauacggaaagcauacugugagauuaauggcacuaaguggaacaaggucuugaaacaggugaccgaaaagcucaaagagcacuucaauaacaagacaaucauuuuucaaccuccaucugggggagaucuggaaaucacuaugcaucacuucaauugccgcggugaguuuuucuauugcaacaccacacagcuguuuaauaacaccuguaucggcaaugaaacgaugaaagggugcaacggaacuauuacacucccguguaagauaaaacagaucauuaauauguggcagggcaccggucaagccauguacgcucccccuaucgacgggaagauaaacugcgugagcaauauuacuggaaucuuacugacacgagauggcggcgccaacaauaccuccaacgagacguuccguccagggggagguaacaucaaggacaauuggagaucagagcuuuauaaauacaaggucguucagauugaaggcagu

SEQ ID NO: 26944 - RNA, 723 nt, Artificial Sequence
  derived and/or modified sequence opt3 from anti-HIV_3BQU_D-Chain
augggcuggagcuggaucuuccuguuucuccuuuccgggaccgccggagugcacucugguguccagcugcaacagucaggccccgaguugguuaagccuggggcuagugugaaaaugagcugcaaggcauccggauacucuuucacagacuauuuuaugcauuggguaaaacagucgcacggcaagucauuagauuggauugguuacauaaacuguuauacuggggccacgaauuacagccagaaauucaagggaaaggcgaccuuuacaguggacaccaguuccaacacugcuuauaugcaauucaauucucugacaagcgaagauuccgccgucuacuauugcgcaagaaccucaaucggcuacggcaguagcccaccguuucccuacugggggcagggaacucuagugacaguuucugccgcuaaaaccacgccuccauccguguauccccucgcaccugguucagccgcucagacuaacagcauggucacccugggcugucuugugaagggguacuucccagagcccguaacaguuacuuggaauaguggaucucuguccagcggcgugcauaccuuuccugccgucuugcagucggaccucuauacacugucuuccucagugaccgugccaaguagcccgaggcccuccgaaacggucacuugcaacguugcgcacccugcaucuagcacaaaaguggauaagaaaauuguaccacgg

SEQ ID NO: 26945 - RNA, 699 nt, Artificial Sequence
  derived and/or modified sequence opt3 from anti-HIV_3BQU_C-Chain
augaccauguucagccuggcccuccuucuguccuuguuacugcuaugcgugucugacucaggcgcugagacaacugucacgcagagucccgcaagccucuccaugucuaucggggaaaagguuaccauuagauguauaacaucgacugauaucgacgaugacaugaacugguaccaacagaaaccuggagagccaccgaggcugcuuauuucagaugguaauacccugcggcccggcgugccuagccgcuuuaguuccucuggguauggaacagacuucguauuuaccaucgaaaacauguugagcgaggauguggccgacuacuauugccuccaguccgauaaucugccauacacuuucggcggugggacaaaccuggaaauuaagcgagcggacgcugcccccaccgucucaaucuuuccuccaaguagcgagcagcucacgucuggaggcgcauccgugguuuguuucuuaaauaacuuuuaucccaaagauauaaaugugaaguggaaaaucgacggcucagagcgucaaaacgggguccugaauagcuggacugaucaggacaguaaggacucuaccuacuccaugagcucgacacuuacuuugaccaaggaugaauaugagagacacaacucuuacacaugcgaagccacccauaaaacguccacuucaccuauugugaagaguuucaauagg

SEQ ID NO: 26946 - RNA, 333 nt, Artificial Sequence
  derived and/or modified sequence opt3 from anti-HIV_Ig_LightChain
gacgugguccugacccagagccccgccucccucgcuguuucucuuggccaaagagcaacaaucucaugcaaggccagucagagcguggauuacgacggggauuccuauaugaacugguaccagcagaaaccuggacaaccaccgaagcuguugauucacgcggcuucuaauuuaguaucggguaugcccgccagguucucaggcagcgggaguggaacugacuuuacgcugaacauacauccuguggaggaagaggaugcagccaccuauuacugucagcaguccaucgaagacccacccacauucggcggugggacuaaacuagagauuaag

SEQ ID NO: 26947 - RNA, 342 nt, Artificial Sequence
  derived and/or modified sequence opt3 from anti-HIV_Ig_HeavyChain
gacgugcagcugcaacagagcggccccgggcucgucaagccuucccagucucuuucacacacaugcaccguuacuggauacaguaucacgagcgauuaugccuggaacuggauuagacaguucccagguaauaaacuggaguggaugggcuacauauccuuuucugggucgaccucauauaacccgagcuugaagaguaggaucuccauuacacgggacacuucuaaaaauuuauucuuucugcaacuaaacagcgugaccacagaagauaccgcuacuuacuauugugcacgcggacuccccgacuacuggggccaggguacaacccugacgguauccuca

SEQ ID NO: 26948 - RNA, 1083 nt, Artificial Sequence
  derived and/or modified sequence opt3 from anti-HIV_4P9H_G-Chain
guguggaaggacgccgauaccacacuguucugcgcuagcgacgcaaaagcccacgagacugaaugucauaacgucugggcgacgcacgcuugcguucccaccgauccuaauccacaggagauccaucucgaacaagugacagagaacuuuaauauguggaagaacaauaugguagaacagaugcaggaggacgugauuucccuuugggaucagugucugcaaccgugcgucaaauugacuggcgggucugugauaaagcaggccugucccaaaaucucauucgacccuauuccaauccacuacugcacccccgcaggauauguuauuuuaaaguguaacgauaagaauuuuaacgguacaggcccuugcaaaaaugugaguagcguccaguguacccaugggaucaagccagugguauccacucagcugcuacucaacggaucucuggccgaggaagagauaaucauuagaucggaaaaucuuacaaacaaugcuaaaaccaucauuguucaucugcaaaagucaguggagaucaacugcacgaggcccagcaauggcgguaguggguccggaggcgacauacggaaagcauacugugagauucagggcacuaaguggaacaaggucuugaaacaggugaccgaaaagcucaaagagcacuucaacaauaagacaaucauuuuucagccuccaucugggggagaucuggaaaucacuaugcaccacuucaacugccgcggugaguuuuucuauugcaauaccacacaacuguuucagaacaccuguaucggcaaugaaacgaugaaagggugcaacggaacuauuacacucccguguaagauaaaacagaucauuaauauguggcaaggcaccggucaggccauguacgcucccccuaucgacgggaagauaaacugcgugagccagauuacuggaaucuuacugacacgagauggcggcgccaauaacaccuccaaugagacguuccguccagggggagguaacaucaaggacaauuggagaucagagcuuuauaaauacaaggucguucagauugaaggcagucaucaccaccaucaccau

SEQ ID NO: 26949 - RNA, 147 nt, Artificial Sequence
  derived and/or modified sequence opt3 from anti-HIV_Chain
caggugcaacugguccagagcggcgggcagaugaagaaacccggagaguccaugagaaucucuugcagggccucagguuacgaguucauugacuguacccucaacuggauacggcuugcuccuggcaagcgcccagaauggaugggg

SEQ ID NO: 26950 - RNA, 180 nt, Artificial Sequence
  derived and/or modified sequence opt3 from anti-HIV_Chain
cccugcuguuucgccuacaucgcuagaccucugccaagggcacacauuaaggaguauuuuuacaccagcggcaaaugcuccaacccggccguggucuucguuacacggaagaaucgccaggugugugcgaaccccgagaaaaaguggguacgagaauauauaaauucucucgaaauguca

SEQ ID NO: 26951 - RNA, 249 nt, Artificial Sequence
  derived and/or modified sequence opt3 from anti-HIV_Chain
cuggaguggaugggcagaaucauucccgccauagacgaugugaccuacgcucagacauucagggggcgggucacuuuuagcgcagacaaguucacgaccacagccuauauggaucucacuggacuucgcuccgaagacaccgcgacauacuuuugcgcucgagauccucaaguuaaccguagagguaauuguuucgaccacuggggccaggggacccuggugacuguaucuucagccaguacaaaagga

SEQ ID NO: 26952 - RNA, 270 nt, Artificial Sequence
  derived and/or modified sequence opt3 from anti-HIV_Chain
gacguggucaugacccagagcccccugucccucccuguuacacuuggccaaccagccucuaucucaugcagaaguagccagucccugguguacucucacggggauacuuauuugaaguguuuccagcagaggccgggacaaucgccccggcgcccuauuuacaaaguaucaaaccgagacagcggugugccagaucguuuuaguggcuccgggucuggaacggacuucaccuuaaagauaagcagagucgaggcugaagaugugggcguu

SEQ ID NO: 26953 - RNA, 294 nt, Artificial Sequence
  derived and/or modified sequence opt3 from anti-HIV_Chain
agcuccuucgccaucucuugggugagacaggcucccggccaagggcuggaguggaugggagguauuauaccuaucuuugaagcaaccucauacgcccagaaguuccaggacaggcucacaauuacuacggaugagaguaccacaacugcguauauggaccuuagcucccugcggucugaagauaccgcugucuacuauugcgcccgcgcacagggcgacaucuugacagagggguacuuugauuauuggggacaaggcaccuuaguuacugugucgucagccagcacaaaaggu

SEQ ID NO: 26954 - RNA, 297 nt, Artificial Sequence
  derived and/or modified sequence opt3 from anti-HIV_Chain
aacaccuucacaagccacuacgugcauugggucagacaggcccccggccaagggcuggaguggaugggaaugaucaauccugguggcacuacgagguaugcuccaaaguuucaggaccggguuacccucacacgcgauacuuccacccgaacaguguacauggaacuucguucucugagaucagaggacaccgcaguauauuacugcgccaggccgcaguauaacuuggggcgggaacccuuaaauguguggggacagggcacuauggucacagugaguagcgcguccaccaaaggu

SEQ ID NO: 26955 - RNA, 297 nt, Artificial Sequence
  derived and/or modified sequence opt3 from anti-HIV_Chain
aucaggagcuucuacuggcacuggauuagacagucccccggcaaggggcuggaguggcucggaucuguguuugacaacggucuuaccacacauaauccuucacugaaaagucgguugacuauaagcgaagauccaucccgcaaccaaaucucuuuaaagcugcgaucgaugacggccgcugacaccgcagucuauuacugcgcccguggcgauuaugacauucuaacaucaagcuaccaguucgauuauugggggcagggaacucucguugcggugaguuccgcuucuaccaaaggc

SEQ ID NO: 26956 - RNA, 300 nt, Artificial Sequence
  derived and/or modified sequence opt3 from anti-HIV_Chain
cagagcgcccugacccaacccgcuuucguguccggcucuccugggcagucaaucacacucaguugcacucuuggaacggaggacgucagcugguaccagcagagaccaaacuccgcaccgaggcugauuauauuugauguuaagaaacggcccucugacgugucggaucgcuucucaggucacaauagcgacaccgccgcguuuuugacaaucagugaauuacgaccugaggaugaagcugacuauuucuguacuuccuggccauaccguuuugauagaggcaccaagguagacguggcc

SEQ ID NO: 26957 - RNA, 300 nt, Artificial Sequence
  derived and/or modified sequence opt3 from anti-HIV_Chain
cagagcgcccugacccaacccgcuuucguguccggcucuccugggcagucaaucacacucaguugcacucuuggaacggaggacgucagcugguaccagcagagaccaaacuccgcaccgaggcugauuauauuugauguuaagaaacggcccucugacgugucggaucgcuucucaggucacaauagcgacaccgccgcguuuuugacaaucagugaauuacgaccugaggaugaagcugaguauuucuguacuuccuggccauaccguuuuggcagagggaccaagguagacguggcc

SEQ ID NO: 26958 - RNA, 300 nt, Artificial Sequence
  derived and/or modified sequence opt3 from anti-HIV_Chain
cagagcgcccugacccaccccgcuuucguguccggcucuccugggcaaucaaucacacucaguugcacucuuggaacggaggacgucagcugguaccagcagagaccaaacuccgcaccgaggcugauuauauuugauguucggaagcgccccucugaagugucggaccgauucucaggucauaaaagcgauaccgccgcguuuuugacaaucagugacuuacguccugaggaugaagcugaguauuucuguacuuccuggccauacagauuugacaggggcacccggcuggauguagcc

SEQ ID NO: 26959 - RNA, 300 nt, Artificial Sequence
  derived and/or modified sequence opt3 from anti-HIV_Chain
cagagcgugcugacccaacccgccuucgucuccggcucuccugggcagucaaucacaauuaguugcacuguuggaacgaccgacgugagcugguaccagcagagaccaaacuccgcuccgaggcucauaaucuuugauguaaagaaacggcccucuggugugucggaccgcuucucaggcagcaguuccgauaaugcagccuuucuuacaauugcggggcugcgaccugaggacgaagcugaguauuacuguacuucuuggccauaucguuucggaagaggcaccaaggucgaugugggu

SEQ ID NO: 26960 - RNA, 300 nt, Artificial Sequence
  derived and/or modified sequence opt3 from anti-HIV_Chain
cagagcgugcugacccaacccgccuucgucuccgcuucuccuggccagucaaucacacucaguugcaaccuugggacugacuacguuagcugguaucagcagagaccauccucugcaccgaggcugauuauauuugaugugaagaaucggcccucgggaguaucagaccgcuucagcgguuacaacagugauacggccgcguuuuugaccaucuccggcuuacaaccugaggacgaagcugaguauuacuguacaucuuggccauauaauuucgggcccggaacuaaaguggaugucacc

SEQ ID NO: 26961 - RNA, 300 nt, Artificial Sequence
  derived and/or modified sequence opt3 from anti-HIV_Chain
cagagcgugcugacccaacccgccuccgucucuggcucaccugggcagaguaucaacauuagcugcgcuggaagauccgacaggguuucuugguaccagcagcggccaaauggugugccgaagcuccuucuguucgauguauaucgccgacccucgggcgugucagaccguuuuagcgggagucacuccgaugacacagcauucuugacuauaucuggauuacaaacggaugacgaggccgauuacuauuguaccagccauccuuacgcguuuggcccagguacaaaagucaacgugcug

SEQ ID NO: 26962 - RNA, 300 nt, Artificial Sequence
  derived and/or modified sequence opt3 from anti-HIV_Chain
cagagcgugcugacccaacccgccuucgucuccggcucuccugggcagucaaucacacucaguugcacucuuggaacggaggacguuagcugguaccagcagagaccaaacuccgcuccgaggcugauuauauuugaugugaagaaacggcccucugacguaucggaucgcuucucaggucacaauagcgacaccgcagccuuuuugacaaucagugaauuacgaccugaggaugaagcggaguauuucuguacuuccuggccauaccguuuuggcagagggaccaagguggacgucgcu

SEQ ID NO: 26963 - RNA, 306 nt, Artificial Sequence
  derived and/or modified sequence opt3 from anti-HIV_Chain
cagagcgcccugacccaacccgcuuccgugucuggcucaccugggcagaguaucacaauuagcugcacugcagacuccgauuacgucucuugguaucagcagagaccaaacucggccccgaagcucauacuuuucgacguuaauucaaggcccagcggagugagugaucgguacuccgguucucgcagcggcaacacggcgucccugaccaucucaggguugcaacgagaggacgaagcugauuauuuuuguacaccuuggccauacgacuuccgucccggaacuagaguauuuguguuaggccag

SEQ ID NO: 26964 - RNA, 306 nt, Artificial Sequence
  derived and/or modified sequence opt3 from anti-HIV_Chain
cagagcgcccugacccaacccgcuuucguguccggcucuccugggcagucaaucacacucaguugcagccuuggaacugcagacgucuccugguaccagcagagaccaaacucugccccgaggcugauuauauuugauguuaagaaacggcccucggacgugucagaucgcuucagcggucacaauagugacacggcggcuuuuguaaccaucuccgaguugcgaccugaagaugaggccgaauauuucuguacaucuuggccauaccguuuuggccccgggacuaagguggacgucgcaagacaa

SEQ ID NO: 26965 - RNA, 306 nt, Artificial Sequence
  derived and/or modified sequence opt3 from anti-HIV_Chain
cagagcgugcugacccaacccgccuccgucucuggcucaccugggcagacaaucaguauuagcugcuccggaacuuucgguucugacucgguuucaugguaccagcaguuuccaaacagcgcuccgacgcucauaaucuucgaugugcacagaaggcccaguggcauuuccacccgguuuucugggagcacauccggagacacugcaucacuuaccaucaguacacugcaucgcgaggaugaagccuucuauuacuguaccagccacccuuaugacuuuggcggugggacuuacguaauuguguug

SEQ ID NO: 26966 - RNA, 306 nt, Artificial Sequence
  derived and/or modified sequence opt3 from anti-HIV_Chain
cagagcgugcugacccaacccgccuccgucucuggcucaccugggcagacaaucaguauuagcugcuccggaacuuucgguucugacucgguuucaugguaccagcaguauccaaacagcgcuccgacgcucauaaucuuugaugugcacagaaggcccaguggcauuuccacccgguucucugggagcacauccggagacacugcaucacuuaccaucaguacacugcaucgcgaggaugaagccuacuauuacuguaccagccacccuuaugacuuuggcggugggacuuacguaauuguguug

SEQ ID NO: 26967 - RNA, 306 nt, Artificial Sequence
  derived and/or modified sequence opt3 from anti-HIV_Chain
cagagcgcccugacccaacccgcuuccgugucuggcucaccugggcagaguaucaacauuagcugcgcaggaagauccgacagggucucuugguaccagcagcggccaaaugguguuccgaagcuccuuauguucgauguguaucgccgacccucgggcguaucagaccguuuuagcgggagucacuccggagauacagccuuccugacuauaucuggcuugcaaacggaggacgaagcggauuacuauuguaccagccauccuuacgcuuuuggugccgggacaaaagugaacgucuuaagacag

SEQ ID NO: 26968 - RNA, 306 nt, Artificial Sequence
  derived and/or modified sequence opt3 from anti-HIV_Chain
gacauccagaugacccaaagccccuccucucugucagccagugugggcgauagagucagcauucacugccaggcugggcagggaauagguuccucucucaacugguaccagcaaaagccuggcagggcaccacggcuucugguucauggggccucgaauuugcagcgcggagugccgucacgauucagcggcagugguuuucacacaacuuucacguuaaccaucuccucucugcagcccgacgauguagcgacauauuggugugcugcccuagaguuuuucgggccuggaacuaaaguggaaauu

SEQ ID NO: 26969 - RNA, 309 nt, Artificial Sequence
  derived and/or modified sequence opt3 from anti-HIV_Chain
gacauccagaugacccaaagccccuccucucugucagccagugugggcgauacagucacuauuacgugccaggcuaacggguaccucaauugguaucagcagagaaggggaaaggcaccuaaacuucugauauacgacgguagcaaguuggaacggggcguuccaucccgcuucucugggcgacguuggggacaagaauauaacuuaaccaucaauaaccugcagccggaggauauugccacauacuuuugucagguguaugaguucguagugcccggcacuagacuagaccucaaaaggaccgucgcg

SEQ ID NO: 26970 - RNA, 309 nt, Artificial Sequence
  derived and/or modified sequence opt3 from anti-HIV_Chain
gacauccagaugacccaaagccccuccucucugucagccagagugggcgauacagucacuauuacgugccaggcuaacggguaccucaauugguaucagcagaggcggggaaaggcaccuaaacuucugauauacgacgguaguaaguuggaacgcggcguuccagcccgauucagcgggcguagauggggacaagaauauaacuuaaccaucaauaaccugcagccggaggauguggcgacauacuuuugucagguauaugaguucauugugcccggcacuaggcuagaccucaaacggaccgucgcu

SEQ ID NO: 26971 - RNA, 309 nt, Artificial Sequence
  derived and/or modified sequence opt3 from anti-HIV_Chain
gacauccagaugacccaaagccccuccucucugucagccagagugggcgauacagucacuauuacgugccaggcuaacggguaccucaauugguaucagcagaggcggggaaaggcaccuaaacuucugauauacgacgguaguaaguuggaacgcggcguuccaagccgauucuccgggcguagauggggacaagaauauaacuuaaccaucaauaaccugcagccggaggauauugccacauacuuuugucagguguaugaguucgcgguacccggcacuaggcuagaccucaaacggaccguggcu

SEQ ID NO: 26972 - RNA, 309 nt, Artificial Sequence
  derived and/or modified sequence opt3 from anti-HIV_Chain
gacauccagaugacccaaagccccuccucucugucagccagugugggcgauacagucacuauuacgugccaggcuaacggguaccucaauugguaucagcagagaaggggaaaggcaccuaaacuucugauauacgacgguagcaaguuggaacggggcguuccaucccgcuucucugggcgacguuggggacaagaauauaacuuaaccaucaauaaccugcaggccgaggauauugcgacauacuuuugucagguguaugaguucgcuguaccgggcacuagacuagaccucaaaaggaccguggcc

SEQ ID NO: 26973 - RNA, 309 nt, Artificial Sequence
  derived and/or modified sequence opt3 from anti-HIV_Chain
gacauccagaugacccaaagccccuccucucugucagccagugugggcgauacagucacuauuacgugccaggcuaacggguaccucaauugguaucagcagagaaggggaaaggcaccuaaacuucugauauacgacgguagcaaguuggaacggggcguuccaucccgcuucucugggcgacguuggggacaagaauauaacuuaaccaucaauaaccugcagccggaggauauugccacauacuuuugucagguguaugaguucaucguacccggcacuagacuagaccucaaaaggaccguggcg

SEQ ID NO: 26974 - RNA, 309 nt, Artificial Sequence
  derived and/or modified sequence opt3 from anti-HIV_Chain
gacauccagaugacccaaagccccuccucucugucagccagagugggcgauacagucacuauuacgugccaggcuaacggguaccucaauugguaucagcagaggcggggaaaggcaccuaaacuucugauauacgacgguaguaaguuggaaaccggcguuccaagccgcuucacagggcgacguuggggacaagaauauaacuuaacuaucaauaaccugcagccggaggauauugccaccuacuuuugucagguguaugaguucaucguacccggcacaagacuagaccucaaaaggaccguggcg

SEQ ID NO: 26975 - RNA, 312 nt, Artificial Sequence
  derived and/or modified sequence opt3 from anti-HIV_Chain
gacauccagaugacccaaagccccuccucucugucagccagugugggcgauaaggucacaauuacuugccagacgagcgcuggguaccucaacugguaucagcagagaaggggacgggcaccuaaacuucugauguacgacgguucccgcuugguuaccggcgugccaucucgauucucggggcguagauggggaacacaauauaauuuaacuauaggcucacugcagccggaggauguagccaccuacuauugucagguguacgaauuuuucggucccgggacaaggcuagaccucaagcggaccgucgcg

SEQ ID NO: 26976 - RNA, 312 nt, Artificial Sequence
  derived and/or modified sequence opt3 from anti-HIV_Chain
gacauccagaugacccaaagccccuccucucugucagccagugugggcgauaaggucacaauuacuugccagacgagcgcuggguaccucaacugguaucagcagagaaggggacgggcaccuaaacuucugauguacgacgguucccgcuugguuaccggcgugccaucucgauucucggggcguagauggggaacacaauauaauuuaacuauaggcucacugcagccggaggauaucgccaccuacuauugucagguauacgaauuuuucggucccgggacaaggcuagaccucaagagcaccguggcg

SEQ ID NO: 26977 - RNA, 312 nt, Artificial Sequence
  derived and/or modified sequence opt3 from anti-HIV_Chain
gacauccagaugacccaaagccccuccucucugucagccagagugggcgauacagucacuauuacgugccaggcuaacggguaccucaauugguaucagcagaggcggggaaaggcaccuaaacuucugauauacgacgguaguaaguuggaacgcggcguuccagcccgauucagcgggcguagauggggacaagaauauaacuuaaccaucaauaaccugcagccggaggauguggcgacauacuuuugucagguauaugaguucauugugcccggcacuaggcuagaccucaaacggaccgucgcugcc

SEQ ID NO: 26978 - RNA, 312 nt, Artificial Sequence
  derived and/or modified sequence opt3 from anti-HIV_Chain
ugcaccgugagcggcggguccaucauuucuuacuauuggaacuggauaagacagucacccggaaagggucuggaauggcucggcuacaucuucgacgggggaagggccaauuauaacccuagucuucggagccgccugacaauguccgucgauacuucuaaaaaucaaauuucguugaagguuaaaucagugacggcugcagacagcgccaucuacuauugugcgcgauuagauggcgaggcuuuucguuacuauuucgacaguuggggucaggggacccugguaacaguguccucugccagcacuaaggga

SEQ ID NO: 26979 - RNA, 312 nt, Artificial Sequence
  derived and/or modified sequence opt3 from anti-HIV_Chain
gugagcggcgggagauucuccaacuacggacugucuugggucaggcaggcccccggucaaggccucgaguggauggggcggaucguuccugcuauuaaucgcgcaaaguaugcccagaaauuucagggacgagugauacuuaccgcggacaagaucacagauacugcuuacauggaacugcguucauugagaagugaggacacggccauuuucuauugcgcaagggauccacagaucgaaauucggggcaacgccuuugacaucuggggucaagggaccguagugacagucagcuccgcuucuacuaaagga

SEQ ID NO: 26980 - RNA, 315 nt, Artificial Sequence
  derived and/or modified sequence opt3 from anti-HIV_Chain
agcgacaucuccguggcccccggcgagaccgcuagaauuucuugcggggaaaagucacugggaaguagggcaguccagugguaccaacaccgggccggucaggcgccuagccucauaaucuauaacaaucaggaucgcccauccggcauuccggagcgauucucugggucgcccgacucaccuuuuggaacaacugcuacgcuuaccaucacaagcguugaagccggcgaugaggcagacuacuauugucauauuugggauagucgugugccaacuaaauggguauucggugggggaaccacacugaccguguug

SEQ ID NO: 26981 - RNA, 315 nt, Artificial Sequence
  derived and/or modified sequence opt3 from anti-HIV_Chain
agcuccaugucugugucacccggcgagaccgccaagaucaguugcgggaaagaaagcauuggauccagagcuguccagugguaccaacagaagucuggucagccuccaucgcugauaaucuauaacaaucaggacaggccgucaggcguucccgagcgguucagcgcaacaccugauuuuggggccggaacuacggcgacccucacaauuacuaacguggaagcugacgaugaggccgacuacuauugucacaucuacgaugcacgcggcgguaccaauuggguauucgaccgaggggccacacuuaccgugcug

SEQ ID NO: 26982 - RNA, 315 nt, Artificial Sequence
  derived and/or modified sequence opt3 from anti-HIV_Chain
agcuucguguccgucgcccccggccagaccgcuagaaucacaugcggggaggaaucucugggaucaaggaguguuauuugguaccaacagcggccuggucaggcaccaagccucauaaucuauaacaauaacgaccgcccguccggcauucccgagcgauuuucugggucgccuggaucaacuuucggcacgaccgccacacuuacuaucaccagcguggaagcgggugaugaggcugacuacuauugucacauuugggauagucguagaccaacaaauuggguauuuggggaaggaaccacucugacaguguug

SEQ ID NO: 26983 - RNA, 315 nt, Artificial Sequence
  derived and/or modified sequence opt3 from anti-HIV_Chain
agcuucguguccgucgcccccggccagaccgcuagaaucacaugcggggaggaaucucugggaucaaggaguguuauuugguaccaacagcggccuggucaggcaccaagccucauaauguauaacaaucacgaccgcccguccggcauccccgagcgauuuucugggucgccuggaucaacuuucggcacgaccgccacacuuacuauuaccagcguggaagcgggugaugaggcugacuacuauugucauaucugggauagucguagaccaacaaacuggguauuuggggaaggaaccacucugacaguguug

SEQ ID NO: 26984 - RNA, 315 nt, Artificial Sequence
  derived and/or modified sequence opt3 from anti-HIV_Chain
gacauccagaugacccaaagccccuccucucugucagccagugugggcgauaaggucacaauuacuugccagacgagcgcuggguaccucaacugguaucagcagagaaggggacgggcaccuaaacuucugauguacgacgguucccgcuugguuaccggcgugccaucucgauucucggggcguagauggggaacacaauauaauuuaacuauaggcucacugcagccggaggauaucgccaccuacuauugucagguauacgaauuuuucggucccgggacaaggcuagaccucaagagcaccguggcggcu

SEQ ID NO: 26985 - RNA, 315 nt, Artificial Sequence
  derived and/or modified sequence opt3 from anti-HIV_Chain
gacauccagaugacccaaagccccuccucucugucagccagugugggcgauagagucagcauuaacugccaggcugggcagggacucgguuccucucuuaauugguaccagcaaaagccuggcagggcaccaaaacuguugguucacggggccucgaacuuacagcggggagugccgucacgcuucagcggcagugguuuucauacaacuuucacgcugaccauauccucucuacagcccgacgauguagcgacauauuuuugugcugccuuccagugguuugggccuggaacuaagguggagaucaaacgaacc

SEQ ID NO: 26986 - RNA, 318 nt, Artificial Sequence
  derived and/or modified sequence opt3 from anti-HIV_Chain
ugcaccgugagcggcggguccaucucuucagccggauacuauuggacauggauuagacagcaccccgguaagggccuggaguucauaggguacaucuauuacauuggaacuacguauuacaacccuagucucaaaagcaggcuuaccaucuccauugacacaucuaagaaucaauuuucgcugaaauugucaagcgucacugcugcagauaccgccaucuauuacugugcgcgggacuacacagcucgcggccgacauuucuuugauuauuggggucagggggccuuaguuaccgugaguuccgcaucuacuaaggga

SEQ ID NO: 26987 - RNA, 321 nt, Artificial Sequence
  derived and/or modified sequence opt3 from anti-HIV_Chain
agcucccugccccucucucuugccccuggcgcuaccgcaaagaucccaugcggggagaaaucaagaggaaguagggccgugcagugguaccaacagaagccgggucaggcgcccacacugauuauauauaacaaucaggaccggccugcuggcgucagcgaacgcuacuccgggaacccagauguugccaucggagugacugcaacguugaccauuucucgaguagaggccggcgacgaagcugaguauuacugucacuauugggauucgcguucacccaucagcuggguguucgguggguggacacaauuaacuguccug

SEQ ID NO: 26988 - RNA, 321 nt, Artificial Sequence
  derived and/or modified sequence opt3 from anti-HIV_Chain
agcucccugccccucucuguggccccuggcgcuaccgcaaagaucgccugcggggagaaaucauucgcgaguagagcuguccagugguaccaacagaagccaggacaggccccgguucuuauuauauauaacaaucaggacaggcccgccggugugagcgaacgguuuuccggcacaccugauguaggguucggaucuacugcaacgcugaccaucucgcgcguggaggcuggcgacgaagcagauuacuauugucacaaaugggacucacgaagcccauugaguugggucuuuggugggggaacacaauuaacugugcug

SEQ ID NO: 26989 - RNA, 321 nt, Artificial Sequence
  derived and/or modified sequence opt3 from anti-HIV_Chain
gacauccagaugacccaaagccccuccucucugucagccaguauuggcgauagagugacaauaacuugcagggcuagccaggacaucgcaaacuaccucaauugguaucagaagaaguccgggacgccuccaaaacuucugauuuucgccgcgaccaacuugcaccggggagucucuccgcgcuuuacagguucgggccaugggacucacuucucauuaaccaucacaaauguucagcaugaggauuuuggaaacuacuucugucaacagagcuuugcuaccgugggcaguuucggucaggggacuuggguagacauucga

SEQ ID NO: 26990 - RNA, 321 nt, Artificial Sequence
  derived and/or modified sequence opt3 from anti-HIV_Chain
gacauccagaugacccaaagccccuccucucugucagccaguauuggcgauagagugacaauaacuugcagggcuagccaggacaucgcaaacuaccucaauugguaucagaagaaguccgggacgccuccaaaacuucugauuuucgccgcgaccaacuugcaccggggagucucuccgcgcuuuacagguucgggccaugggacucacuucucauuaaccaucacaaauguucagcaugaggauuuuggacacuacuucugucaacagagcuuugcuaccgugggcaguuucggucaggggacuuggguagacauucga

SEQ ID NO: 26991 - RNA, 321 nt, Artificial Sequence
  derived and/or modified sequence opt3 from anti-HIV_Chain
gacauccagaugacccaaagccccuccucucugucagccagugugggcgauagagucacaauuacuugcagggcuagccaggacauagcaaacuaccucaauugguaucagaagaaguccgggacgccuccaaaacuucugaucuucgccgcgaccaacuugcaccggggaguuucuccgcgcuuuucggguucaggcagcgggacacauuucaguuuaacuauuaccaaugugcaguacgaggauuuugcuaacuauuucugucaacacuccuuuggaacaaucggcaccuucggucaggggacuuggguagacauucga

SEQ ID NO: 26992 - RNA, 321 nt, Artificial Sequence
  derived and/or modified sequence opt3 from anti-HIV_Chain
gacauccagaugacccaaagccccuccucucugucagccaguauuggcgauagagugacaauaacuugcagggcuagccaggacaucgcaaacuaccucaauugguaucagaagaaguccgggacgccuccaaaacuucugauuuucggagccaccaacuugcaccauggugucucuccgcgguuuucgggcucagggcacggaacacauuucagcuuaacuaucaccaauguucagcacgaggauuuugcgaacuacuucugucaacagaguuuucagacagugggcuccuucggucaggggaccuggguagacauucgc

SEQ ID NO: 26993 - RNA, 321 nt, Artificial Sequence
  derived and/or modified sequence opt3 from anti-HIV_Chain
gaaaucgugcugacccagagccccgccacacucucccuuucuccuggcgaaacugcuauuauaucaugcagaacgagucaaagcgggucccuggcaugguaccagcagaggccaggacaggccccgcgguuggucaucuauucugguucgacccgcgcggcuggcauucccgaccgauucucagggagccguuggggagccgauuacaacuuaaguaucuccaaucuggagucuggcgacuuugguguuuauuacugucaacaguaugaguucuuugggcagggaacaaaggugcagguagauauuaaaagaacuguggca

SEQ ID NO: 26994 - RNA, 321 nt, Artificial Sequence
  derived and/or modified sequence opt3 from anti-HIV_Chain
gacauccagaugacccaaagccccuccucucugucagccaguauuggcgauagagugaacauaacaugccaggcuagcagggacacuggguccgcacucaauugguaccagcagaaggucggacggccuccacgccuucugaucucugccguuucgaacuugggugcgggcgugccgucacgauucagcgggcguagaaguggaacgcaauccaccuuaacaauuaauacucugcagcccgaagauaucgcuaccuauuuuugucagcacuacgaguucuuuggcccugguacaaaaguagacauuaagaggaccguggcc

SEQ ID NO: 26995 - RNA, 321 nt, Artificial Sequence
  derived and/or modified sequence opt3 from anti-HIV_Chain
gacauccagaugacccaaagccccuccucucugucagccagugugggcgauagagucacaauuacuugccaggcugggcagggaauagguagcucccuccagugguaccaacagaagccuggcaaagcaccaaaacuucugguucacggggccucuaacuugcauaggggagugccgucgcgguucucaggcagcgguuuucacacgaccuucaguuuaacaaucuccgggcugcagcgcgacgauuuugcgacuuauuucugugcuguacuagaguuuuucggacccggcaccaagguggaaauuaagcgaacagucgcc

SEQ ID NO: 26996 - RNA, 324 nt, Artificial Sequence
  derived and/or modified sequence opt3 from anti-HIV_Chain
agcuacgugagaccccuguccgucgcccucggcgagaccgcuucuaucucaugcgggaggcaggcacuuggaagucgggccguucaaugguaucagcaccgcccuggucaggcgccaauucuguugauauacaacaaucaggaccgaccgagcggcauccccgaacguuucuccgggacaccugauauuaacuuuggaacuagagcuacguuaaccaucucuggcguggaggccggugacgaagcagauuauuacugucauaugugggacucgaggucaggguucagcuggaguuuuggaggcgccacacggcugacuguacua

SEQ ID NO: 26997 - RNA, 324 nt, Artificial Sequence
  derived and/or modified sequence opt3 from anti-HIV_LightChain
gacauccugaugacccagagccccucccuccuuucugccucagugggcgauagagucacaauuacuugcaaggcuagucaagacguuagcacggcaguggccugguaccagcagaaaccugggaaggcgccaaaacuguugauauauugggcuuccaccaggcacacaggaguaccgucucgguucacugguucgggcucagggaccgauuuuacauuaaccaucagccgccugcaggccgaggacuucgcacuauacuauugucaacagcauuacacuacacccuggaccuuuggaggcgguacgaagguggaaauuaaacga

SEQ ID NO: 26998 - RNA, 324 nt, Artificial Sequence
  derived and/or modified sequence opt3 from anti-HIV_LightChain
gacaucgugaugacccagagccccucccugcucucugccucagucggcgauagaguuacaauuacuugcaaggcuagucaagacgugagcacggcaguagccugguaccagcagaaaccugggaaggcgccaaaacuucugauauauugggcuuccaccaggcacacaggagugccgucucgguucucggguucaggcagcgggacugauuuuaccuugacaaucaguuccuuacagcccgaggacuucgcccuguacuauugucaacagcauuacaccacuccuuggacauuuggaggcgguaccaaggucgaaauuaaacgc

SEQ ID NO: 26999 - RNA, 324 nt, Artificial Sequence
  derived and/or modified sequence opt3 from anti-HIV_Chain
gacauccagaugacccaaagccccuccucucugucagccagugugggcgauacagucacuauuaacugccagacgaauaagggguaccucaacugguaucagcagagaaggggacgggcuccuaaacuucugauguacgacgguagcaaguugguuaccggcgugccaucccgcuucucugggcgacguuggggaacacaauauaauuuaacuauaggcucgcugcagccggaggauaucgcaaccuacuauugucagguauacgaauuuuucggucccgggacaagacuagaccucaaaaggaccguggccgcgccuucagau

SEQ ID NO: 27000 - RNA, 333 nt, Artificial Sequence
  derived and/or modified sequence opt3 from anti-HIV_Chain
cugagcgccuacgugggcgacagagucaccaucacaugcagggcuucccagaacauuaauacuuaucucaacugguaccaacagcggcccgggaaggcaccuaaacuucugauauaugccgcgucuacguugcagucaggaguuccaagucgcuucagcgguuccggcucugggaccgauuuuacauuaacuaucucgaaucuggagaccgaagacuucgcuguguacuauugucagcaaacauacucaagcguaaccuuuggacagggcacuaagcuagagacacgacguaccguggccgcaccgagugucuucauuuuucccccuuccgau

SEQ ID NO: 27001 - RNA, 333 nt, Artificial Sequence
  derived and/or modified sequence opt3 from anti-HIV_Chain
gagaucgugcugacccagagccccgccacacucucccuuucuccuggcgaaagagcuacucugucaugcagggcaagucaaggggucaacuucguugugugguaccagcagaagcggggacaggccccacgcuuguuaauuuaugguaauagcgaccgaguaccgggcgugcccgaucguuuuuccgcgagagggucuggaacggaguucucgcuggucauaucaagcguggaaccugacgauuuugcucuauacuauugucaagaguacaguuccaccccauauaacuucggccccgguacaaggguugaccggaaacgcacuguggccgca

SEQ ID NO: 27002 - RNA, 336 nt, Artificial Sequence
  derived and/or modified sequence opt3 from anti-HIV_HeavyChain
gaggugaagcuggaagagagcggcgggggacucguccagcccgguggcuccagaaaacuuucuugcgccgcuucaggguucaccuuuaguagcuucggaaugcacuggguuaggcaagcaccugaaaagggccuggaguggguggccuacaucuccucugguucgucaacauugcauuaugcggacacuguaaaagggcgguuuacgauuagccgcgauaacccaaagaauaccuuauuccugcagaugaaacuaccgagucucuguuacggacugcuuggcucccgaaaccugucucaccguuugcucagccagaaugacacacccauaugccug

SEQ ID NO: 27003 - RNA, 336 nt, Artificial Sequence
  derived and/or modified sequence opt3 from anti-HIV_Chain
gagaucgugcugacccagagccccgccacacucucccuuucuccuggcgaaagagcuacucugucaugcagggcaagucaaggggucaacuucguugugugguaccagcagaagcggggacaggccccacgcuuguuaauuuaugguccgagcgaccgagcgcccggcguaccugaucguuuuuccgcuagagggucuggaacggaguucucgcuggugauaucaagcgucgaaccagacgauuuugcccuauacuauugucaagaguacaguuccacccccuauaauuucggcacagguacuaggguggaccggaaacgcaccguugcagccccu

SEQ ID NO: 27004 - RNA, 336 nt, Artificial Sequence
  derived and/or modified sequence opt3 from anti-HIV_Chain
cagacccugagccucacaugcuccgugucuggcgggucaaucaguagcgccggauacuauugggguuggauuagacaacaccccggcaaggggcuugaguggauaggacauaucuacuauuccggcaacacuaauuacaacccuucucugaaaucgagguugucaaugagcgucgaaacgaguaagaaucaguucuccuuaaaccuggcuucuguuaccgcagccgacacagcgguguauuuuugugcucgggauuacagcgccgcaggucgccaccuauucgacuccugggggcagggcauucucguaacugugucaagugccagcaccaaagga

SEQ ID NO: 27005 - RNA, 336 nt, Artificial Sequence
  derived and/or modified sequence opt3 from anti-HIV_LightChain
gacaucgugaugacccagcaaacaccccugacucucagcauuacgauaggccagccugccuccaucucuugcaagucaagucagagccuucuggauuccgacgggaaaaccuacuugaacugguuacugcagagaccaggacaaucuccgaagaggcuaauuuauuggaugucgaaacucgauucagguguccccgaccgguucacaggcagcgggaguggaacugauuuuacccugaagaucucccgcguugaggcugaagaccuuggcguguacuauuguuggcaggguacacacuucccuuggaccuuugggggaggcacuaaacuggaguug

SEQ ID NO: 27006 - RNA, 339 nt, Artificial Sequence
  derived and/or modified sequence opt3 from anti-HIV_LightChain
gacaucgugauuacccagagcacaaaguucauguccacuucugucggcgauagaguuucaauaacgugcaaagccagucaagacgugagcaccgcuguagcaugguaccagcagaagcccgggcaguccccuaaacugcucaucuauugggccucuacaaggcacacuggagugccagaucgguuuaccgguucgggcucagggacagacuacacccuuacuauuagccgcguccaagcggaggaucuggcuuuguauuacugucagcagcauuauacaaccccguggacguucggaggcgguacuaaguuagaaaucaaacgaaccguggccgcaccc

SEQ ID NO: 27007 - RNA, 339 nt, Artificial Sequence
  derived and/or modified sequence opt3 from anti-HIV_Chain
gacauccagaugacccaaagccccuccucucugucagccagagugggcgauacagucacuuucacgugccaggcuaacggguaccucaauugguaucagcagaggcggggaaaggcaccuaaacuucugauuuacgacgguaguaaguuggagcgcggcguuccaagccgauuuuccgggcguagauggggacaagaauauaacuuaaccauaaauaaccugcagccggaggauaucgccacauacuucugucagguguaugaauuugcgguacccggcacuaggcuagaccucaaacggaccguggcugccccuucugucuucauuuuuccaucggau

SEQ ID NO: 27008 - RNA, 339 nt, Artificial Sequence
  derived and/or modified sequence opt3 from anti-HIV_Chain
cagagcgugcugacccaacccgccuccgucucuggcucaccugggcagaguaucacaauuagcugcacuggaacgaacuccgacguugguuacucuuaugugucgugguuccagcagcacccaggcaagguaccgaaacuccuuauauacgaugugucaagaaggagcaguggggucuccaaucgguuuucuggaagccgcuccggcaacaccgcuucacugacaaucagugguuugcgagcagaggacgaagccgauuauuacugugggagcuucacuaccucuuuaacacugguguuuggaggcggcaccaagcuagcgguucucgugucccccuca

SEQ ID NO: 27009 - RNA, 339 nt, Artificial Sequence
  derived and/or modified sequence opt3 from anti-HIV_Chain
agccuguccgccucugugggcgacagagucaccaucacaugcagggcuucagagaguauuagcuucuaccucaacugguaucagcaaaagcccgggaaagcaccugaacuucugauauuugccacuuccacguugcacucuggaguuccaucgcgguucucagguagcggcagugggaccgauuuuacauuaacuaucuccucucugcagcuagaggacuucgcgaccuacuauugucagcagagcuccucaacaccguuuaccuucggaggcgguacuaagguggaaauuaaacgcacaguagcugcccccaguguguuuaucuucccuccaagcgau

SEQ ID NO: 27010 - RNA, 342 nt, Artificial Sequence
  derived and/or modified sequence opt3 from anti-HIV_Chain
gacauccagaugacccaaagccccuccucucugucagccagugugggcgauacagucacuauuacgugccaggcuaacggguaccucaauugguaucagcagagaaggggaaaggcaccuaaacuucugauauacgacgguagcaaguuggaacggggcguuccaucccgcuucucugggcgacguuggggacaagaauauaacuuaaccaucaauaaccugcagccggaggauauugccacauacuuuugucagguguaugaguucaucguacccggcacuagacuagaccucaaaaggaccguggcggcuccuucggucuuuauuuucccacccucagau

SEQ ID NO: 27011 - RNA, 342 nt, Artificial Sequence
  derived and/or modified sequence opt3 from anti-HIV_Chain
gacauccagaugacccaaagccccuccucucugucagccagagugggcgauacagucacuauuacgugccaggcuaacggguaccucaauugguaucagcagaggcggggaaaggcaccuaaacuucugauauacgacgguaguaaguuggaacgcggcguuccaagccgauucuccgggcguagauggggacaagaauauaacuuaaccaucaauaaccugcagccggaggauauugccacauacuuuugucagguguaugaguucgcgguacccggcacuaggcuagaccucaaacggaccguggcugccccuucugucuuuaucuucccacccucggau

SEQ ID NO: 27012 - RNA, 342 nt, Artificial Sequence
  derived and/or modified sequence opt3 from anti-HIV_Chain
gacauccagaugacccaaagccccuccucucugucagccagagugggcgauacagucacuauuacgugccaggcuaacggguaccucaauugguaucagcagaggcggggaaaggcaccuaaacuucugauauacgacgguaguaaguuggaacgcggcguuccaagccgauucuccgggcguagauggggacaagaauauaacuuaaccaucaauaaccugcagccggaggauauugccacauacuuuugucagguguaugaguucguagugcccggcacuaggcuagaccucaaacggaccgucgcggcuccuucuguguuuaucuucccacccucggau

SEQ ID NO: 27013 - RNA, 342 nt, Artificial Sequence
  derived and/or modified sequence opt3 from anti-HIV_Chain
gacauccagaugacccaaagccccuccucucugucagccagagugggcgauacagucacuuucacgugccaggcuaacggguaccucaauugguaucagcagaggcggggaaaggcaccuaaacuucugauuuacgacgguaguaaguuggagcgcggcguuccaagccgauuuuccgggcguagauggggacaagaauauaacuuaaccauaaauaaccugcagccggaggauaucgccacauacuucugucagguguaugaauuugcgguacccggcacuaggcuagaccucaaacggaccguggcugccccuucugucuucauuuuuccacccucggau

SEQ ID NO: 27014 - RNA, 342 nt, Artificial Sequence
  derived and/or modified sequence opt3 from anti-HIV_Chain
gacauccagaugacccaaagccccuccucucugucagccagugugggcgauacagucacuauuacgugccaggcuaacggguaccucaauugguaucagcagagaaggggaaaggcaccuaaacuucugauguacgacgguagcaccuuggaacggggcguuccagcccgcuucuccgggcgacguuggggacaagaauauaacuuaacaauaaauaaccugcagccggaggauguggcgacuuacuuuugucagguauaugaguucaucgugcccggcaccagacuagaccucaagaggacagucgcugccccuucuguguuuauuuucccacccucggau

SEQ ID NO: 27015 - RNA, 342 nt, Artificial Sequence
  derived and/or modified sequence opt3 from anti-HIV_Chain
gacauccagaugacccaaagccccuccucucugucagccagugugggcgauacagucacuauuacgugccaggcuaacggguaccucaauugguaucagcagagaaggggaaaggcaccuaaacuucugauauacgacgguagcaaguuggaacggggcguuccaucccgcuucucugggcgacguuggggacaagaauauaacuuaaccaucaauaaccugcaggccgaggauauugcgacauacuuuugucagguguaugaguucgcuguaccgggcacuagacuagaccucaaaaggaccguggccgcacccucggucuuuaucuucccuccaucagau

SEQ ID NO: 27016 - RNA, 342 nt, Artificial Sequence
  derived and/or modified sequence opt3 from anti-HIV_Chain
gacauccagaugacccaaagccccuccucucugucagccagugugggcgauacagucacuuucacgugccaggcuaacggguaccucaauugguaucagcagagaaggggaaaggcaccuaaacuucugauuuacgacgguagccgguuggagcgcggcguuccaucccgauuuucugggcguagauggggacaagaauauaacuuaaccauaaauaaccugcagccggaggauaucgccacauacuucugucagguguaugaauuugcgguacccggcacuaggcuagaccucaagcggaccguggcugccccuucggucuucauuuuuccacccucagau

SEQ ID NO: 27017 - RNA, 342 nt, Artificial Sequence
  derived and/or modified sequence opt3 from anti-HIV_Chain
gacauccagaugacccacagccccuccucucugucagccagugugggcgauacagucacuauuacgugccaagcuaacggguaccucaauugguaucagcagagaaggggaaaggcaccuaaacuucugauauacgacgguagcaaguuggaaaccggcguuccaucccgguucacagggcgccgauggggacaggaauauaacuuaacuaucaauaaccugcaaccggaggauauugccaccuacuuuugucagguguaugaguucaucguacccggcacacgucuagaccucaaaagaaccguggcggcuccuucugucuuuauuuucccacccucggau

SEQ ID NO: 27018 - RNA, 342 nt, Artificial Sequence
  derived and/or modified sequence opt3 from anti-HIV_Chain
gacauccagaugacccaaagccccuccucucugucagccagagugggcgauacagucacuauuacgugccaggcuaacggguaccucaauugguaucagcagaggcggggaaaggcaccuaaacuucugauauacgacgguaguaaguuggaaaccggcguuccaagccgcuucacagggcgacguuggggacaagaauauaacuuaacuaucaauaaccugcagccggaggauauugccaccuacuuuugucagguguaugaguucaucguacccggcacaagacuagaccucaaaaggaccguggcggcuccuuccgucuuuauuuucccacccucugau

SEQ ID NO: 27019 - RNA, 342 nt, Artificial Sequence
  derived and/or modified sequence opt3 from anti-HIV_Chain
gacauccagaugacccaaagccccuccucucugucagccagagugggcgauacagucacuuucacgugccaggcuaacggguaccucaauugguaucagcagaggcggggaaaggcaccuaaacuucugauuuacgacgguaguaaguuggagcgcggcguuccaagccgauuuuccgggcguggauggggccaagaauauaacuuaaccauaaauaaccugcagccggaggauaucgccacauacuucugucagguguaugaauuugcgguacccgguacuagacuagaccucaaaaggaccguggcugccccuucugucuucauuuuuccacccucggau

SEQ ID NO: 27020 - RNA, 342 nt, Artificial Sequence
  derived and/or modified sequence opt3 from anti-HIV_Chain
gacauccagaugacccaaagccccuccucucugucagccagugugggcgauacagucacuauuacgugccaggcuaacggguaccucaauugguaucagcagagaaggggaaaggcaccuaaacuucugauauacgacgguagcaaguuggaacggggcguuccaucccgcuucucugggcgacguuggggacaagaauauaacuuaaccaucaauaaccugcagccggaggauauugccacauacuuuugucagguguaugaguucguagugcccggcacuagacuagaccucaaaaggaccgucgcggcuccuucgguguuuaucuucccacccucagau

SEQ ID NO: 27021 - RNA, 342 nt, Artificial Sequence
  derived and/or modified sequence opt3 from anti-HIV_Chain
agccaguccguggucacccaagagcccucucugacaguuucaccuggcgggacugugacgcuuaccugcggaccaaguacaggugccguaacuagcggcuucuacccgcacugguuucagcagaagcccgggcaggcuccuagagcacucaucuauuccaccucuaacaaauacucguggacaccagccagguucucaggaagccuguugggcgguaaggcgguguuaacccugagugacguccaacccgaugacgaagcugaguauuacugucuacuccugcuuuauuacgggggaccuuggauuuuuggcggcgggacuaaacugacaguguugguuucc

SEQ ID NO: 27022 - RNA, 345 nt, Artificial Sequence
  derived and/or modified sequence opt3 from anti-HIV_Chain
gacauccagaugacccaaagccccuccucucugucagccagugugggcgauaaggucacaauuacuugccagacgagcgcuggguaccucaacugguaucagcagagaaggggacgggcaccuaaacuucugauguacgacgguucccgcuugguuaccggcgugccaucucgauucucggggcguagauggggaacacaauauaauuuaacuauaggcucacugcagccggaggauguagccaccuacuauugucagguguacgaauuuuucggucccgggacaaggcuagaccucaagcggaccgucgcggcuccuagcguguuuaucuucccacccagugau

SEQ ID NO: 27023 - RNA, 345 nt, Artificial Sequence
  derived and/or modified sequence opt3 from anti-HIV_Chain
gacauccagaugacccaaagccccuccucucugucagccagugugggcgauacagucacuauuacgugccagaccacaaagggguaccucaacugguaucagcagagaaggggacgggcuccuaaacuucugauguucgacgguagcaaguugguuacuggcgugccaucccgcuuuucugggcgacguuggggaacccaauacaauuuaacaauaggcucgcugcagccggaagaucuagcaaccuauuacugucagguauaugaguucuuuggucccgggacuagacucgaccugaaaaggacaguggccgcgccuucagucuucaucuuuccacccagcgau

SEQ ID NO: 27024 - RNA, 345 nt, Artificial Sequence
  derived and/or modified sequence opt3 from anti-HIV_Chain
gacauccagaugacccaaagccccuccucucugucagccagugugggcgauacagucacuauuacgugccagaccaacaagggguaccucaauugguaucagcagagaaggggacgggcuccuaaacuucugaugugugacgguagcaaguugguuacaggcgugccaucccgcuucucugggcgacguuggggaacucaauacaacuuaaccauaggcucgcugcagccggaggauaucgcaacauauuacugccagguauaugaauuuuucggucccgggaccagacuagaccucaaaaggacuguggccgcgccuucagucuuuauuuucccacccagcgau

SEQ ID NO: 27025 - RNA, 345 nt, Artificial Sequence
  derived and/or modified sequence opt3 from anti-HIV_Chain
gacauccagaugacccaaagccccuccucucugucagccagagugggcgauaaggucacaauuacuugccagacgagugcuggguaccucaacugguaucagcagaggcggggacgcgcaccuaaacuucugauguacgacgguagccgauugguuaccggcgugccaucccguuucucugggagaagguggggaacacaauauaauuuaacuauaggcucgcugcagccggaggauaucgccaccuacuauugucagguauacgaauuuuucggucccgggacacggcuagaccucaagcgcaccguggcggcuccuucagucuuuauuuucccacccagcgau

SEQ ID NO: 27026 - RNA, 345 nt, Artificial Sequence
  derived and/or modified sequence opt3 from anti-HIV_Chain
gacauccagaugacccaaagccccuccucucugucagccagugugggcgauacagucacuauuacgugccagaccaacaagggguaccucaauugguaucagcagaaaagaggaagggcuccuaaacuucugauguacgacgguagcaaguugguuacaggcgugccaucccgguuaucugggcgccgauggggaacucaauauaaccugaccauaggcucgcuacagccggaagauaucgcaacauacuauugucagguauacgaguucuuuggucccgggacccgucucgaccugaagagaacuguggccgcgccuucagucuucauuuuuccacccagcgau

SEQ ID NO: 27027 - RNA, 345 nt, Artificial Sequence
  derived and/or modified sequence opt3 from anti-HIV_Chain
gacauccagaugacccaaagccccuccucucugucagccagugugggcgauacagucacuauuacgugccagaccaacaagggguaccucaauugguaucagcagagaaggggacgggcuccuaaacuucugauguacgacgguagcaaguugguuacaggcgugccaucccgcuuaucugggcgacguuggggaacucaauauaaccugaccauaggcucgcuacagccggaagauaucgcaacauacuauugucagguauacgaguucuuuggucccgggaccagacucgaccugaaaaggacuguggccgcgccuucagucuucauuuuuccacccagcgau

SEQ ID NO: 27028 - RNA, 345 nt, Artificial Sequence
  derived and/or modified sequence opt3 from anti-HIV_Chain
gacauccagaugacccaaagccccuccucucugucagccagugugggcgauacagucacuauuacgugccacaccaacaagggguaccucaauugguaucagcagagaaggggacgggcuccuaaacuucugauguucgacgguagcaaguugguuacaggcgugccaucccgcuuuucugggcgacguuggggaacucaguacaacuuaaccauaggcucgcugcaaccggaggauaucgcaacauauuacugucagguauaugaaguguucggucccgggaccagacuagaccucaaaaggacugucgccgcgccuucaguguuuauuuucccacccagcgau

SEQ ID NO: 27029 - RNA, 345 nt, Artificial Sequence
  derived and/or modified sequence opt3 from anti-HIV_Chain
gacauccagaugacccaaagccccuccucucugucagccagugugggcgauacagucacuauuaacugccagacgaauaagggguaccucaacugguaucagcagagaaggggacgggcuccuaaacuucugauguacgacgguagcaaguugguuaccggcgugccaucccgcuucucugggcgacguuggggaacacaauauaauuuaacuauaggcucgcugcagccggaggauaucgcaaccuacuauugucagguauacgaauuuuucggucccgggacaagacuagaccucaaaaggaccguggccgcgccuucagucuuuauuuucccacccagcgau

SEQ ID NO: 27030 - RNA, 345 nt, Artificial Sequence
  derived and/or modified sequence opt3 from anti-HIV_Chain
gacauccagaugacccaaagccccuccucucugucagccagagugggcgauaaggucacaauuacuuaccagacgagugcuggguaucucaacugguaccagcagaggcggggacgcgcaccuaaacuucugauguaugacgguagccgauugguuaccggcgccccaucccguuucucugggagaagguggggaacacaauacaauuuaacuauaggcucgcugcagccggaggauaucgcgaccuauuacugccagguguaugaauuuuucggucccgggacacggcuagaccucaagcgcaccguagcugccccuucaguguuuauuuucccacccagcgau

SEQ ID NO: 27031 - RNA, 345 nt, Artificial Sequence
  derived and/or modified sequence opt3 from anti-HIV_Chain
gacauccagaugacccaaagccccuccucucugucagccagugugggcgauacagucacuauuacgugccagaccaacaagggguaccucaauugguaucagcagagaaggggacgggcuccuaaacuucugauguacgacgguagcaaguugguuacaggcgugccaucccgcuucucugggcgacguuggggaacucaauauaacuuaaccauaggcucgcugcagccggaggauaucgcaacauacuauugucagguauacgaauuuuucggucccgggaccagacuagaccucaaaaggacuguggccgcgccuucagucuuuauuuucccacccagcgau

SEQ ID NO: 27032 - RNA, 345 nt, Artificial Sequence
  derived and/or modified sequence opt3 from anti-HIV_Chain
gugacccugagccucucccccggcgagagagccacacuuucuugcagggcuucacagacuaucaguaacaauuaccuggcaugguaucaacagaagccugggcaggccccacgguuguuaauuuacggagcgagcuccggugcuacgggccugccggaccgcuucucugggucgggaucaggcaccgauuuuacacuaacuauaagccgacucgaacccgaggacuucgccgucuauuacugucaccaguaugcacugaguccuuggaccuuuggucgugggacaaaaguugaaaucaagagaaccguggccgcuccauccguauucauuuuucccccuucugau

SEQ ID NO: 27033 - RNA, 345 nt, Artificial Sequence
  derived and/or modified sequence opt3 from anti-HIV_Chain
acccugagcgccuccgugggcgacagagucacaaucacuugcagggcuucucagucaauuaacaauuaccucaacugguaucaacagaagcccgggaaagcaccuaaacuucugauauacgccgcgaguagcuugcaguccggaguuccaucucgguucucggguucaggcagcgggacggauuuuaccuuaacaaucaguucccugcagccggaggacuucgugacuuauuacugucaacagaccuauucuaauccccgcauguuuggacagggcacaaagguagaaauuaagcgaaccguggcugccccuagcgucuucaucuuuccacccuccgaugagcag

SEQ ID NO: 27034 - RNA, 345 nt, Artificial Sequence
  derived and/or modified sequence opt3 from anti-HIV_Chain
cagagcgcccugacccaagcucccuccgcaucuggcacaccugggcagagagugacuaucucaugcaguggagguggcagcaacauugggggaaaucucgucuccugguaccagcacuucccaggcgccgcgccgaaacuucugauauauaggaacgaccagcggcccucugguguuccugaucgcuuuucggcuucaaagagcgggacgagugccuccuuggcaaucucuggauuacgaagcgacgaugaggccaccuacuucugugcugcauaugacuccacacugucacuacgucucuuuggcggcgggacuacccuggccgugcuuagucaaccaaaggcu

SEQ ID NO: 27035 - RNA, 345 nt, Artificial Sequence
  derived and/or modified sequence opt3 from anti-HIV_Chain
aagcccagccagacccugucccucacaugcacugugucuggcgggucaaucaguagcgccggauacuauuggacguggauuagacaccauccugguaaaggccuugaguucauaggguacaucuaucacauuggaaccccauacuauaacccgucccugaagucuagguugacaaucucgauugacacuagcaaaaaucaauuuucauuaaagcugaguuccgucaccgcugcagauacagccaucuacuauugugcgcgggacuacaccgcucgcggccgacauuucuuugauuacuggggucagggggcccuaguuacugugucuagcgcauccacaaaagga

SEQ ID NO: 27036 - RNA, 345 nt, Artificial Sequence
  derived and/or modified sequence opt3 from anti-HIV_Chain
cccagcgagacccugucccucacaugcagagugucuggcgccucaaucaguaacuucuacuggacuuggauuaggcagccugcugggaagggacuugaauggauaggucggcuguauagcuccgacaaaacgaauuacaacccaucuuugaauggccgcgucaccaugucguuagauacaucaaagaaccaauuuagccugcgacuaaccaguaugacugacgcagauacagccaucuauuacugugcgcgugagaaagggcaguggguuacccucccgcccuauuacuucgacuccuggggacagggcauucuggugacuguaucuagcgcuuccacaaagggu

SEQ ID NO: 27037 - RNA, 348 nt, Artificial Sequence
  derived and/or modified sequence opt3 from anti-HIV_Chain
ggccccgccacccugagcguguccccuggggagagagcuacacucucuugcagggcaucacagagucuucggaacaaucuggccugguaccaacagaagacuggacagagcccacgcuuguuaaucuaugcggucuccacgcgagcuaccgguauuccgccccguuucucuggcgggggaucgggcacagaauuuacucugaccauagacucacuacagagcgaggauuucgccguuuacuuuugucaacaguaugacaguccucaguggacauucggucaggggaccaaaguggaaaucaagagaacuguagcagccccauccguguuuauuuucccucccucugau

SEQ ID NO: 27038 - RNA, 348 nt, Artificial Sequence
  derived and/or modified sequence opt3 from anti-HIV_Chain
gcccccgugacccugagcgcuuccgucggcgacacaguuacuaucacgugcagagcaucucagccuauugccaccuuccucaacugguaccaacacaagccagggcaggcgccgaaacuucugauauaugcugccucaacauuucagaggggagcacccagucgguacagcgguuccggcucugggacugauuucaccuugacaaucaauucguuacagccugaggaccuggccaccuauuacugucaacagacuuuuacagauccagugaccuucggacagggcacgcgccuagaaauuaagcgaacuguagcugcacccucaguguuuaucuucccuccaagcgac

SEQ ID NO: 27039 - RNA, 351 nt, Artificial Sequence
  derived and/or modified sequence opt3 from anti-HIV_LightChain
gacauccagaugacccaaagccccuccacacugucugccucaauuggcgauacugugagaauaaguugcagggcuagccaguccaucaccgggggauggcucgcaugguaccaccagcggccugguaaggccccacgccuucugauuuaucgaggcucucguuuguuagggggagucccgucgagauucucaggcagcgcggcugguacggacuuuacacugacuaucgccaaccuacaggcagaggauuucgggaccuuuuacugucaacaguaugacacauaccccggaaccuucggccagggcacuaaaguugaagugaagaggacaguagccgcuccuaguguguuu

SEQ ID NO: 27040 - RNA, 351 nt, Artificial Sequence
  derived and/or modified sequence opt3 from anti-HIV_LightChain
gacauccagaugacccaaagccccuccacacugucugccucaauuggcgauacugugagaauaaguugcagggcuagccaguccaucacggggaacugggucgcaugguaccagcagcggccuggaaaggccccacgccuccuuauuuaucgaggugcggcucuguugggcgggguuccgucucguuucucgggaucagccgcaggcaccgacuuuacauuaacuaucgguaaucugcaaaccgaggauuucgggacauuuuacugucagcaguaugacaccuaccccggaacuuucggccagggcacaaaaguggaaguaaagagaaccguggccgcuccuagcgucuuu

SEQ ID NO: 27041 - RNA, 351 nt, Artificial Sequence
  derived and/or modified sequence opt3 from anti-HIV_LightChain
gacauccagaugacccaaagccccuccacacugucugccucaauuggcgauacugugagaauaaguugcagggcuagccaguccaucacggggaacugggucgcaugguaccagcagcggccuggaaaggccccacgccuccuuauuuaucgaggugcggcucuguugggcgggguuccgucucguuucagaggaucggccgcaggcaccgacuuuacauuaacuaucgguaaucugcaagccgaggauuucgggaccuuuuacugucagcaguaugacacauaccccggaaccuucggccagggcacuaaaguggaaguaaagaggacaguggcugcaccuucagucuuu

SEQ ID NO: 27042 - RNA, 351 nt, Artificial Sequence
  derived and/or modified sequence opt3 from anti-HIV_LightChain
gacauccagaugacccaaagccccuccacacugucugccucagugggcgauacugucagaauuaguugcagggcuagccaguccauaaccgggggauggcucgcaugguaccaccagcggccugguaaggccccacgccuucugaucuaucgaggcucucguuuguuagggggaguuccgucgagauucucaggcagcgcggcugguacggacuuuacacugacuauugccaaccuacaggcagaggauuucgggaccuuuuacugucaacaguaugacacauaccccggaaccuucggccagggcacuaaaguggaaguaaagaggacaguggccgcuccuagugucuuu

SEQ ID NO: 27043 - RNA, 351 nt, Artificial Sequence
  derived and/or modified sequence opt3 from anti-HIV_LightChain
gacauccagaugacccaaagccccuccacacugucugccucaauuggcgauacugugagaauaaguugcagggcuagccaguccaucacggggaacugggucgcaugguaccagcagcggccuggaaaggccccacgccuccuuauuuaucgaggugcggcucuguugggcgggguuccgucucguuucucgggaucagccgcaggcaccgacuuuacauuaacuaucgguaaucugcaagccgaggauuucgggaccuuuuacugucagcaguaugacacauaccccggaaccuucggccagggcacuaaaguggaaguaaagagaacaguggcugcaccuagcgucuuu

SEQ ID NO: 27044 - RNA, 351 nt, Artificial Sequence
  derived and/or modified sequence opt3 from anti-HIV_LightChain
gacauccagaugacccaaagccccuccacacugucugccucaauuggcgauacugugagaauaaguugcagggcuagccaguccaucaccgggggaugggucgcaugguaccaccagcggccugguaaggccccacgccuccuuauuuaucgaggcucucgucuguuagggggaguuccgucgagauucucaggcagcgcggcugguacggacuuuacauugacuaucgggaaccugcaggccgaggauuucggaaccuuuuacugucaacaguaugacacauaccccggcaccuucggccaggggacuaaaguggaaguaaagaggacaguggcagccccuagugucuuu

SEQ ID NO: 27045 - RNA, 351 nt, Artificial Sequence
  derived and/or modified sequence opt3 from anti-HIV_LightChain
gacauccagaugacccaaagccccuccacacugucugccucagugggcgauacugucagaauuaguugcagggcuagccaguccauaaccgggggauggcucgcaugguaccaccagcggccugguaaggccccacgccuucugaucuaucgaggcucucguuuguuagggggaguuccgucgagauucucaggcagcgcggcugguacgggguuuacacugacuauugccaaccuacaggcagaggacuucggaaccuuuuacugucaacaguaugauacauaccccggcaccuucggccaggggacuaaaguggaaguaaagaggacaguggccgcuccuagugucuuu

SEQ ID NO: 27046 - RNA, 351 nt, Artificial Sequence
  derived and/or modified sequence opt3 from anti-HIV_LightChain
gacauccagaugacccaaagccccuccacacugucugccucagugggcgggacugucagaauuaguugcagggcuagccaguccauaacgggagguuggcucgcaugguaccaccagcggccuggcaaggccccacgccuucugaucuaucgagggucucguuuguuaggaggcguuccgucgagauucucagguagcgcggcugggaccgauuuuacacugacuauugccaaccuacaggcagaggacuucggaaccuuuuacugucaacaguaugauacauaccccggcaccuucggccaggggacuaaaguggaaguaaagaggacaguggccgcuccuagugucuuu

SEQ ID NO: 27047 - RNA, 351 nt, Artificial Sequence
  derived and/or modified sequence opt3 from anti-HIV_LightChain
gacauccagaugacccaaagccccuccacacugucugccucaauuggcgauacugugagaauaaguugcagggcuagccaguccaucacggggaacugggucgcaugguaccaccagcggccuggaaaggccccacgccuccuuauuuaucgaggugcggcucuguugggcgggguuccgucucguuucucgggaucagccgcaggcaccgacuuuacauuaacuaucgguaaucugcaggccgaggauuucgggaccuuuuacugucaacaguaugacacauaccccggaaccuucggccagggcacuaaaguggaaguaaagagaacaguggcugcaccuagcgucuuu

SEQ ID NO: 27048 - RNA, 351 nt, Artificial Sequence
  derived and/or modified sequence opt3 from anti-HIV_LightChain
gacauccagaugacccaaagccccuccacacugucugccucaauuggcgauacugugaugauaaguugcagagcuagccaguccaucaccgggggauggcucgcaugguaccaccagaggccugguaaggccccacggcuucugauuuaucgcggcucuaaauuguuagggggagucccgucgcgauucucaggcagcgcggcugguacgggguuuacacugacuaucggaaaccuacaggccgaggacuucggcaccuuuuacugucaacaguaugauacauaccccggcaccuucgggcagggaacuaagguugaagugaaacguacaguagcagccccuaguguguuu

SEQ ID NO: 27049 - RNA, 351 nt, Artificial Sequence
  derived and/or modified sequence opt3 from anti-HIV_LightChain
gacauccagaugacccaaagccccuccacacugucugccucagugggcgauacugucagaauuaguugcagggcuagccaguccauaaccgggggauggcucgcaugguaccaccagcggccugguaaggccccacgccuucugaucuaucgaggcucucguuuguuagggggaguuccgucgagauucucaggcagcgcggcuggugccgacuuuacgcugacaauugcaaaccuacaggccgaggauuucgggacuuuuuacugucaacaguaugacaccuaccccggaacauucggccagggcaccaaaguggaaguaaagaggacuguggcugcaccuagugucuuu

SEQ ID NO: 27050 - RNA, 351 nt, Artificial Sequence
  derived and/or modified sequence opt3 from anti-HIV_LightChain
gacauccagaugacccaaagccccuccacacugucugccucaauuggcgauacugugagaauaaguugcagggcuagccaguccaucaccgggggauggcucgcaugguaccaccagcggccugguaaggccccacgccuucugauuuaucgaggcucucguuuggucgggggaguuccgucgagauucucaggcagcgcggcugguacggacuuuacauuaacuaucgggaaccugcaggccgaggauuucggaaccuuuuacugucaacaguaugacacauaccccggcaccuucggccaggggacuaaaguggaaguaaagaggacaguggcagccccuagugucuuu

SEQ ID NO: 27051 - RNA, 351 nt, Artificial Sequence
  derived and/or modified sequence opt3 from anti-HIV_LightChain
gacauccagaugacccaaagccccuccacacugucugccucaauuggcgauacugugagaauaaguugcagggcuagccaguccaucaccgggggauggcucgcaugguaccaccagcggccugguaaggccccacgccuucugauuuaucgaggcucucguuuguuagggggagucccgucgaaauucucaggcagcgcggcugguacggacuuuacacugacuaucgccaaccuacaggcagaggauuucgggaccuuuuacugucaacaguaugacacauaccccggaaccuucggccagggcacuaagguugaagugaaaagaacaguagccgcuccuaguguguuu

SEQ ID NO: 27052 - RNA, 351 nt, Artificial Sequence
  derived and/or modified sequence opt3 from anti-HIV_LightChain
gacauccagaugacccaaagccccuccacacugucugccucaacuggcgauacggugagaauuaguugcagggcuagccaguccauaaccgggaacugggucgcaugguaccagcagcggccuggaaaggccccacgccuccuuaucuaucgaggugcggcucuguugggcgggguuccgucucguuucagaggaucggccgcaggcacagacuuuacuuuaaccauugguaaucugcaagccgaggauuucgggacauuuuacugucagcaguaugacaccuaccccggaacuuucggccagggcacaaaaguggaaguaaagaggaccguggcugcaccuucagucuuu

SEQ ID NO: 27053 - RNA, 351 nt, Artificial Sequence
  derived and/or modified sequence opt3 from anti-HIV_LightChain
gacauccagaugacccaaagccccuccacacugucugccucaauuggcgauacugugagaauaaguugcagggcuagccaguccaucacggggaacuggcucgcaugguaccaccagcggccuggaaaggccccacgccuucugauuuaucgagguucucguuuguuaggcggggucccgucgagauucucaggaagcgcggcuggcaccgacuuuacacugacuaucgccaaucuacaggcagaggauuucgguaccuuuuacugucaacaguaugacacauaccccgggaccuucggacagggcacuaaaguugaagugaagaggacaguagccgcuccuaguguguuu

SEQ ID NO: 27054 - RNA, 351 nt, Artificial Sequence
  derived and/or modified sequence opt3 from anti-HIV_Chain
aucauucuguuccucguggccaccgcuacaggcagcugggcacaguccgcccuuacucaacccagaucugucucagggagucugggacagagcguuacgauauccugcaccgguucuucgucagacgugggcagguacaacuauguaagcugguaccagcaccauccugggaaggcgccaaaauugaugaucagugaugugaauaagcggccguccggaguccccgaccgcuuuucuggcagcaaauccgguaacacagcuucauuaacuauuagugggcugcaggccgaggaugaaaccgacuauuacuguugcagcuaugcaggaucuuacaucuggguguucggcggc

SEQ ID NO: 27055 - RNA, 351 nt, Artificial Sequence
  derived and/or modified sequence opt3 from anti-HIV_Chain
cccgugacccugagcgccuccgucggcgacagaguuacaaucacuugcagggcuucugaggauauuucaaaguaccucaacugguaucagcacaaaccugggaaggcaccaaaacuucugauauacacggccaguagcuuggaaaccggagugccgucccgguucucugguucgggcucagggacagacuuuagcuuaacuaucaguucccugcaacccgaugacuucgcgaccuauuacugucagcagucuuauacaagcuccguaaccuuuggacagggcacucgcguggaggucaagcgaacaguggcugccccuucaguuuucauuuuuccacccagugaugaacaa

SEQ ID NO: 27056 - RNA, 351 nt, Artificial Sequence
  derived and/or modified sequence opt3 from anti-HIV_Chain
guggaggaacccggcagcuccgucaagguuucuugcaaagccucagggggaaguagcaccgcuuacgguuauuccugggugagacaggcaccuggccaaggguucgaguggaugggaaggaucauuccauuuuacggcauaaucacauaugccccgaaguuccagggucggguaacuauuacggcggaccgcucuaccucgacaguguacauggaacugacucgacucaccuuugcugauacagcccuuuucuuuugugcacgugacuauggggaucccagaaacggauacuauuucgacucaugggaucagggccugugguugaccgucagcagugccuccacuaaaggc

SEQ ID NO: 27057 - RNA, 351 nt, Artificial Sequence
  derived and/or modified sequence opt3 from anti-HIV_Chain
caggugagacuggagcaaagcggcgccgcugucaggacccccggggcauccguuacacucucuugccaggccucaggauacaaguucgugaacuauaucauucacuggguacggcagcgcccuggucuugcguuugaaugggugggcaugauagacccauaccgagggcguccguggagugcucauagcuucgagggaagacuguccuugucuagggaugucucgauggaaaucuuauauaugacucugacgucacuacggagcgacgauaccgccacauacuuuugugcacgcgccgaggcugaaagucagucccacucuagacccauuaucagcacuuccggcgcaagg

SEQ ID NO: 27058 - RNA, 351 nt, Artificial Sequence
  derived and/or modified sequence opt3 from anti-HIV_Chain
gugcaccuggagguccagcuccaacagagcggccccgaacuuaagaaaccuggggagaccguuaagaucuccugcaaagccucuguguacacauucacugaauauccaauucauuggguaaagcaggcuccgggaaaagguuuuaaguggaugggcuggauaaacacguacucaggggagcccaccuaugcagacgauuucaagggaagauuugccuucagucuggaaacaagcgcguccacugcuuacuugcagaucaauucucugaaaaacgaggacaccgccacauauuuuugugcaucguuaggcagggauuacuggggucaagggcagggaaccacucuaacagug

SEQ ID NO: 27059 - RNA, 354 nt, Artificial Sequence
  derived and/or modified sequence opt3 from anti-HIV_Chain
cugagcgugucccucggcgagagagccaccaucaacugcaagucuucacagaguauucuuuacagcuccgacaaaaagaauuaucuggcuugguaccaacagaaaauagggcagcccccuaaguuguuacuguauugggcaucuacaagggaaucgggaaucccagaucgguucucagguagcggcaguggguccgacuuuacucuaacgauuucuagccuccagccggaggaugucgccguuuacuauugucaacaguacuauaucucccccuucaccuuuggaccuggcacaaaaguggaccugaagcgcacuguagcggcuccaucaguguucauuuuucccccuagugau

SEQ ID NO: 27060 - RNA, 354 nt, Artificial Sequence
  derived and/or modified sequence opt3 from anti-HIV_Chain
cagagcgugcugacccaacccccuuccgccucuggcgcuccagggcagagagucacaaucucaugcaguggagguccgagcaacguuggcgggaauuacguguauugguacaggcaguuccccggaacugcaccuaagcuccuuauucugcgggacgaucagcgcccauccggcguacccgaccgauuuucugccucgaaaucagguaacagcgcgaguuuggcuauauccggguuacguccugaugacgaggccuucuauuuuugugcaacguacgauucugacggaagcaucagacuguucggcggcgggaccgcccuaacagugcucucccaaccaaaggcugcacccuca

SEQ ID NO: 27061 - RNA, 354 nt, Artificial Sequence
  derived and/or modified sequence opt3 from anti-HIV_Chain
aaggcccccgcuacccugagccucuccccuggcgagagagcaacacuuucuugcagggccucacagaguguggggagcgaccuggcgugguaccaacagaaaccaggacaggcuccgcgguuguuaaucuaugaugccuccaaccgcgcaacugccauucccgcucgauucucugguucgggcucagggacggacuucacccugagcauaaguucccuagaaccugaggauuucgcagucuacuuuugucagcaacguuaugacaagaucacauucggacagggcacuagacucgaaauucagaggaccguugccgcuccaucuguguuuaucuuucccccuagcgaugagcag

SEQ ID NO: 27062 - RNA, 354 nt, Artificial Sequence
  derived and/or modified sequence opt3 from anti-HIV_Chain
caggugcaacugguccagagcggcgccgaggcuaagagacccggggacuccguuaaagugucuugcaaggcaucaggauacaccuucacagaauauuacauccacuggguaaggcagacuccuggucagggcuuugaguggauggggauuauaacgccaggagccggcaacaccacauaugcgcaaaaauuccagggucggaucacugugacccgcgauacaagugcugccaccgucuacauggaacucagcaaucuuacuuccgaggacacagcaguguauuuuuguucucgagggguuucguucuggggacagggcacccuggugacggucucaagcgccaguacuaagggc

SEQ ID NO: 27063 - RNA, 354 nt, Artificial Sequence
  derived and/or modified sequence opt3 from anti-HIV_HeavyChain
gaggugaagcugcagcaaagcggcgccgaacucgucagacccggggcuuccguuaaaaugucuugcaaggcaucaggauacagguucaccaguuauaacaugcacugggugaaacagacaccucggcagggucuugaguggaucggcgccauuuacccagggaauggagacacuagcuauaaccagaaguuuaaaggcaaggcgacgcugaccguagauaaguccucuucgacagcuuacaugcaauugaguagcuuaacuucagaagacuccgccguguauuucugugcacgcggucgacugucucuaggguuugauuacuggggacagggcagcacccucacagucuccuca

SEQ ID NO: 27064 - RNA, 357 nt, Artificial Sequence
  derived and/or modified sequence opt3 from anti-HIV_Chain
caggugcaacugguccagagcggcaccgccguuaagagacccggggcuuccgugaggguaucuugccaggcaucaggauacacauucaucgaccacuuuauuuauugguggcggcaggccccuggucaaggccucgaguggcuuggguggauaaacccacugacgagucagccgagcuaccccucccgcuuccagggacgauugacuuuaacccgugauacauuugacgaaaugcuguauauggaucuaagaggccucaggucugacgauacugguaucuacuucugugcgcggcgccauucggacuauugcgauuuugacauuugggggucaggaacccagaucauugugagcagu

SEQ ID NO: 27065 - RNA, 357 nt, Artificial Sequence
  derived and/or modified sequence opt3 from anti-HIV_Chain
caggugcaacugguccagagcggcaccgccguuaagagacccggggcuuccgugaggguaucuugccaggcaucaggauacacauucacugacuauuuuaucuacugguggcggcaggccccuggucaaggccucgaguggcuuggguggauuaacccacugacgagucagccgagcuaucccucccgcuuccagggacgauugaccuuaacacgugauacuuuugacgaaaugcuguacauggaucuaagaggccucaggucugacgauaccgguauauauuucugugcgcggcgccacucggacuacugcgauuuugacaucugggggucaggaacacagauuaucgugagcagu

SEQ ID NO: 27066 - RNA, 357 nt, Artificial Sequence
  derived and/or modified sequence opt3 from anti-HIV_Chain
cagagcgugcugacccaacccagauccgucucuggcucaccugggcagaguguuacaaucagcugcacuggaacguccucugacguggguggcuacaacuauguaucgugguaccagcagcacccagggaaggccccgaaaaccaugauuuucgaugugacaaagaggcccucaggagucccugaccgguuuagcggcaguaaauccgguaauacugcuucucucaccauaagcgggcuucaagcagaggaugaagccgacuauuacuguuccucauaugcgggacgcaacacauucuacguguuuggcaccggcacuacaguuaccgugcaggucaguccaagccagcccccucca

SEQ ID NO: 27067 - RNA, 357 nt, Artificial Sequence
  derived and/or modified sequence opt3 from anti-HIV_Chain
gagaucgugcugacccagagccccggcacacucucccuuucuccuggggaaagagccacucugucaugcagggcuagucaaagcgucuccucuaacuacuuggcaugguaucagcagaagccaggacaggccccgcgguuacugauuuacggugcgucgucacgcgcuacgggcauacccgaccgauucagcgggaguggauccggcaccgauuuuacacuaucuaucagccgucucgagccugaagacuucgccguuuauuacugucaacaguaugguacuuccucaugcaccuuugggcagggaacaaaacuggagauuaagagaaccguggcagccccaaguguauucaucuuu

SEQ ID NO: 27068 - RNA, 357 nt, Artificial Sequence
  derived and/or modified sequence opt3 from anti-HIV_Chain
cugagcgccuccgugggcgacagagucaccaucacaugcagggcuucucagucaauugaucgguaccucaacugguaucaacagaagcccgggaaagcaccuaaacuucugauauacgccgcgaguagcuugcacacugacguuccaucccgcuucucuggaucgggugcuggcacguauuuuaccuuaacaaucacuucacugcagccggaggauuucgccaccuacuauugucagcaaagccauagucccuccuuugggcaggaaucuuacagcauuacauucggacagggcacccgacuagagaucaagcguacuguggcagccccuuccguauuuauuuucccacccucagac

SEQ ID NO: 27069 - RNA, 357 nt, Artificial Sequence
  derived and/or modified sequence opt3 from anti-HIV_Chain
aacuucaugcugacccaggcccccagcgcuuccggcgcaccugggcaaagagugacaaucucuugcucaggagguccaaguaaugucggcgggaacuacguuuauugguacaggcaguauccgggaacugcccccaagcuccuuauucugcgggacgaucagcgcccuagcggcgugccagaccgauuuuccgcgucuaaaucggguaauucagcuagcuuggccauaagugaguuacgucccgaugacgaagcauucuacuuuugugccacguaugauuccgacgggucuaucagacuguucggaggcggcaccgcucuaacaguacucagccagccuaaggcagccccauccgug

SEQ ID NO: 27070 - RNA, 360 nt, Artificial Sequence
  derived and/or modified sequence opt3 from anti-HIV_Chain
gacauccagaugacccaaagccccuccucucugucagccaguauuggcgauagagugaacauaacaugccaggcuagcagggacacuggguccgcacucaauugguaccagcagaaggucggacggccuccacgccuucugaucucugccguuucgaacuugggugcgggcgugccgucacgauucagcgggcguagaaguggaacgcaauccaccuuaacaauuaauacucugcagcccgaggauaucgcuaccuauuuuugucagcacuacgaguucuuuggcccugguacaaaaguagacauuaagaggaccguggccgcaccaucugucuucaucuuucccccuagcgaugaacag

SEQ ID NO: 27071 - RNA, 360 nt, Artificial Sequence
  derived and/or modified sequence opt3 from anti-HIV_Chain
cagagcgugcugacccaacccgccuccgucucuggcucaccugggcagaguaucacaauuagcugcacuggaacguccaacgacguugguggccagaauuucgugucuugguaccagcaacacccagggaccgcuccgcagcuccuuauauaugauguaacaaacagacccgcaggagugucgucaagguuuagcggcaguaaguccgguaauacugccucucugaccaucagcggguugcggacagaggacgaagcggauuacuauugugcuuccuucaccauuuuaaacggagucgacuacguguuuggcacuggcacaaaaguuaccgugcugcuaucaccuagucagccauaucuc

SEQ ID NO: 27072 - RNA, 360 nt, Artificial Sequence
  derived and/or modified sequence opt3 from anti-HIV_Chain
aacuucaugcugacccagcccgccagcguguccggcucuccugggcaaucaaucacacucaguugcacuggaacgaccagcgacgucagagauuccaauuuuguuucuugguaccaacaggugccagguaaggcuccgaaacuuauuauauaugacguaucggcaaggcccucaggcgugagcuuccgguuuaguggguccaagucuggaaacacagccagccugacuaucuccggcuugcaggcggaagaugaggcuuuauacuauuguucaaguuucaccccuacaaauacccuggucuuuggugggggaacuaaacuaacagugcucggccagccaaaggccgcacccagcguuacc

SEQ ID NO: 27073 - RNA, 360 nt, Artificial Sequence
  derived and/or modified sequence opt3 from anti-HIV_Chain
cagagcgcccugacccaacccccugcugcauccggcgccccagggcagagagugacaaucucuugcucaggagguggcaguaacgucgggggaaaucucguuagcugguaccagcaguucccgggcgcggcucccaaacuuauucugcacagggacggucaacggccuuccggggugccagaucgcuuuucugccucgaagucaggaacuagcgcaaguuugacgauauccggcuuacgaucugacgaugaggccaccuauuucugugcugcauacgacagcgccguaucccugcccguguuuggcgggggaacaaagcuaacuguccucucacagccuaaagcugccccacuggugacc

SEQ ID NO: 27074 - RNA, 360 nt, Artificial Sequence
  derived and/or modified sequence opt3 from anti-HIV_Chain
cagcuggugcucacccaacccccuagcgucuccggcacaccagggcagaacguuacuaucucuugcucaggagguggcagucacguagggggaaaucuugugagcugguaccagcauuucccgggcgccgcucccaagcuguugauucacagagacaaccagaggccuuccggugugccagaucgguuuucugcauuaaaaucgggaaauucagccagccuggcgauaagugggcuacgcuccgacgaugaggcuuucuauuuuugugccgucuacgacucuagccucucccugggccuuuucggcgggggaacgaagcugaccguguugucacaacccaaagcagccccuaguguuaca

SEQ ID NO: 27075 - RNA, 360 nt, Artificial Sequence
  derived and/or modified sequence opt3 from anti-HIV_Chain
gacauccagaugacccaaagccccuccucucugucagccagugugggcgauagagucagcauucacugccaggcugggcagggaauagguuccucucucaagugguaccagcaaaaaucgggcagggcaccucggcuucugguucauggggccucaaacuugcagcgcggagugccaagccgauucaguggcuccgguuuucacacaacuuucacguuaaccaucucuagccugcagccggacgauguagcgacauauuggugugcugugcuagaguuuuucgggcccggaacuaaggucgaaauuaaacguaccguggccgcaccuuccguuuuuaucuucccacccucagacgagcag

SEQ ID NO: 27076 - RNA, 360 nt, Artificial Sequence
  derived and/or modified sequence opt3 from anti-HIV_Chain
gacauccagaugacccaaagccccuccucucugucagccagugugggcgauagagucacaauuacuugccaggcuagccaggggauaggauccucucuccagugguaccaacagaagccugguagggcaccaaaacuucugguucacggcgccucgaacuugcaucgcggggugccgucacgguucagcggaaguggcuuucacacguccuucaccuuaacaaucucuagccugcagcccgacgauguagcgacuuauuuuugugcugugcuagaguucuuugguccugggaccaaggucgaaauuaaacgaacaguggccgcaccauccguuuucaucuuucccccuucagacgagcag

SEQ ID NO: 27077 - RNA, 360 nt, Artificial Sequence
  derived and/or modified sequence opt3 from anti-HIV_Chain
gacauccagaugacccaaagccccuccucucugucagccagugugggcgauagagucagcauuaacugccaggcugggcagggaauagguuccucucucaauugguaccagcaaaagaggggcaaagcaccuaaacuucugguucacggggccucgacauugcagcggggagugccaucacgcuucagcggcagugguuuucauacuacguucaccuuaacaaucuccucucugcagccggacgauguagcgacuuauuuuugugagagcuuccagugguuugggcccggaaccaagguggaaauuaagcgaacagucgcugccccuuccguguucaucuuuccacccucagacgagcaa

SEQ ID NO: 27078 - RNA, 360 nt, Artificial Sequence
  derived and/or modified sequence opt3 from anti-HIV_Chain
uacauccagaugacccaaagccccuccucucugucagccaguauuggcgacagagugacaauaacuugccaggcugggcagggaaucgguagcucccucaacugguaucagcaaaagccuggcaaagcaccaaaacuucugguccacggggccucuaauuugcagaggggaguuucgucacgguucagcggcagugguuuucauacgaccuucacauuaacuauuuccucucugcgcccggaggauguggggaccuacuuuugugaaguauaugaguucaucggacccggcacaaagguggacauuaagcgaaccgucgcggcuccuagcguguuuaucuucccacccuccgaugaacag

SEQ ID NO: 27079 - RNA, 360 nt, Artificial Sequence
  derived and/or modified sequence opt3 from anti-HIV_Chain
gacauccagaugacccaaagccccuccucucugccugccucagugggcgauacagucacuauuacgugccaggcugggcagggaauagguaguagccuccagugguaccaacagagaccaggcagggcaccgaaccuucugguuuaugacgccuccaauuugcagcgcggggugcccucucgguucaccggaacaggcuuucacacuaccuucacauuaaccauccgaggucugcguccugaggauuuugggacuuacuucugugcgucgcuagaauuuuucggaccaggcacaaagguagacauuaaaagaaccguggcugcccccucagucuuuaucuucccuccaagcgaugagcag

SEQ ID NO: 27080 - RNA, 360 nt, Artificial Sequence
  derived and/or modified sequence opt3 from anti-HIV_Chain
gacauccagaugacccaaagccccuccucucugucagccagugugggcgauagagucacaauuacuugccaggcuagccaggggauaggauccucucuccagugguaccaacagaagccugguagggcaccaaaccuucugguucacggcgccucgaauuugcaucgcggggugccgucacgguucagcggaaguggcuuucacacgaccuucuccuuaacaaucucuggucugcagcgagacgauuuugcgacuuauuucugugcuguacuagaguuuuucgggcccggaaccaaaguggacauuaagcguacagucgccgcaccuagcguguuuaucuucccacccuccgaugaacag

SEQ ID NO: 27081 - RNA, 360 nt, Artificial Sequence
  derived and/or modified sequence opt3 from anti-HIV_Chain
gacauccagaugacccaaagccccuccucucugucagugagugucggcgauagaguuagcauuacaugcagggccacucaggggauaggaaacucccucaauugguaccagcagaagccugguaaagcuccaaaggugcuuaucuauggcacgaccaaacugcacgggggaguaccgucucgguucucgggcggugggucaggaagcacaggcacuuugaccauugacaguuuacaacccgaggauaucgcaacauacuucugucagcuguucgaauuuuucggcccugggaccaagguggagauuaaacgcacugucgccgcgccauccguguuuaucuuucccccuucugacgaacag

SEQ ID NO: 27082 - RNA, 360 nt, Artificial Sequence
  derived and/or modified sequence opt3 from anti-HIV_Chain
gacauccagaugacccaaagccccuccucucugucagccagugugggcgauagagucacaauuacuugccaggcugggcagggaauagguagcucccucaacugguaccagcaaaagccuggcagggcaccaaaacuucugguuuauggggccucuaauuugcagcggggagugccgucgcgcuucucaggcagcgguuuucacacgaccuucacauuaacuaucaguucccugcagcccgaggacuuugcgaccuacuucuguucuguauaugaauuucuagggccuggaacaaagguggagauuaaacgaaccgucgcugccccaagcguguucaucuuucccccuuccgaugaacag

SEQ ID NO: 27083 - RNA, 360 nt, Artificial Sequence
  derived and/or modified sequence opt3 from anti-HIV_Chain
cccauguuccagccuggccaaagcgggggaguggucguucaguccggugagucucugcaccucucaugcgaagccaguggcuuuaaguucgcuagccagaugaugcauugggugagacacguaccagggaggggacuugaguggguggcacugaucuccugggacggcucugguaaauuguuugccgauucgguccgggggcgcuucaccauucaucgauggaacgaccguaauucauuauaccuggaugugaagaacguuagaccggaagacgcggcuauauauuacuguacaaggaauggauuugauguguggggccagggcauccuagucacugugagcagugccuccacgaaaggg

SEQ ID NO: 27084 - RNA, 363 nt, Artificial Sequence
  derived and/or modified sequence opt3 from anti-HIV_HeavyChain
gaggugaagcuggucgaaagcggcgggggacucguucagcccgguggcucccuuagacugucuugcgccgcuucaggguucaccuuuaguagcuucggaaugcacugggugaggcaagcaccugagaaaggcuuggaauggguagccuacaucuccucugguucgucaacauuacauuaugcggacacugugaaggggcgguuuacgauuagccgcgauaacaguaaaaauucccuguaccuacagaugaaccuccugcgagcugaggacaccgccgucuauuacugugcacguggaucuagaaaucuuagccacaggcuguuguccuauuggggccagggcacacucgugacuguuucaagu

SEQ ID NO: 27085 - RNA, 363 nt, Artificial Sequence
  derived and/or modified sequence opt3 from anti-HIV_HeavyChain
gaggugcagcuggucgaaagcggcgggggacucguucaacccgguggcucccuuagacugucuugcgccgcuucaggguucaccuuuaguagcuucggaaugcacugggugaggcaggcaccuggcaaggguuuggaguggguauccuacaucucuucggggucaagcacauuacauuaugccgacacugugaagggacgguuuacgauuagucgcgauaacuccaaaaauucucuguaccuacagaugaacagccuccgagcggaagacaccgcugucuauuacugugcccguggcuccagaaaucugucacacaggcuucugaguuauuggggccaggggacauuggugacuguuagcucu

SEQ ID NO: 27086 - RNA, 363 nt, Artificial Sequence
  derived and/or modified sequence opt3 from anti-HIV_Chain
gacauccagaugacccaaagccccuccucucugucagccagugugggcgauagagucacaauuacuugccaggcuagccaggggauauccaacucucucaauugguaccagcaaaagccuggaaaagcaccaaggcuucugaucuaugguacgucgaccuugcagcggggcguuccgucacgcuucagcgggaguggauccggcacacgauuuacugugaccauuaacucuuuacagcccgaggacaucgccacauacuucugucagcacaaugaauuuuucggucgugggaccaagguagauauuaaaagaacuguggcggcuccuagcgucuuuaucuucccacccuccgacgagcaacug

SEQ ID NO: 27087 - RNA, 363 nt, Artificial Sequence
  derived and/or modified sequence opt3 from anti-HIV_Chain
gacauccagaugacccaaagccccuccucugugucagccagugucggcgauagaguuacaauuacuugccaggcuagcagggacacggauaacucccugaccugguaccagcagaagccugggcggccaccgaaacuccuuauauaucacgugguaaaucugggacccggugugccuucucgcuucucgggcucagcaagcagugccacacaauccacuuugaucauuucugacuuucagccagaugacgucgcgaccuacuucugucagaacuaugaguuuuucgggcccggaacaaagguggaaaucaaacgaaccguugcugccccuagcguguuuauuuucccacccuccgaugagcag

SEQ ID NO: 27088 - RNA, 363 nt, Artificial Sequence
  derived and/or modified sequence opt3 from anti-HIV_Chain
gagaucgugcugacccagagccccggcacacucucccuuucuccuggggaaagagccacucugucaugcagggcuagucaaagcgucuccucuaacaauuuggcaugguaccagcagaagccaggacaggccccgcgguuacugaugucgggugcgucaagccgcgcuacgggcauucccgaccgauucaguggguccggaucuggcaccgauuuuacacuaacuauaagccgucucgagccugaagacuucgccguuuaucacugucaacaguacgguuccucaccacccaccuuugggcagggaacaaaaguggagaucaagagaaccguagcagccccuaguguguucauuuuuccaccc

SEQ ID NO: 27089 - RNA, 363 nt, Artificial Sequence
  derived and/or modified sequence opt3 from anti-HIV_Chain
gacauccagaugacccaaagccccuccucucugucagccuacgugggcgauagagucacaauuacuugcagggcuagucagaacauaaauacguaucucaacugguaccagcagcggccugggaaggcaccaaaacuucugaucuaugccgcgagcaccuugcaauccggaguuccgucucgcuucucggguucaggcagcgggacagacuuuacuuuaaccauuaguaaucuggagacagaagauuucgcuguguacuauugucagcagaccuaccgauccguaacuuuuggacagggcacaaagcuagagaucaaacguaccguggccgcacccucugucuucauuuuuccuccaagcgac

SEQ ID NO: 27090 - RNA, 363 nt, Artificial Sequence
  derived and/or modified sequence opt3 from anti-HIV_Chain
gacauccagaugacccaaagccccuccucucugucagccagugugggcgauagagucacaauuacuugccaggcugggcagggaauagguagcucccuccagugguaccaacagaagccuggcaaagcaccaaaacuucugguucacggggccucuaacuugcauaggggagugccgucgcgguucucaggcagcgguuuucacacgaccuucaguuuaacaaucuccgggcugcagcgcgacgauuuugcgacuuauuucugugcuguaguggaguuuuucggacccggcaccaaggucgacauuaagcgaacaguggccgcaccuucuguuuuuaucuucccacccagcgaugaacagcua

SEQ ID NO: 27091 - RNA, 363 nt, Artificial Sequence
  derived and/or modified sequence opt3 from anti-HIV_Chain
caggugcaacuggucgagagcggcgccgaacucagaaagcccggggagucccuugaaaucucuugcaaggcuucaggauacaguuucagcucccacuggauugguugggcaaggcagaugccuggcaaagggcuggaguggaugggaauaaucuauccaggcgacucuaacaccauuuacucgccgucauuucagggucagguuacaaucagcgccgauaaaaguauuaauacugcguauuugcaaugguccucuuuaaaggcuagcgacacggccauguacuucugugcauccaacuaucaugauuacuuuuauugggggcagggaacccuggugacaguaucaagugccagcacuaaaggc

SEQ ID NO: 27092 - RNA, 363 nt, Artificial Sequence
  derived and/or modified sequence opt3 from anti-HIV_Chain
uucgugcagcuggucgagagcggcgggggaguugugcaacccgguaccucccucagacuuucuugcacaacuucaggcuuuaucuucagugacuacgggaugcacuggguaaggcaggccgcuggaaagggccuggaauggguggcagucauuuggcaugaugguagcaaccgguuuuaugccgacuccgugaaagggcgcuucacgauaucucgagauaauucgaagaacgcgguuuacuuggagaugaauaacuuacguguggaagacaccgcucuguauuacugugccagaacaucaauggauaucgacuauuggggacagggcacuccugucaccgugagcagugcauccacaaaaggc

SEQ ID NO: 27093 - RNA, 363 nt, Artificial Sequence
  derived and/or modified sequence opt3 from anti-HIV_Chain
gagcccauguuccagccuggccaaagcgggggaguggucguucaguccggugaaucucugcaccucucaugcgaggccaguggcuuuaaguucgcuagccagaugaugcauugggugagacacguaccagggaggggacuugaauggguggcacugaucuccugggacggcucugguaaauuguuugccgauucgguccgggggcgcuucaccauucaucgauggaacgaccguaauucauuauaccuggaugugaagaacguuagaccggaggacgcggcuauauauuacuguacaaggaauggauuugauguguggggccagggcauccuagucacugugagcagugccuccacgaaaggg

SEQ ID NO: 27094 - RNA, 366 nt, Artificial Sequence
  derived and/or modified sequence opt3 from anti-HIV_Chain
agccagcaccuggugcaauccggcacccaggucaagaaacccggggccucuguuagaaucucaugccaggcuaguggauacagcuucacagacuaugugcuccauugguggaggcaggcaccuggucaaggccuugaguggaugggguggauuaagccaguauacggagcccggaacuaugcgcgccgauuucagggccguauaaauuucgauagagacaucuacagggaaauugcuuuuauggaucuguccgguuugcggucugacgauacugccuuauauuucugugcacgcgacgggucgggagaugacacgucauggcaccuggauccguggggccagggcacccuagugaucgucagcgcc

SEQ ID NO: 27095 - RNA, 366 nt, Artificial Sequence
  derived and/or modified sequence opt3 from anti-HIV_Chain
gacauccagaugacccaaagccccuccucucugucagccagugugggcgauagagucacaauuacuugcagggcuagccaguccauaucucgguaccucaacugguaucagcagaagccugggaaagcaccaaaacuucugaucuacgccgcgucgucauugcaaggagguguuccgagccgcuucaguggcuccgggucuggaacggacuucaccuuaacaauuagcucccugcagcccgaggauuucgcuacuuauuacugucagcagucaaguagcaagccuuuuaccuucggcggugggacaaagguggaaaucaaacgaaccguagccgcaccaucuguguuuauuuuucccccuuccgac

SEQ ID NO: 27096 - RNA, 366 nt, Artificial Sequence
  derived and/or modified sequence opt3 from anti-HIV_Chain
gagaucgugcugacccagagccccggcacacucucccuuucuccuggggaaagagccacucugucaugcagggcuagucaaagcauuuccucuaacuacuuggcaugguaucagcagaagccaggacaggccccgcgguuacugauauacggugcgucgacgcgcgcuaccggcauccccgaccgauucucagggagcggaaguggcacagauuucacucuauccauuucucgucucgagccugaagacaucgccgucuauuacugucaccaauaugguagcucccagagauucgggcagggaaccaaaguugagauuaagaggacaguggcagccccaucaguauuuaucuuucccccuagugau

SEQ ID NO: 27097 - RNA, 366 nt, Artificial Sequence
  derived and/or modified sequence opt3 from anti-HIV_Chain
gagaucgugaugacccagagccccgccacacuguccgucucuccuggcgacagagcuacucucucaugcagggcaagucaaagcguuuccacgaaccuugccugguaccagcagaagccagggcaggcgccgcggcuguugauuuauggagcuucuacccgcgccacagguauacccgcaacuuucucgggcucaggguuugccaccgaguucacauuaaccaucagcagucugcaauccgaagauuuugcuguguacuauugucagcaguacaauaacuggccuccagcauucggacagggcacuaaaguagaaauuaagcgaacaguggccgcucccucugucuuuaucuucccuccaagcgac

SEQ ID NO: 27098 - RNA, 366 nt, Artificial Sequence
  derived and/or modified sequence opt3 from anti-HIV_Chain
gacauccagaugacccaaagccccgccucccugucugcuucagugggcgauagagucacaauuacuugcagggcaagucaggggauaagccacuaccucgccugguaucagcagaagccuggaaaaguuccacggcuucugaucuacgcggcuucccgcuugcaaucuggugugacgucgcgauucucaggcagcgggaguggaaccgaguuuacauuaacuauuuccucucugcuaccggaagacgccgcaguauauuucugucagaaguacgauaccgaccccaugacauuuggccaggguacccgucucgagaucaaaagaacuguggccgcuccuagcgucuucauuuuuccacccuccgau

SEQ ID NO: 27099 - RNA, 366 nt, Artificial Sequence
  derived and/or modified sequence opt3 from anti-HIV_Chain
cagagcgcccugacccaacccccuuccgcuucuggcgcaccagggcagagagugacaaucucaugcaguggagguccgagcaacgucggcgggaauuacguuuauugguacaggcaguuccccggaacugccccuaaccuccuuauucugcgggacgaucagcgcccauccggcgugcccgaccgauuuucugcgucgaagucagguaauagcgcuaguuuggccauauccggguuacguccugaugacgaggcauucuauuuuugugccacguacgauucugacggaagcaucagacuguucggcggcgggaccacacuaacuguacucucccaaccaaaagcugcacccucagugacccuguuu

SEQ ID NO: 27100 - RNA, 366 nt, Artificial Sequence
  derived and/or modified sequence opt3 from anti-HIV_Chain
gacauccagaugacccaaagccccuccucucugucagccagugugggcgauagagucacaauuaacugccaggcugggcagggaauagguagcucccucaauugguaccagaagaaaccuggcagggcaccaaaacuucugguucacggggccucuaacuugcaacggggagugccgucgcgcuucucaggcagcgguuuucauacuacguucaccuuaacaaucaguucccugcagcccgacgauguagcgacuuauuuuugugcuguguuccagugguuugggccuggaaccaaggucgacauuaagcgaacaguggccgcaccaucuguuuucaucuuucccccuagcgaugagcagcuaaaa

SEQ ID NO: 27101 - RNA, 366 nt, Artificial Sequence
  derived and/or modified sequence opt3 from anti-HIV_Chain
gacauccagaugacccaaagccccuccucucugucagccagugugggcgauagagucacaauuacuugccaggcuagccaggggauaggauccucucuccagugguaccaacagaagccugguagggcaccaaaccuucugguucacggcgccucgaaauugcaucgcggggugccgucacgguucagcggaaguggcuuucacacgaccuucuccuuaacaaucucuggucugcagcgagacgauuuugcgacuuauuucugugcuguacuagaguuuuucgggcccggaaccaagguggaaauuaaacguacagucgccgcaccuagcguguuuaucuucccacccuccgacgagcagcucaag

SEQ ID NO: 27102 - RNA, 366 nt, Artificial Sequence
  derived and/or modified sequence opt3 from anti-HIV_Chain
caggugcaccugguccaaagcggcgccgagguuaagaaacccggggcuuccgugaagguaucuugcaaagugucaggauacacccucagugaacuuagcauccauugggucagacaggguccuggcagggggcuggaguggauggcaaacuucgacccagaagauggagagacaauuuaugccccgcaguuucagggccgggugacuuugacggaagacaccuccacagauacugcguacaugcaauuaaccucucugcgcucggaggacacagcuguuuauuacugugccaccgaucgauauacugacacaggucguugggggcccggaacccuagugacggucucaagcgcaaguacuaagggc

SEQ ID NO: 27103 - RNA, 366 nt, Artificial Sequence
  derived and/or modified sequence opt3 from anti-HIV_Chain
caggugcaacuggucgagagcggcgggggacucauccagcccgguggcucccuuagacugucuugcgaagccucaggguucgcuguuggagacauuaacuacaugaguugggugaggcaggcaccuggcaaggguuuggaguggguaagcguguuauauuccgggggaucuucgcaguacgccgauucagucaaaggccgguuuaccauaagccgcgacaauagucgaaacacacuguaucuacaaauggauaaucuccgugcggaagacacugcuguguacuauugugccagaggccugaggguuuacuucgaucuuugggggcagggaauccuggugacggucuccucugcaagcaccaagggu

SEQ ID NO: 27104 - RNA, 366 nt, Artificial Sequence
  derived and/or modified sequence opt3 from anti-HIV_Chain
caggugcaaauggucgccagcggcgggggacugguuaagcccgguggcucccucagacuuucuugcgaggcuucaggguucaccuuuagugacuacuauaugagcugggugaggcaggcaccuggaaaaggccuggaauggaucuccuacauuacaucuggugggaacgccuuguauuacgcggauucgguaaagggacgguucacuauaucacgcgacaaugcuaaaaacagcuuauaucugcagaugaauagucuacgagccgaggauacggcaguguacuauugugcccgugaccuccugcacgcucaugauuuuggcagacagggcacccuugucacaguguccucugcaagcacuaagggg

SEQ ID NO: 27105 - RNA, 366 nt, Artificial Sequence
  derived and/or modified sequence opt3 from anti-HIV_Chain
cagcugcaacucguggagagcggcgggggagucguucagcccgguagaucccuuaggcugucuugcgccgcuucaggcuucaccuuuaguacauacacuaugcacugggugcggcaggcaccugggaagggauuggaauggguagccgugaucagcuaugacggcacgaauaaauacuaugcggauuccgucaagggucgcuucaccauuucucgagacaauucgaaaaacacauuauaccugcagaugaacucacuacguggggaggauacugcuguguauuacugugccagaagcccaaguuauuacuuugacuacuggggacaaggcacccucguuacaguguccgcagccucuaccaagggc

SEQ ID NO: 27106 - RNA, 369 nt, Artificial Sequence
  derived and/or modified sequence opt3 from anti-HIV_Chain
caggugcaccugagccaauccggcgccgcugucaccaagcccggggcaucuguuagagugucaugcgaggccaguggauacaaaaucagcgaccauuucauucacugguggaggcaggcgccuggucagggccuccaguggguaggguggauaaacccaaagacaggacaaccgaauaacccccggcaguuucagggccgcgugucccuuacucgacaggcuucuugggauuucgacacguauucguuuuacauggaucugaaagccguccguucagacgauaccgcaaucuauuucugugccagacaaaggagcgacuuuugggauuucgacgugugggguagugggacacagguuacuguguccucu

SEQ ID NO: 27107 - RNA, 369 nt, Artificial Sequence
  derived and/or modified sequence opt3 from anti-HIV_Chain
caggugcaacugcuccagagcggcgccgucguuaccaagcccggggcuuccgugagaguaucuugcgaggcaucaggauacaaaaucagggacuauuucauucacugguggcggcaggccccuggucagggccuucaaugggugggguggauaaacccacagacaggacagccgaauaucccccgcccuuuucagggccgagucacucugacgcgucaugcgaguugggauuucgacaccuuuagcuucuacauggauuugaaggcuuuaagauccgacgauacagccauuuauuuuugugcaaggcggcgcucugacuacugcgauuucgacgugugggguucggggacucacguuaccgugucaagc

SEQ ID NO: 27108 - RNA, 369 nt, Artificial Sequence
  derived and/or modified sequence opt3 from anti-HIV_Chain
caggugcaacugcuccagagcggcgccgcugucaccaagcccggggcauccguuagagugucuugcgaggccucaggauacaacaucagggacuauuucauucacugguggcggcaggcgccuggucagggccuucaauggguaggguggauaaauccaaaaacaggacagccgaacaauccccgccaguuucagggccgagugagucugacucgucaugcuagcugggauuucgacacguuuuccuucuacauggauuugaaggguuuaagaucugacgauaccgccaucuauuuuugugcaaggcaacggucggacuacugggauuucgacgucugggggucaggaacacaggugacuguuagcagu

SEQ ID NO: 27109 - RNA, 369 nt, Artificial Sequence
  derived and/or modified sequence opt3 from anti-HIV_Chain
caggugcaacugcuccagagcggcgccgcugucaccaagcccggggcauccguuagagugucuugcgaggccucaggauacaacaucagggacuauuucauucacugguggcggcaggcgccuggucagggccuucaauggguaggguggauaaauccaaaaacaggacagccgaacaauccccgccuguuucagggccgagugaguuugacucgucaugcuagcugggauuucgacacguuuuccuucuacauggauuuaaaggccgucagaucugacgauaccgcaguguauuuuugugccaggcagcggucggacuacugggauuucgacguuugggguucagggacacaagugacugucagcagu

SEQ ID NO: 27110 - RNA, 369 nt, Artificial Sequence
  derived and/or modified sequence opt3 from anti-HIV_Chain
caggugagacugcuccaaagcggcgccgcugucaccaagcccggggcauccguuagggugucuugcgaggccucaggauacgaaauccgggacuauuucauucacugguggcgccaggcgccuggucagggccuucaguggguaggguggauaaacccaaaaacaggacaaccgaauaacccccgacaguuucagggccgugugagucugacuagacaggcuagcugggauuucgacuccuacucuuuuuauauggauuugaaggccuuaaggucggacgauacgggugucuacuucugugcacggcaacgcucagacuauugggauuuugacgugugggggagcggaacccagguuacagugaguucc

SEQ ID NO: 27111 - RNA, 369 nt, Artificial Sequence
  derived and/or modified sequence opt3 from anti-HIV_Chain
caggugcaacugcuccagagcggcgccgcugucaccaagcccggggcauccguuagagugucuugcgaggccucaggauacaacaucagggacuauuucauucacugguggcggcaggcgccuggucagggccuucaauggguaggguggauaaauccaaaaacaggacagccgaacaauccccgccaguuucagggccgagugagucugacucgucaugcuagcugggauuucgacacguuuuccuucuacauggauuugaaggccuuaagaucugacgauaccgcagucuauuuuugugccaggcaacggucggacuacugggauuucgacgugugggguucagggacacagguuacugugagcagu

SEQ ID NO: 27112 - RNA, 369 nt, Artificial Sequence
  derived and/or modified sequence opt3 from anti-HIV_Chain
gaggugcagcuggucgaaagcggcgggggacucauccaaagagguggcucccuuaggcugucuugcguugccucaggguuccccgugagugacaaccacaugagcuggguacggcaggcuccuggaaagggcuuggaguggguguccauuauauacucugauggugggaccuauuacgcagacucggucaaaggacgcuuuacaaucucacgagauaauagcaagaacacuguguauuuacagaugaauagucugcgugccacggacaccgcgguuuacuauugugcuagagauccaggcuuccauuacggccuagacgugugggggcagggaacaacugucaccguguccucugccagcacaaaaggu

SEQ ID NO: 27113 - RNA, 369 nt, Artificial Sequence
  derived and/or modified sequence opt3 from anti-HIV_Chain
caggugcaacugcaggagagcggccccgggcuccuuagaccucuggaaaccuuguccuuaacaugcucugucucaggagguaguaucaggggcuacuucuggagcuggguucggcagccagccgggcgcggacuggaguggauuggccgaauauauuccucugguacuacgcguuuuaacccgucgcuaaagucaagagugaggcucagcaucgacaccgcuaaaagugaaguaucccugaauauuacaucugugacugcagccgauagcgcguccuacuucugugcugggaccucacccguccacggaggccuugaccuguggggcuuggggcuccgggugacaguuaguagcgccucuaccaaggga

SEQ ID NO: 27114 - RNA, 369 nt, Artificial Sequence
  derived and/or modified sequence opt3 from anti-HIV_Chain
gagaucgugcugacccagagccccggcacacucucccuuucuccuggggaaagagccacucugucaugcagggcuagucaaagcgucuccucuaacuuggcaugguacgcccagaagccaggacaggcgccgcgguuaauuauauauggugcuucgucacgcgccagcgcaauccccgaccgauuccguggcaguggguccggaacggauuuuacccugacaauuucuagacuagagccugaagacuucgccguuuacuauugucagcaauacgaugacgcuccaaucacuuuuggccacgguaccaggcucgagauuaaacggacaguggcagcccccagcguauucaucuuuccuccauccgaugaa

SEQ ID NO: 27115 - RNA, 369 nt, Artificial Sequence
  derived and/or modified sequence opt3 from anti-HIV_Chain
gagaucgugcugacccagagccccggcacacucucccuuucuccuggggacagagccgcucugucaugcagggcaagugaaacuuugagcggaaacuccuuagccugguaccaacagaagcggggucagccaccgcgccugcuaauuuucgcggcuucuucgcgagccacgggcauacccgagcguuuuucagggggaggcagcgguaccgauuucacacucacuaucaccagacuggaaccugaggacuuugcagucuauuucugucagcaauacguugaugccccaauuacauuugggcagggaaccaggcuugaaaucaaacggacuguggcugcacccaguguauucauuuuuccuccauccgac

SEQ ID NO: 27116 - RNA, 369 nt, Artificial Sequence
  derived and/or modified sequence opt3 from anti-HIV_Chain
gacauccagaugacccaaagccccuccucucugucagccagugugggcgauagagucacaauuacuugcagggcuagccaggacauaacgaccuaccucgcauggcuucagcagaagccugggaaagccccaaagucccugaucuauucugcgucgacaguucaaucaggagugccgagccgguucagugguuccggcucugggacugaguuuaccuugacaauuagcggauuacagcccgaagauuucgcuaccuacuauugucagcaguacaacuauuacccuaucacuuuuggccuggguacacgccuagagauuaaacgaaccguagccgcaccauccguguucaucuuucccccuucagacgaa

SEQ ID NO: 27117 - RNA, 369 nt, Artificial Sequence
  derived and/or modified sequence opt3 from anti-HIV_Chain
gacauccagaugacccaaagccccuccucucugucagccaguauuggcgauagagugacaauaacuugcagggcuaaccagcacauccggagcuuccucaauugguaccagcagacgccugggaaggcaccaaaacuucugauuuaugccgcguccaccuugcaacgcggagucccgucucgauuuucggguucaggcagcgggacagacuucacuuuaaccaucacaagucuggagcgugaagaucuagcuaccuacuauugucagcagacuuacacaucccccauuaccuuuggacagggcacgagacucgagaucaagaggacuguugccgcaccuucuguguucauauuuccacccagcgacgaa

SEQ ID NO: 27118 - RNA, 369 nt, Artificial Sequence
  derived and/or modified sequence opt3 from anti-HIV_Chain
agcgagaucgugcugacccagucccccgccacacucucucuuucaccuggcgaaagugcuacucugagcugcagagcaucccaaucuuugucgagcucauuagccugguaccagcagaagccagggcaggcgccgaggcugcuaauuuaugacacgagugaucgggcuaccggaauacccgcccgcuucuccggucgaggcucugggacagacuuuacucucaccaucagcucccuggagccugaagauuucgcagucuacuauugucaacagcguucaaacugggccauuacauuuggacagggcaccagacuugagaucaaaaggacuguugcugcaccaaguguguucauuuuucccccuagcgac

SEQ ID NO: 27119 - RNA, 369 nt, Artificial Sequence
  derived and/or modified sequence opt3 from anti-HIV_Chain
caggugcugagcgucuccggcacccccgggcaaagaguuaucauuucuugcucaggaacaaguagcaacguggguggcaaucucguauccugguaccagcaccuuccuggggccgcuccaaggcuguugauacaucgggacgaucagcgcccgucuggagugcccgaccgauucucgggcucaaagagcgguaacagugcauccuuagucaucucugggcugcguagcgaugacgaggccgauuauuuuugugcggcuuacgacuccacuuucucacuaccuguguuuggaggcggcacgagacucaccguucugagucagccaaaagccgcacccagcgugacacuuuaugccccuucuuccgaagag

SEQ ID NO: 27120 - RNA, 369 nt, Artificial Sequence
  derived and/or modified sequence opt3 from anti-HIV_Chain
gacauccagaugacccaaagccccuccucucugucagccagugugggcgauagagucacaauuacuugccaggcugggcagggaauagguagcucccuccagugguaccaacagaagccuggcaaagcaccaaaacuucugguucacggggccucuaacuugcauaggggagugccgucgcgguucucaggcagcgguuuucacacgaccuucaguuuaacaaucuccgggcugcagcgcgacgauuuugcgacuuauuucugugcuguacuagaguuuuucggacccggcaccaagguggaaauuaagcgaacagucgccgcaccuucuguguuuaucuucccacccagcgacgagcagcucaaaucc

SEQ ID NO: 27121 - RNA, 369 nt, Artificial Sequence
  derived and/or modified sequence opt3 from anti-HIV_Chain
gagaucgugcugacccagagccccgccacacucucccuuucuccuggcgaaagagcuacucugucaugcagggcaagucaaggguugaacuucgucguuugguaccagcagaagcggggacaggccccacgcuuacugauucacgcgccgagcgaccgagcucccggugugccugaucguuucuccgccagaggcucugggacggacuucucgcuaguaauaucaagcguggagccagaugacuuugcaaucuauuacugucaagaauauaguuccacccccuacaauuucggaccuggcacaagggucgaucggaaacgcacuguggccgcuccaucuguuuuuauuuuucccccuagcgacgagcag

SEQ ID NO: 27122 - RNA, 369 nt, Artificial Sequence
  derived and/or modified sequence opt3 from anti-HIV_Chain
gagaucgugcugacccagagccccacaacucucucccuuucuccuggcgaaagagccacgcugucaugcagggcuagucaaggggucaacuugguugugugguaccagcagaagcggggacaggcaccacgcuuacugauuuaugguccgagcgaccgagcccccggcguaccugaucguuucuccgcgagagggucuggaaccgaguuuucgcuagugauaucaagcgucgaaccagacgauuucgcucucuacuauugucaagaguacaguuccacacccuauaauuuuggcacugguaccaggguggaccggaaacgcacaguugccgcaccuucuguguucaucuuuccacccagcgaugaacag

SEQ ID NO: 27123 - RNA, 369 nt, Artificial Sequence
  derived and/or modified sequence opt3 from anti-HIV_Chain
gagaucgugcugacccagagccccgccacacucucccuuucuccuggcgaaagagcuacucugucaugcagggcaagucaaggggucaacuucguugugugguaccagcagaagcggggacaggccccacgcuuguuaauuuaugguccgagcaaucgagcgcccggcguaccugaccguuucuccgcuagagggucuggaacggaguucucgcuggugauaucaagcgucgaaccagaugacuuugcccuauacuauugucaagaguacaguuccacccccuauaacuucggcccugguacaaggguggaucggaaacgcacuguugcagccccaucuguguuuaucuuucccccuagcgacgaacag

SEQ ID NO: 27124 - RNA, 369 nt, Artificial Sequence
  derived and/or modified sequence opt3 from anti-HIV_Chain
gagaucgugcugacccagagccccgccacacucucccuuucuccuggcgaaagagcuacucugucaugcagggcaagucaaggguugaacuucgucguuugguaccagcagaagcggggacaggccccacgcuuacugauucacgguccgagccaucgagcgcccggcgugccugaccguuucuccgcuagagggucuggaacggaguucucgcuaguaauaucaagcguggaaccagaugacuuugccaucuauuacugucaagaguauaguuccacccccuacaauuucggcccugguacaagggucgaucggaaacgcacuguggcagccccaucuguuuuuauuuuucccccuagcgacgaacag

SEQ ID NO: 27125 - RNA, 369 nt, Artificial Sequence
  derived and/or modified sequence opt3 from anti-HIV_Chain
gagaucgugcugacccagagccccgccacacucucccuuucuccuggcgaaagagcuacucugucaugcagggcaagucaaggguugaacuucgucguuugguaccagcagaagggaggucaggccccacgguuacugauucacggcccgacggaccgcgcgcccggggugccugaucgauucagcgcucguggauccggcaccgaguucucucuaguaauaucgucaguggaaccagacgauuuugcccucuauuacugucaagaguauagcaguacacccuacaauuucgguccugggacuagagucgacaggaaacggaccguggcagccccauccguuuuuaucuuucccccuucugaugaacag

SEQ ID NO: 27126 - RNA, 369 nt, Artificial Sequence
  derived and/or modified sequence opt3 from anti-HIV_Chain
gagaucgugcugacccagagccccgccacacucucccuuucuccuggcgaaagagcuacucugucaugcagggcaagucaaggguugaacuucgucguuugguaccagcagaagcggggacaggccccacgcuuacugauucacgcgccgagcggucgagcucccggcgugccugaccguuucuccgccagagggucuggaacggaguucucgcuaguaauaucaagcguggaaccagaugacuuugcaaucuauuacugucaagaguauaguuccacccccuacaauuucggcccugguacaagggucgaucggaaacgcacuguggccgcuccaucuguuuuuauuuuucccccuagcgacgaacag

SEQ ID NO: 27127 - RNA, 369 nt, Artificial Sequence
  derived and/or modified sequence opt3 from anti-HIV_Chain
caggugcaacugguccagagcggcgccgagguuaagaaacccggguccucugugaagguaucaugcaaaaccaguggagguagcuucuccaacuacgcuuuuucuugggugagacaggcaccuggcgaagggcucgaguggaugggaaggaucauuccaauauucggcacagccaaguauacucagaaacuucaaggucgggucacgaucaccgcggacaaguuuacaucgacuguguacauggaacugagcucauugcgcagugaggauaccgcuauuuauuacugugccuccuuacaccaggggccgaucggauauacacccuggcauccuccaccccgagcaccucugggccagucuguuugcggc

SEQ ID NO: 27128 - RNA, 369 nt, Artificial Sequence
  derived and/or modified sequence opt3 from anti-HIV_Chain
caggugcaacuggucgagagcggcgggggacucguucagcccgguggcucccuuagaaucucuugcucagccaccggguucacauuuaguacucacgcuaugcauugggugaggcaggcaccuggaaagggccuggaauacguaagcgccauuaacuccaauggucggucugcguucuaugcugacucggugaaagggcgcgucacgauaucacgagauaacagcaagaauaccuuguuuuuacagaugacaagucugcgugccgaggacacugcaguguacuauuguguuaaaggaccacuacucagauaccuggauuccuggggccaaggcacccuugugacagucucuagcgccuccaccaagggg

SEQ ID NO: 27129 - RNA, 369 nt, Artificial Sequence
  derived and/or modified sequence opt3 from anti-HIV_Chain
gaggugcagcuggucgaaagcggcgggggacucguucaacccgguggcucccuuagaaucucuugcucagccaccggguucacauuuaguacucacgcuaugcauugggugaggcaggcaccuggaaagggccuggaguacguaagcgccauuaacuccaauggucggucugcguucuaugcugacucggugaaagggcgcgucacgauaucacgagauaacagcaagaauaccuuguuuuuacagaugacaagucugcgugccgaagacacugcaguguacuauuguguuaaaggaccacuacucagauaccuggauuccuggggccagggcacccuugugacagucucuagcgccuccaccaagggg

SEQ ID NO: 27130 - RNA, 369 nt, Artificial Sequence
  derived and/or modified sequence opt3 from anti-HIV_Chain
gaggaaagcggccccgggcuggugaagccuucccagacccucucucuuacaugcucagucaguggagacagcguuuccucugguggcuacuucuggucguggaucagacaacacccaacuaaagggcuggaguguuugggauauguguacuauacgggcaacaccuacuauaauccgucauuaaagagucccccuacaauugaaguagccauggcuaacaaucaggugagccugaaacuagguuccgucacugcagccgauaccgcgguguacuauugcgcuaggauaaagcgguuucgcgggggaaacuacuucgacacauggggccauggccuccugguuaccgugucuagcgccuccacuaaaggg

SEQ ID NO: 27131 - RNA, 369 nt, Artificial Sequence
  derived and/or modified sequence opt3 from anti-HIV_Chain
caggugcaacugcaggagagcggcuccgggcucgucaagcccucuggaacccuuucacugacaugcgccguuaguaacgguccuaucagcuccggcaauugguggucuugggugagacagacuccagaaaaaggguuggaguggauuggagaaguauaccacucgggcucaacgaaccauaauccgagcuuaaagaguagggcuaccauacugguggacaaauccaagaaccaguucucucuaaaucuccggagcgucacagcagccgauacugcgguguauuacugugcucgcguucgagguuccuggaacuuugacuauugggggcaaggaauccuggugaccgucucaagugccagcacaaaaggc

SEQ ID NO: 27132 - RNA, 369 nt, Artificial Sequence
  derived and/or modified sequence opt3 from anti-HIV_HeavyChain
gaggugcagcugcaacagagcggcaccguccucgccagacccggggcuuccguuaagaugucuugcaaagcaucaggauacacauucacuucauauuggaugcacugggugaagcagaggccuggucagggccuugaauggaucggggccauuuacccaggaaacagcgacacguccuauaaucaaaaauuuaagggcaaagcgaagcugaccgcuguaacaucugccucgacugcauacauggaguugaguagcuuaaccaacgaagauagugccguguauuacuguacacgguggccgcauuauuacggugggucccgcuacuauuucgacuacuggggacagggcaccacucugacagucucuagc

SEQ ID NO: 27133 - RNA, 372 nt, Artificial Sequence
  derived and/or modified sequence opt3 from anti-HIV_Chain
gugguccagcugguugagagcggcgggggacucgugcaacccgguggcucccuuagacugucuugcgccgcuucaggguucgcauuuaggaguuacuggaugagcuggguacggcaggccccuggacgcggcuuggaauggguggcgaacaucaagcaggacgguuccgagaaauauuacgcugauucugucaaggggcgauucaccauuucgcgugacaauacuaaaaacucauuauaucugcagaugaauagccuaagagccgaagauacagcaguguuuuacugugccaguaggggagaccgguauggcccaauagauuacuggggccaagggacgcucguuaccguguccucugcuagcacaaaggga

SEQ ID NO: 27134 - RNA, 372 nt, Artificial Sequence
  derived and/or modified sequence opt3 from anti-HIV_Chain
caggugcaacugguccagagcggcgccgagaucaagaaacccggggaaucccucaagauuucuugcaaggcuucaggauacaccuucaacgacuauuggauagguuggguuagacagaugccuggcaaagggcuugaguggaugggaaucuuuuacccagaugacagugauagcaauuauuccccgucuuuccagggcagggugacaauuucggcagacaaaucaaucacuacggccuaccugcaauggagcaccuugaaggcgagugauuccgcuauguauuuuugugcccgguuacugggugacucuggggcauucgauauuuggggacagggcacaaugguaaucgugagcuccgccucaacuaagggc

SEQ ID NO: 27135 - RNA, 372 nt, Artificial Sequence
  derived and/or modified sequence opt3 from anti-HIV_Chain
caggugcaacugguccagagcggcgggggacucguuaagcccgguggcucccuuagacugucuugcgccgcuucaggguucaccuuuaguagcuacuccaugaacugggugaggcaggcaccuggaaaaggcuuggaguggguaucuucgaucucaagcaguuccucuuauauuuacuaugccgacagcgugaagggucgguucacaauaucccgcgauaaugcgaaaaacucauuauaccugcagaugaauagucuacgagcugaagacacugccgucuauuacugugcacgugaggggagcuauuacuacggaauggauguguggggccaaggcacgaccguuacagugucuuccgccucaacuaagggg

SEQ ID NO: 27136 - RNA, 372 nt, Artificial Sequence
  derived and/or modified sequence opt3 from anti-HIV_Chain
gagaucgugcugacccagagccccgccacacucuccgucucuccuggcgaaagagcuacucuuucaugcagggcagggcaaaguguuagcuccgaccuggccugguaccagcacaagccaggacaggcgccgcgguuguuaauuuaugaugcuucuaaacgcgccacggguauacccgcacgauucucgggcucagggagcggaaccgacuuuacacugacuaucaguucccuagagccugaagauuucgccguguacuauugucagcaucguaccaacuggccacccucuauuacauuuggccaagguaccagacucgagaucaagaggacuguagcugcaccuagcguguucauuuuuccacccuccgac

SEQ ID NO: 27137 - RNA, 372 nt, Artificial Sequence
  derived and/or modified sequence opt3 from anti-HIV_Chain
gagaucgugcugacccagagccccggcacacucucccuuucuccuggggaaagagccacucugucaugcagggcuagucaaagcgucuccucucgguacuuggcaugguaucagcagaagccaggacaggccccgcgcuuaauuauauacgacgcgucgucacgagcuagcgguauccccgaucguuucaguggcuccgggucugagacggacuuuacccugacaauuacuagacuagaaccugaggauuucgccguuuauuacugucaacucuauggaaccagcccaaaauuuacauucggccaggguaccaagcuggaaaucaaaaggacuguggcagcccccuccguauuuauuuucccuccaucagac

SEQ ID NO: 27138 - RNA, 372 nt, Artificial Sequence
  derived and/or modified sequence opt3 from anti-HIV_Chain
gagaucgugcugacccagagccccggcacacucucccuuucuccuggggaaagagccacucugucaugcagggcuagucaaagcgucuccaacaauuacuuggcaugguaucagcagaagccaggacaggccccgcgguuacugauuuacggugcgucuucgcgcgcuacgggcauacccgaccgauucucagggagcggaaguggcaccgauuuuacacuaacuaucucccgucucgagccugaagacuucgccguuuauuacugucaacaguaugcaaccucuagccuguacacauuuggucaggggaccaaacuugagauuaagagaacuguggccgcuccauccguauucaucuuucccccuucagau

SEQ ID NO: 27139 - RNA, 372 nt, Artificial Sequence
  derived and/or modified sequence opt3 from anti-HIV_Chain
cccgccacccuggcugugagcccuggcgagagagcaacaaucuccugcaagucuucacagaaccuccuuuacagugccaauaaccaacacagccuggcgugguaucagcagaggccagggcagccgcccaaauuguuacuguacugggcuuccacucggcuaucuggagucccugaccgcuucucggguucaggcagcgggacggauuucacccucacaauuaguaaucugcaagccgaagacguugcaguguauuacugucagcaguauuacuccccacccccuacuuucggacagggcaccaagguagagauacgacguacaguggccgcuccaucugucuuuaucuuucccccuagcgaugaacaacuu

SEQ ID NO: 27140 - RNA, 372 nt, Artificial Sequence
  derived and/or modified sequence opt3 from anti-HIV_Chain
cagcccgugcugacccaaccuccaagcgccuccggcgcuccggggcagagagucacaaucucuugcucaggaggucccaguaacguuggcgggaauuacguguauugguacaggcaguucccuggaacugcaccaaaccuccuuauucugcgggacgaucagcgccccagcggcguaccugaccgauuuuccgccucuaagucggguaauucagcgagcuuggcuauaacgggguuacguccagaugacgaggccuucuauuuuugugcaaccuacgauagugacggauccaucagacuguucggcggcgggacagcccuaacugugcucucucaacccaaagcugcaccuagcgucacccuguuuccaccg

SEQ ID NO: 27141 - RNA, 372 nt, Artificial Sequence
  derived and/or modified sequence opt3 from anti-HIV_Chain
aacuucaugcugacccagcccccuagcgccuccggcgcuccagggcaaagagugacaaucucuugcucaggagguccgaguaaugucggcgggaacuacguuuauugguacaggcaguuucccggaacugcaccuaaucuccuuauucugcgggacgaucagcgcccaagcggcgugcccgaccgauucuccgccucuaagucggguaacucagcgagcuuggcuauaaguggguuacguccugaugacgaggccuuuuauuucugugcaacguacgauuccgacggaucuaucagacuguuuggcggcgggaccacacuaacuguacucagccagccaaaagccgcucccuccgugacccuguucccucca

SEQ ID NO: 27142 - RNA, 372 nt, Artificial Sequence
  derived and/or modified sequence opt3 from anti-HIV_Chain
gacauccagaugacccaaagcccucccucccugucugccucagugggcgauagagucacaauuacuugccaggcuagucaggacauaaacaauuuccucaacugguaccagcaaaagccagggaaagcaccgaggcuucugaucuaugaugccagcaauuuggaguccggaguuucuucgcgguuuucagguagccgcaguggcacggacuucaccuuaacaauuuccucucugcuacccgaagauaucgcgacuuacagcugucagcaguauuccaaccucccuuacaccuuuucacaggggacaaagcuggagauuaaacgaaccguggcugccccaaguguauucaucuuucccccuagcgacgaacaa

SEQ ID NO: 27143 - RNA, 372 nt, Artificial Sequence
  derived and/or modified sequence opt3 from anti-HIV_Chain
caggugcaacugguccagagcggcaccgccguuaagagacccggggcuuccgugaggguaucuugccaggcaucaggauacacauucaucgaccacuuuauuuauugguggcggcaggccccuggucaaggccucgaguggcuuggguggauaaacccacugacgagucagccgagcuaccccucccgcuuccagggacgauugacuuuaacccgugauacauuugacgaaaugcuguauauggaucuaagaggccucaggucugacgauacugguaucuacuucugugcgcggcgccauucggacuauugcgauuuugacauuugggggucaggaacccagaucauugugagcagugcuuccacaaaaggc

SEQ ID NO: 27144 - RNA, 372 nt, Artificial Sequence
  derived and/or modified sequence opt3 from anti-HIV_Chain
caggugcaacugguccagagcggcgccgcucucaagaaacccggggcaucccuuagaaucucuugccaggccuacggauauaaguucaccgaccaccugauuuacugguggaggcaggcgccuggucaaggcuuggaguggauaggguggaucaaaccagaaacaggacagccgucauauaguuacaaguuucagggccggguuagcuuaacucgcgauacguuccaggagauucuguuuauggaccuacgaggucuccguuccgaugacaccgcuaucuauuucugugccagaaggcauucugauuacugcgacuuugaugugugggggucgggaucacaaguaauugugagcagugcauccacaaaaggc

SEQ ID NO: 27145 - RNA, 372 nt, Artificial Sequence
  derived and/or modified sequence opt3 from anti-HIV_Chain
caggugcaacugguccagagcggcgccgcucucaagaaacccggggcaucccuuagaaucucuugccagaccuacggauauaaguucacagaccaccugauuuacugguggaggcaggccccuggucaaggcuuggaguggaugggguggauaaaaccagaaacuggacagccgucauauaguuaccgguuucagggccgcguuagcuuaacgcgagauaccuucgaggaaaucguguuuauggaccugcguggucuaagauccgaugacacagcgauuuauuucugugcuaggcggcauucugauuacugcgacuuugauguaugggggucgggaucacaggugaucgucagcagugccuccacuaagggc

SEQ ID NO: 27146 - RNA, 372 nt, Artificial Sequence
  derived and/or modified sequence opt3 from anti-HIV_Chain
caggugcaacugguccagagcggcgccgcucucaagaaacccggggcaucccuuagaaucucuugccagaccuacggauauaaguucacagaccaccugauuuacugguggaggcaggccccuggucaaggcuuggaguggauaggguggaucaaaccagaaacuggacagccgucauauaguuaccgguuucagggccgcguuagcuuaacgcgagauaccuucgaggaaauugcguuuauggaccugcguggucuaagauccgaugacacagcuaucuauuucugugccaggcggcauacugauuacugcguguuugacguaugggggucuggaucgcagauuaucgugucaagcgcaaguaccaagggc

SEQ ID NO: 27147 - RNA, 372 nt, Artificial Sequence
  derived and/or modified sequence opt3 from anti-HIV_Chain
caggugcaacugguccagagcggcaccgccguuaagagacccggggcuuccgugaggguaucuugccaggcaucaggauacacauucacugacuauuuuaucuacugguggcggcaggccccuggucaaggccucgaguggcuuggguggauuaacccacugacgagucagccgagcuaucccucccgcuuccagggacgauugaccuuaacacgugauacuuuugacgaaaugcuguacauggaucuaagaggccucaggucugacgauaccgguauauauuucugugcgcggcgccacucggacuacugcgauuuugacaucugggggucaggaacacagauuaucgugagcagugcuuccaccaaaggc

SEQ ID NO: 27148 - RNA, 372 nt, Artificial Sequence
  derived and/or modified sequence opt3 from anti-HIV_Chain
caggugcaacugguccagagcggcgccgcucucaagaaacccggggcauccguuagaaucucuugccaggccuacggauauaaguucaccgaccaccuuauuuacugguggaggcaggcgccuggucaaggccuggaguggauaggguggaucaaaccagaaacaggacagccgucauaugcuuacaaguuucagggccgggugacuuugacgcgcgauaccuucgaggaaauucauuuuauggacuuacgagguguacguaacgaugacacagccacuuauuucugugcaagaaggcacagugauuacugcgacuuugaugugugggggagcggaucccaggucaucgugucuucggccucaaccaaaggc

SEQ ID NO: 27149 - RNA, 372 nt, Artificial Sequence
  derived and/or modified sequence opt3 from anti-HIV_Chain
caggugcaacugguccagagcggcgccgcucucaagaaacccggggcauccguuagaaucucuugccagaccuacggauauaaguucacagaccaccuuauuuacugguggaggcaggccccuggucaaggccuggaguggauaggguggaucaaaccagaaacuggacagccgucauauaguuaccgguuucagggccgcgugagcuugacgcgagauaccuucgaggaaauuguauuuauggacuuacguggucugagauccgaugacacagcgaucuauuucugugcuaggcggcauucugauuacugcgacuuugaugugugggggucgggaucacagguccuagugagcagugccuccacuaagggc

SEQ ID NO: 27150 - RNA, 372 nt, Artificial Sequence
  derived and/or modified sequence opt3 from anti-HIV_Chain
caggugcaacugguccagagcggcgccgcucucaagaaacccggggcaucccuuagaaucucuugccagaccuacggauauaaguucacagaccaccugauuuacugguggaggcaggccccuggucaaggcuuggaguggauaggguggaucaaaccagaaacuggacagccgucauauaguuaccgguuucagggccgcguuagcuuaacgcgagauaccuucgaggaaauuguguuuauggaccugcguggucuaagauccgaugacacagcgaucuauuucugugcuaggcggcauucugauuacugcgacuuugauguaugggggucgggaucacaggugcucgucagcagugccuccacuaagggc

SEQ ID NO: 27151 - RNA, 372 nt, Artificial Sequence
  derived and/or modified sequence opt3 from anti-HIV_Chain
caggugcaacugguccagagcggcgccgcucucaagaaacccggggcauccguuagaaucucuugccagaccuacggauauaaguucacagaccaccuuauucauugguggaggcaggccccuggucaaggccuggaguggauaggguggaucaaaccagauacuggacagccgucauacaguagccgguuucagggccgcguguccuugacgcgagacaccuucgaagagauuguauuuauggauuuacguggucugagaucugacgauacagcgaucuauuucugugcuaggcggcacucggacuacugcgauuuugacgugugggggucaggaagccagguccuagugaguuccgccucuacuaagggc

SEQ ID NO: 27152 - RNA, 372 nt, Artificial Sequence
  derived and/or modified sequence opt3 from anti-HIV_Chain
caggugcaacugguccagagcggcgccgcucucaagaaacccggggcaucccuuagaaucucuugccagaccuacggauauaaguucacagaccaccugauuuacugguggaggcaggccccuggucaaggcuuggaguggauaggguggaucaaaccagaaacuggacagccgucauauaguuaccgguuucagggccgcguuagcuuaacgcgagauaccuucgaggaaauuguguuuauggaccugcguggucuaagauccgaugacacagcgaucuauuucugugcuaggcggcauucugauuacugcgacuuugauguaugggggucgggaucacaggugauugucagcagugccuccacuaagggc

SEQ ID NO: 27153 - RNA, 372 nt, Artificial Sequence
  derived and/or modified sequence opt3 from anti-HIV_Chain
caggugcaacugguccagagcggcgccgcucucaagaaacccggggcaucccuuagaaucucuugccagaccuacggauauaaguucacagaccaccugauuuacugguggaggcaggccccuggucaaggcuuggaguggauaggguggaucaaaccagaaacuggacagccgucauauaguuaccgguuucagggccgcguuagcuuaacgcgagauaccuucgaggaaauuguguuuauggaccugcguggucuaagauccgaugacacagcgaucuauuucugugcuaggcggcauucugauuacugcgacuuugauguauggggagggggcucacaggugauugucucgagcgccaguacuaagggc

SEQ ID NO: 27154 - RNA, 372 nt, Artificial Sequence
  derived and/or modified sequence opt3 from anti-HIV_Chain
caggugcaacugguccagagcggcgccgcucucaagaaacccggggcaucccuuagaaucucuugccugaccuacggauauaaguucacagaccacuugauuuacugguggaggcaggccccuggucagggcuuagaguggauaggguggaucaaaccagaaacuggacaaccgucauauaguuaccgguuucagggccgcguuagccugacgcgagauaccuucgaggaaauuguguuuauggaccuacguggucucagauccgaugacacagcgaucuauuucugugcuaggcggcauucugauuacugcgacuuugauguaugggggucgggaucacaggugauugucagcagugccuccacuaagggc

SEQ ID NO: 27155 - RNA, 372 nt, Artificial Sequence
  derived and/or modified sequence opt3 from anti-HIV_Chain
caggugcaacugguccagagcggcgccacccucaagaaacccggggcuuccguuagaaucucuugccaggcauacggauauaaguucacagaccaccuuauucauugguggaggcaggccccuggucaaggccuggaguggauaggguggaucaaaccagaaacuggacagccgucauacgcguauaaguuucagggccgggugaguuugacgcgcgauaccuucgaggaaauuuuauuuauggaccugcgaggucuacguagcgaugacacagcuaucuacuucugugccagaaggcacuccgauuauugcgaccucgauguauggggagggggcacucagcugcuugugucuucggcaucaaccaaaggc

SEQ ID NO: 27156 - RNA, 372 nt, Artificial Sequence
  derived and/or modified sequence opt3 from anti-HIV_Chain
caggugcaacugguccagagcggcgccgcucucaagaaacccggggcauccguuagaaucucuugccaggccuacggauauaaguucaccgaccaccuuauuuacugguggaggcaggcgccuggucaaggccuggaguggauaggguggaucaaaccagaaacaggacagccgucauauaguuacaaguuucagggccgggugacuuugacgcgcgauaccuucgaggaaauucauuuuauggacuuacgaggucugcguuaugaugacacagcuacuuacuucugugccagaaggcacagcgauuauugcgacuuugauguauggggguccggaucucaggugucggucucaagcgcaaguaccaaaggc

SEQ ID NO: 27157 - RNA, 372 nt, Artificial Sequence
  derived and/or modified sequence opt3 from anti-HIV_Chain
caggugcaacugguccagagcggcgccgcucucaagaaacccggggcaucccuuagaaucucuugccaggccuacggauauaaguucaccgaccaccugauuuacugguggaggcaggcgccuggucaaggcuuggaguggauaggguggaucaaaccagaaacaggacagccgucauauaguuacaaguuucagggccggguuagcuuaacucgcgauacguuccaggagauucuguuuaugaaccuacgaggucuccguuccgacgauaccgcuaucuauuucugugccagaaggcauucugacuacugcgauuuugacgugugggggucgggaucacaaauucugguaagcagugcauccacaaaaggc

SEQ ID NO: 27158 - RNA, 372 nt, Artificial Sequence
  derived and/or modified sequence opt3 from anti-HIV_Chain
caggugcaacugguccagagcggcaccgccguuaagaaacccggggcuuccgugagaguaucuugccaggcaucaggauacacauucacugacuauuuuaucuacugguggaggcaggccccuggucaaggccucgaguggcuuggguggauuaacccacggacgagucagccgagcuaucccuaccgcuuccagggacgagugacccugacacgugauauauuugaagagauguuguauauggacuuaagaggccugagguccgaugacacugguaucuacuucugugcgcggcgccacucugauuauugcgacuuugauauuugggggucgggaacccagaucauugucucaagcgcuaguacaaagggc

SEQ ID NO: 27159 - RNA, 372 nt, Artificial Sequence
  derived and/or modified sequence opt3 from anti-HIV_Chain
caggugcaacugguccagagcggcgccgcucucaagaaacccggggcaucccuuagaaucucuugccaggccuacggauauaaguucaccgacuaccugauucacugguggaggcaggcgccuggucaaggcuuggaguggauaggguggaucaaaccagaaacaggacagccgucauauaguuacaaguuucagggccggguuagcuuaacucgcgauacguucgaggaaauucuguuuauggaccuacgaggucuccguuccgaugacaccgcuaucuauuucugugccagaaggcauucugauuacugcgacuuugauguguggggagggggcucgcagguacuggugucaagcgcaaguacaaaaggc

SEQ ID NO: 27160 - RNA, 372 nt, Artificial Sequence
  derived and/or modified sequence opt3 from anti-HIV_Chain
gaggugcagcugcucgaaagcggcggggcccuuguccaacccggagguucccugagauugucuugcgcugcaucaggcuucaccuuuaguacaagcuccaugucuuggguuaggcaggccccugggaagggauuagagugggugucggcgaucggcucaggucgggggagcacuuucuacgcugacaguguaaaaggacgcuuuacgauuucccgagauaacucuaagaauacccugagccuacagaugaacucccucacagccgaagacacugcaaccuauuacuguacaaaaaccggcggccugcuucguuucccagaggugugggggaagggaacuacagucaccgugucaagugccagcacgaaaggu

SEQ ID NO: 27161 - RNA, 372 nt, Artificial Sequence
  derived and/or modified sequence opt3 from anti-HIV_Chain
gaggugcagcuggucgaaagcggcgggggacucguuaagcccgguggcucccuuagacugucuugcgccgacucaggguucaccuuuaggaguuacagcaugcacugggugcggcaagcuccuggaaaaggcuuggcauggguauccucuaucucgucaacaagcaacuauauuuacuaugccgauagugugaagggucgcuucacuauaucccgagacaaugcgaaaaacucuuuauaccugcagaugaauagccuacgugcugaggauacggccgucuauuacugugcaagaaccuuuaucacagccuccugguucgacucaugggggcagggaacucucgugaccguuaguagcgcuucuacaaagggc

SEQ ID NO: 27162 - RNA, 372 nt, Artificial Sequence
  derived and/or modified sequence opt3 from anti-HIV_Chain
caggugcaacugguccagagcggcgccgagguuaagaaacccggggcuuccgugaagguaucuugcaaagcaucaggauacaccuucacaaacuauggugugaguugggucagacaggccccuggccaggggcucgaauggaugggauggaucagcccauacuccggcaauacuaacuaugcgcaaaggcuucaggaccgggugacgaugaccacagauacuucuaccaauacagcuuacauggagcugcgcucguugcgaucagacgauaccgccguuuauuacugugcagcccguagcuauuacuacuauaguauggacguguggggucaggggacuacagucaccguguccucugcuagcacgaaggga

SEQ ID NO: 27163 - RNA, 372 nt, Artificial Sequence
  derived and/or modified sequence opt3 from anti-HIV_Chain
caggugcaacugguccagagcggcgccgagcucaagaaacccggguccucuguuaaggugucaugcaaagcuaguggagguaccuucagcaacuacgcaaucaauuggguaagacaggccccuggccagggguuugaauggaugggaggcauuauaccacuuuucgcgacaccgacuuaugcucaaaaguuucaggguagggugcggaucacggccgacgauuccaccucuacagcauacauggagcugucgucauugcgcagcgacgauacugccgucuauuucugugcucgacccaacgugguucguagugcauuagacuacugggggcagggaacccuggugacagucuccucugccagcaccaaaggc

SEQ ID NO: 27164 - RNA, 372 nt, Artificial Sequence
  derived and/or modified sequence opt3 from anti-HIV_Chain
caggugcaacuggucgagagcggcgggggaguugugcagcccgguaagucccucagacuuucuugcgccgcuucaggcuucaccuuuaguacacacgcaaugcauuggguaaggcaggccccugggaaaggacuggacuggguggcggucaucagccacgauggcgacaaccaguacuaugcugaugccgugaagggucgguucacuauuucccgcgacgauucucgagacacgguguuuuugcaaaugaacucguuacguaccgaagauacagggguuuacuauugugcagccgacucaagcggaaguaauugguucgauuacuggggccagggcauacuggucacuguguccucugcuagcaccaaaggg

SEQ ID NO: 27165 - RNA, 375 nt, Artificial Sequence
  derived and/or modified sequence opt3 from anti-HIV_Chain
caggugagacugagccaauccggcgggcagaugaagaaacccggagagucuaugaggcucucaugccgggccagugguuacgaguuccuuaacuguccuaucaauuggauucgccuggcuccaggccgacguccggaauggauggggugguugaagcccagaggaggcgcagucaacuaugccaggaaauuucagggucggguuaccaugacacgcgacguguacagcgauacugcguucuuagaacugagaucccuaacgucugacgauaccgcuguauauuuuugcacaagggggaaguacuguacugcccgggacuauuacaauugggauuucgagcacuggggacgcggcgcaccugugaccgucucguca

SEQ ID NO: 27166 - RNA, 375 nt, Artificial Sequence
  derived and/or modified sequence opt3 from anti-HIV_Chain
gaggugcagcugguccaaagcggcuccgacguuagaaagcccggggccaccgugacaguaucuugcaaagcugaugaagacgaggaugacuucacugcauacaacuauuuuaugcacugggugaggcaggccccuggacauggucucgaauggaucggcuggauuaauccacggacggggcagccgaaccacgcgaagcaguuccaaggacgcgucacccuuacacgagagcguucaaccaguacuguguuuaugaaacugacaaauuugagauuagaugacaccgcuguuuacuucugugccaggccccugcggggcggugauacuuggcauuaucacagcugggggcgcggaacaucccuaaccgugucuucg

SEQ ID NO: 27167 - RNA, 375 nt, Artificial Sequence
  derived and/or modified sequence opt3 from anti-HIV_Chain
caggugcaacugguccagagcggcgggggacucguucagcccggugagucccuuagacugucuugcaccgccucaggcuucacauuuaguagcuacaacaugaauugggugaggcaggcuccugggaagggauuggaauggaucuccuauauuucugacaaaucgaagaacaaauacuaugcagauucaguacggggccgcuucacuauaagccgagacaaugcccaaaacaguuuauuucugcagauguccucucuacgugaugaggacacggcgguguacuauuguaccagagaagguccacagaggagcuucuacuuugauuauugggggcagggaauccaagucacaguguccucagcuaguacuaagggc

SEQ ID NO: 27168 - RNA, 375 nt, Artificial Sequence
  derived and/or modified sequence opt3 from anti-HIV_Chain
gaggugcagcuggucgaaagcggcgccgagguuaagaaacccggguccucugugaagguaucaugcaaagcuaguggagguaccuucagcuccuacucuaucucgugggugagacaagcaccuggccaggggcucgaauggaugggaggcauuauaccaaucuuugccacaacucacuauggucagaaguuccaggggaggauuaaaaucacggcggacaagucaaccagcacagcuuacauggagcuuagucggcugcgcuccgaagauacugccgucuauuacugugcacgagaccgugaguuuuauuucuacggaauggauguguggggccaaggcaccacaguuaccgugucuagcgccuccacuaagggg

SEQ ID NO: 27169 - RNA, 375 nt, Artificial Sequence
  derived and/or modified sequence opt3 from anti-HIV_Chain
cagcugcaacuccaggagagcggccccgggcuugugaagccuugggaaacccuggucuugacaugcuccguuucuggagguucaaucaguagcggcgacuacuauuggggguggauuagacaguccccaggaaaaggcccggaguggauagguaacaucuucuacucuucggggaauacuuauuacaacacgucauuaaagagcagggugaccauuaguguagauguguccaaaaaucgguuuucucugaagcuaacaagcaugacugccgcugacaccgcagucuauuacuguggacgccucuccaacaaaggcugguucgaucccuggggccaggggacacuggugucaguuaguagcgccucuaccaaggga

SEQ ID NO: 27170 - RNA, 375 nt, Artificial Sequence
  derived and/or modified sequence opt3 from anti-HIV_Chain
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugauaccgacuuuacacuaacuaucuccucucucgagccugaagauuucgccguuuauuacugucaacagcgugggauuuggccacugcagaucaccuuuggacagggcacaagacuugagauuaaaaggaccguggcugcacccagcguauucaucuuuccuccauccgacgaa

SEQ ID NO: 27171 - RNA, 375 nt, Artificial Sequence
  derived and/or modified sequence opt3 from anti-HIV_Chain
agcgagaucgugcugacccagucccccggcacacucucucuuucaccuggggaaagagccacucugaguugcagggcuagccaauccgucucuucgucauacuuggcaugguaucagcagaagccaguucaggccccgcgguuacugauuuacggagcgagcagucgcgcuacggguauacccgaccgauucuccggcucugggagcggaaccgauuuuacacuaacuaucucccgucucgagccugaagacuucgccguguauuacugucaacaguauggcacccugcacccaagaacauuuggucaggggaccaaaguagagauuaagaggacuguggcagcccccucagucuucaucuuuccuccaagugau

SEQ ID NO: 27172 - RNA, 375 nt, Artificial Sequence
  derived and/or modified sequence opt3 from anti-HIV_Chain
agccaggccguggucacccaacccccuuccguuucuggcgcuccagggcagagagugacaaucucaugcaguggagguccgagcaacguaggcgggaaucugguguacugguauaagcaguuccccggaacugcaccuaaacuccuuauuaggcgggacgaucagcgcccauccggcguccccgaccgauuuucugguucgaagucagggaacagcgccagucuggcgauauccggauugcguccugaugacgaggcuuucuacuuuugugccacguaugauucucacggcagcaucagauuauucggcgggggaacccugcuaacagugcucucccaaccaaaagcagcccccucaguuacucuguuuccucca

SEQ ID NO: 27173 - RNA, 375 nt, Artificial Sequence
  derived and/or modified sequence opt3 from anti-HIV_Chain
gacauccagaugacccaaagccccuccacacuggccgcuucuauuggcgggacugugagagucucaugcagggcaagucagagcauaacgggaaacuggguugccugguaccagcagcggccugguaaggcgccacgccuccuuaucuaucgaggcgcugcccuguuagggggagugccgucccguuucucuggcucggcagccgguaccgauuuuacauugacuauugggaaucugcaagcugaggacuucggaaccuuuuacugucagcaguaugauacauaccccggcaccuucggccaggggacuaaaguagaagugaagagaacagucgcagccccuucaguguuuaucuucccacccagcgacgagcaa

SEQ ID NO: 27174 - RNA, 375 nt, Artificial Sequence
  derived and/or modified sequence opt3 from anti-HIV_Chain
gagaucgugaugacccagagccccgacacacuguccgucucuccuggcgaaagagccacucucucaugcagggcuagucaaagcguuaacuccaaucuugcaugguaccagcagaagccagggcaggccccgcggcuguugauuuauggagcgucuacgcgcgcuaccgccgugcccgcacgauucucggguucaggcagcgggacagaguuuacuuuaaccauaaguucccugcaaucugaagauagcgccguauacuauugucagcaguacuaucaguggcuauccuacacauucggacaaggcaccaaacucgagaucaagcguacuguggcugcaccuucagucuuuauuuucccacccagugacgaacag

SEQ ID NO: 27175 - RNA, 375 nt, Artificial Sequence
  derived and/or modified sequence opt3 from anti-HIV_Chain
agacaggugcaacugguccagagcggcgccgcucucaagaaacccggggcaucccuuaggaucucuugccaggccuacggauauaaguucaccgaccaccugauuuacugguggcggcaggcgccuggucaaggcuuggaguggauaggguggaucaaaccagaaacaggacagccgucauauaguuacaaguuucagggccgcguuagcuuaacucgagauacguuccaggagauucuguuuauggaccuacguggucucagauccgaugacaccgcuaucuauuucugugccaggcggcauucugauuacugcgacuuugaugugugggggucgggaucacaaauucugguaagcagugcauccacaaaaggc

SEQ ID NO: 27176 - RNA, 375 nt, Artificial Sequence
  derived and/or modified sequence opt3 from anti-HIV_Chain
caggugcaacugguccagagcggcgccgcucucaagaaacccggggcauccguuagaaucucuugccaggccuacggauauaaguucaccgacuaccuuauucacugguggaggcaggcgccuggucaaggccuggaguggauaggguggaucaaaccagaaacaggacagccgucauauaguuacaaguuucagggccgggugacuuugacgcgcgauaccuucgaggaaauuuuauuuauggaccugcgaggucuacguagcgaugacacagcuaucuauuucugugccagaaggcauuccgauuacugcgacuuugauguaugggggucuggaucacaggugauugucucgagcgcaaguacuaaaggcgcc

SEQ ID NO: 27177 - RNA, 375 nt, Artificial Sequence
  derived and/or modified sequence opt3 from anti-HIV_Chain
gaggugcagcuggucgaaagcggcgggggacucguuaagcccgguggcucccuuagacugucuugcgccgcuucaggguucaguuuuagcgagcacuacauguccuggaucagguuggcaccuggaaaaggcuuagaauggcugucuuauauuucgucaagcacccggacaacuuacagugccgacuccgugcgcggucgauucacgauaucucgugauaccgcgaagcaacuacucuuucugcauaugagcucccuuagagcugaggacacagccguauauuacugugugaggcuguaugggggaaucaacggcugguucgaucaguggggccaggggacuuuggucucagugaguagcgcaucuaccaaagga

SEQ ID NO: 27178 - RNA, 375 nt, Artificial Sequence
  derived and/or modified sequence opt3 from anti-HIV_Chain
caggugcaacugguccagagcggccccgggcucguuaagccuuccgagacccuuucucugacaugcucagugaguaacggaagcaucuccucugguggcuacuauuggucgugguugagacaguucccagggaaaggauuagaauggauuggcucaauacacuacacugguaggacguuuuauaauccgagccugauggggcggaccgcccuaaguauggacacauccaacaaucaguucucucucaagguaagcuccgugacugcugcagauaccgcccuguacuauugugcgcgcgagcuucaauggauguuugucguggaccccuggggacagggcacacugguuaccgugucaagugcuagcacuaaaggc

SEQ ID NO: 27179 - RNA, 375 nt, Artificial Sequence
  derived and/or modified sequence opt3 from anti-HIV_Chain
caggugcaacugcaggagagcggccccgggcucgucaagccuuccgaaacccuuucucugacaugcucaguuaguaacggaagcaucuccucugguggcuacuauuggucgugguugagacaguucccagggaaaggauuagaguggauuggcucaauacacuacacugguaggacgauguauaauccgagccugauggggcggcccgcccuaaguauggacaccuccaacaaucaguuuucucucaagcugcgcagcgugacagcugcagauacugcccuuuacuucugugcgcgagaccugcaauggaucuuuguaguggauccuuggggacagggcaccuuggucacaguguccucagcuaguaccaaaggc

SEQ ID NO: 27180 - RNA, 375 nt, Artificial Sequence
  derived and/or modified sequence opt3 from anti-HIV_Chain
gaggugcagcugcucgaaagcggcgggggacuuguccaacccgguggcucccugagauugucuugcgccguuucaggguucaccuuuggaggccacgcugugaguuggguaaggcaggcaccugguaagggguuagaguggcugagccagaucuccggaacaggcucucggacugacuacgccgaugcggugaaaggccgcuucacggucucgcgagacaacucaaagaaaaccguguaucuacagaugaauagccuccguguugaagauacagcucuguuuuacugugccacuagaaguccagggggagguuaugcauucgacauuuggggccaaggggccauggugaccgucuccucugcuagcacaaaggga

SEQ ID NO: 27181 - RNA, 375 nt, Artificial Sequence
  derived and/or modified sequence opt3 from anti-HIV_Chain
caggugcaacugguccagagcggcgccgagguuaagaaacccggguccucugugaagguaucaugcaaagugaguuucuuuagcaacuacggaaucuccugggucagacagaggccuggucagggccucgaauggauggggcggauuauaccagcuaucgacgauaugaccuaugcacaaacauuccgcggacgagugacuuuuucugccgacaaguucacgaccacagcguacauggagcuuacuggccugaccuuugaagauacagcuaccuauuucugugcccgugacccgcagguuaauagaagggguaacugcuuugaucacugggggcagggaacuuuggugacagucucgucagcaagcaccaaaggc

SEQ ID NO: 27182 - RNA, 375 nt, Artificial Sequence
  derived and/or modified sequence opt3 from anti-HIV_Chain
caggugcaacugcaggagagcggccccgggcucgucaagccuuccgaaacccuuucucugacaugcacuguuucaggagguaguaucagcuacuauuacugguccuggauuagacagccaccgggcaaaggguuggaguggauaggagacaucuauuacucuggcacgaccgauuauaaccccucguuaaagucaagggugacaauuagcguagacaccaguaaaaaucaguucucccugaagcuaucuagcgugacugccgcugauacagcagucuacuauugugcccggcgccgaggucaacgucuccuggcguacuuugacuacugggggcagggaucccuugugaccguuucaagugcuagcacuaaaggc

SEQ ID NO: 27183 - RNA, 375 nt, Artificial Sequence
  derived and/or modified sequence opt3 from anti-HIV_Chain
caggugcaacugcaggagagcggccccgggccugucaagccauccgaaacccucucucuuacaugcacuguuucaggagguaguaugaucagcuacuauugguccuggauuagacagccgcccggcaaagggcuggaguggauaggauacaucuucacgaacggcaggaccacauauucuccuucguugcggucacgcgugacuauuagcuuagacaccaguacaaaucacuuuucccugcgacuaaagucuguaaccgccgcugauacugcaaucuacuauugugcccgucucgacggugaagcguucagauacuaucuggaucuuugggggcagggaaaccuggugacagucagcuccgcuucaaccaaaggc

SEQ ID NO: 27184 - RNA, 375 nt, Artificial Sequence
  derived and/or modified sequence opt3 from anti-HIV_Chain
caggugcaacugguccagagcggcgccgagguuaagaaacccggggcuuccgugaagguaucuugcaaaccuucaaguaacaccuucacaagccacuacauccauugggugagacaggcaccaggacagggucucgaauggaugggcaugauuaaucccgggggauccacuagguaugccccgaaguuucaaggccgggucacgcuuacccgcgacacaucuacucgaaccguguacauggagcugucgucauugcguagcgaagauacagcgguuuauuacugugcuagaccucaguauaacuuagguagggacccacuggaugugugggggcuaggaaccauggucacugugaguuccgccucuacaaaaggc

SEQ ID NO: 27185 - RNA, 375 nt, Artificial Sequence
  derived and/or modified sequence opt3 from anti-HIV_Chain
caggugcaacugcagcaguggggcgccgggcuccuuaagcccagcgagacccuguccuugacaugcgcugucuacggagguucuuucucaggcuauuacuggaguuggaucagacagccuccagggaaaggauuagaauggauuggcgagauaaaccacagcgguuccacuaauuauaacccgucucugaagucgaggguuacgaucucaguggacaccagcaaaaaucaauuuagucuaaagcucuccucuguaacagcagccgauacugcgguguacuauugugcucggcugcccauugggagcggaugguacggccgcgacuauuggggccaggggacccuugucacaguguccucagccaguaccaaagga

SEQ ID NO: 27186 - RNA, 375 nt, Artificial Sequence
  derived and/or modified sequence opt3 from anti-HIV_Chain
caggugcaacugguccagagcggcgccgagguuaagaaacccggggcuuccgugaagguaucuugcaaagcaucaggaaacaccuucacaaguuacgguaucacuugggugagacaggccccuggccaggggcucgaauggaugggauggauuagcgcguauaauggcaacacgaauuacgcucaaaaacuucaggacaggcugaccaugacaacugauaccuccacaucuaccgccuauauggaguugcggucguuacgcucagacgauacugcagucuacuauugugccuuuagccgacacuacgguagugggaacuaugacuacuggggacagggcacacuggugaccguuuccucugcuagcacgaagggc

SEQ ID NO: 27187 - RNA, 375 nt, Artificial Sequence
  derived and/or modified sequence opt3 from anti-HIV_Chain
caguucagacuggugcaaagcggccccgaggucaagaacccuggguccucuguuaccgugucaugcaaagccaguggagguacauuuagcggccucgggaucaauuggguaaggcaggcuccaggacagggccuugaauggcugggugacauuaagacuauguacgggacgaccaacuaugcaccgaaauuccagggacgggugacaauaacugccgaugaguccaccucuacaucguacauggaauugucaggcuuacgcagcgaggacaccgcggucuuuuauugugugcgagaacuguucggccaccaucccgcuuuugggguuuggggacaagguacaagugugaucgucuccucugccagcacuaagggc

SEQ ID NO: 27188 - RNA, 375 nt, Artificial Sequence
  derived and/or modified sequence opt3 from anti-HIV_Chain
agagugcagcugguccaaagcggcgccgagguuaagaaacccggguccucugugaccguaucaugcaaggcuaguggagguagcuucuccucuuacgcaaucucgugggugaggcaggccccuggccaggggcucgaaugggucggaggcgugaaaguuauguuugguacagugcacuauucacagaagguccaagggcgggugacuauuacggcggacgauagcaccggaacaaguuaccuugagcuguccggcuugcgcucugcugacacugccguauauuacugugcacgaaacgccggcgcuuauuucuacccauuugauauaugggggcagggaaccuuaaucauuguuagcuccgcaucaacaaaaggu

SEQ ID NO: 27189 - RNA, 375 nt, Artificial Sequence
  derived and/or modified sequence opt3 from anti-HIV_Chain
caggugcaacugcaggagagcggccccgggcucgucaagccuuccgaaacccuuucucugacaugcacuguuucaggagguaguaucagcuccagaucuuacuauuggggcuggauuaggcagccaccggggaaaggauuggagugggugggcucgauauacuauacggguucaaccuacuauagccccaguuuaaagucccggguaacaaucucuguggacacuagccagaaccaauucucccugaaacuaaauucagucaccgccgcugauacagcaguguacuauugugcccgccagaaggggaguggaaccagccuccuguacuggggccagggcacucuuguuacagugucuuccgcgucaaccaaaggg

SEQ ID NO: 27190 - RNA, 375 nt, Artificial Sequence
  derived and/or modified sequence opt3 from anti-HIV_Chain
caggugcaacugguccagagcggcaccgagguuaagaaacccggguccucugugaagguaucaugcaaagccaguggagguacauucagcgacuccgauaucgcuugggugagacaggcaccuggccaggggcucgaauggaugggaggcauuacuccaauguuugacauggccaagucugcgcaaaaauucaggggucggcuuauaaucacggcugauaagucgaccgggacagccuacauggagcugagcucauugcgcuaugaagacgcagccgucuacuuuugugcucgaaguuccggaaacuucgaguuugcauucgaaauuuggggccagggcacuaagaucauugugucuuuagccagcaccaaaggg

SEQ ID NO: 27191 - RNA, 375 nt, Artificial Sequence
  derived and/or modified sequence opt3 from anti-HIV_Chain
gugguccagcugguucaaagcggcaccgaggugaagaaacccggguccucuguaaaggugucaugcaaagccaguggagguacauucagcggcuccgacaucucuugggucagacaggcuccugggcagggacucgaauggaugggcgguauuauaccaauguuugauaucgaggaccacgcacagaaguucagggggcggcuuacuauuacggccgauaaaucgaccggagcggcuuacauggaacugagcucauugcgcagugaggacgccgcaguguauuacugugcccgauccucuggcaacuaugauuuugcuuucgacaucuggggccaagggacacguuuaauuguuagcuccgcaucaacuaaggga

SEQ ID NO: 27192 - RNA, 375 nt, Artificial Sequence
  derived and/or modified sequence opt3 from anti-HIV_Chain
gugguccagcugguugagagcggcaccgaagugaagaaacccggguccucuguaaaggugucaugcaaagccaguggagguacauucagcggcuccgacaucucuugggucagacaagcuccugggcagggacucgaguggaugggcgguauuauaccaauguuugauaucgaaaaccacgcagagaaguucagggggcggcuuacuauuacggccgugaaaucgaccggagcggcuuacauggaacugagcucauugcgcagugaggacgccgcaguuuauuacugugcccgauccucuggcaauuaugauuuugcuuacgacaucuggggccaggggacacgugugauugucagcuccgcaucaacuaaggga

SEQ ID NO: 27193 - RNA, 378 nt, Artificial Sequence
  derived and/or modified sequence opt3 from anti-HIV_Chain
caggugcaacugguccagagcggcuccgccaugaagaaacccggggcuucuguuagagugucaugcuggaccagugaggacaucuucgauacaacugaacucauucacuggguaaggcaggcaccuggacagggucuugaguggauaggcugggugaaggccgucagcggggcggugaacuacggaucccuggacuuucggcaucgcguuucuuugacgcgagaucgugacuuaucgaccgcucacauggauaucagaggccugacacaagacgauacugccaccuauuucugugcaaggcagaaauuugcccggggugaccaggggugguucuuugaucuauggggacgcggcacacucauuguggucucaagcgcu

SEQ ID NO: 27194 - RNA, 378 nt, Artificial Sequence
  derived and/or modified sequence opt3 from anti-HIV_Chain
caggugcaacugcaggagagcggccccgggcucgucaagccuuccgaaacccuuucucugacaugcacuguuucaggagguaguaucagcaaccacuacugguccuggauuagacagccaccgggcaaaggguuggaguggauaggauauaucuaccauucuggcaauauuaacuauaagucgucauuaaaaagcagggccacgaucaguauugacaccuccaauaaccaguucucucugaagcuaagcuccgugaucgcugcagauacagccguauacuauugugcgcggaauuuuggucccgggucaccuaacuacggaauggacguguggggccaaggcacuaccgucacagugaguagcgcuucuaccaaaggg

SEQ ID NO: 27195 - RNA, 378 nt, Artificial Sequence
  derived and/or modified sequence opt3 from anti-HIV_Chain
caggugcaacugguccagagcggcgggggaguugugcagcccgguagaucccucaggcuuucuugcgccgcuucaggcuucaccuuuagucaccaugggauccacuggguacggcaggcaccuggagagggccuggaauggguggccgucauuagcgaggacgguacaaauauacauuacgaagauuccgugcgcgggcgauucacuaucucucgugacaauucgaagaacacgguugauuugcaaaugaacucauuaagagcggaggacaccgcuguguauuacugugccagccugauuaguaugagggauggagacgcauuugaucuauggggccagggcacacgggucacuguguccucugccagcaccaaaggg

SEQ ID NO: 27196 - RNA, 378 nt, Artificial Sequence
  derived and/or modified sequence opt3 from anti-HIV_Chain
caggugcaacuggucgagagcggcgggggacucggucagcccggcgggucccuuagacugucuugcgccgcuucaggauucaccuuuaggaacuacgcaaugaguuggguucggcaggccgcgggcaaggguuuggaaugggugagcgggguauccggaggcggcgacacaacuuauuacggggauucugugaaaggacgcuucacgaucucgcgagacaauucaaagaacaccuuauaucugcagaugaauaaccuacgugcugaggauacagccgucuacuauugugcaaaagacaaggguguguggggcagcagugauuuugacuacugggggcaaggaacucucguuaccguguccucugccagcacaaaaggc

SEQ ID NO: 27197 - RNA, 378 nt, Artificial Sequence
  derived and/or modified sequence opt3 from anti-HIV_Chain
gaggugcagcuggucgaaagcggcgggggaguugugcaacccgguagaucccucaggcuuucuugcgccgcuucaggcuucaccuuuagucaccaugggauccacuggguacggcaggcaccuggagagggccuggaauggguggccgucauuagcgaggacgguacaaauauacauuacgaagauuccgugcgcgggcgauucacuaucucucgugacaauucgaagaacacgguugauuugcagaugaacucauuaagagcggaggacaccgcuguguauuacugugccagccugauuaguaugagggauggagacgcauuugaucuauggggccagggcacacgggucacuguguccucugccagcaccaaaggg

SEQ ID NO: 27198 - RNA, 378 nt, Artificial Sequence
  derived and/or modified sequence opt3 from anti-HIV_Chain
agaggccccgugacccuggccgucagccucggggagagggcuacaaucacuugcaaguccucucagucaguucuugugcacaguaacaauaaaaacuaccugagcugguaucaacagaagccuggacagccaccgaaauuguuaauuuacugggcauccacgcgggaaucugguguacccgagcgcuucucgggcucagggagcggaaccgacuuuacacugaguauauccucucuacaggccgaagauguggcggucuauuacugucaucaauauuucagcacuccucgaaccuuuggccaggguacaaagguggagaucaaagggaccguugcugccccauccguguucauuuuucccccuucagacgaacagcuc

SEQ ID NO: 27199 - RNA, 378 nt, Artificial Sequence
  derived and/or modified sequence opt3 from anti-HIV_Chain
agcgagaucgugaugacccagucccccgccacacugucuaugucaccuggcgaaagagcuacucucaguugcagggcaagccuuuccgucaacacgaaucuggccugguaccaacagaagccagggcaggcgccgcgguuguuaauuuauggagcuucuacccgcgccacagguauacccgcacgauucucgggcucagggagcggaacugaguuuacccugacaaucaguucccuacagucugaagacuucgcccucuacuauugucaacaguacaaccacuggccucagaccuuuggccaggguacuaaaguugagauuaagcguacaguggcugcaccaagcguauucaucuuucccccuuccgaugaacaaaaa

SEQ ID NO: 27200 - RNA, 378 nt, Artificial Sequence
  derived and/or modified sequence opt3 from anti-HIV_Chain
agcgagaucgugcugacccagucccccgccacacucucucuuucaccuggcgaaagagcuacucugaguugcagggcaagccaauccauuaacaauuacuuggccugguaucagcagaagccagggcaggcgccgcgguuacugauauacgacgcuucuaaccgcgccacgggaauccccgcacgauucucggguggcgggucaggaaccgauuuuacacuaacuauuagcagucucgagccugaagacuucgccgucuauuacugucaacagcgugcuaauuggagacugcuuaccuuuggcggugggacaaaaguugagaucaagaggaccguggcagccccauccguauucauuuuucccccuucugaugaacag

SEQ ID NO: 27201 - RNA, 378 nt, Artificial Sequence
  derived and/or modified sequence opt3 from anti-HIV_Chain
caggugcaacugguccagagcggcggggccguuaagaaacccggagcuuccgugaagguaucuugcgagaccuacgguuauacauucacugaccacuuuaugcauugguggagacaggcaccuggccaggggcucgaauggaugggauggaucaacccauacucaagugccgugagcuauuccccgagguaccaaggccgggucacgaugacccgcgauacauuccuugagacuguguauauggaacugcgagguuugaaauuugacgauaccgcgauuuacuauugugcuacacccaagucugggcgugacuacuggucguucgauuuauggggacagggcacccugguuacugugucaagcgccaguacaaaaggc

SEQ ID NO: 27202 - RNA, 378 nt, Artificial Sequence
  derived and/or modified sequence opt3 from anti-HIV_Chain
agccaggugcaacuggucgaguccggccccgggcucguuaagccuucugaaacccuuucacugacaugcagugugagcaacggauccaucucuucggguggcuacuauuggucaugguugagacaguucccagggaaaggauuagaguggauuggcagcauacacuacacugguaggacgauguauaauccgagucugauggggcggcccgcccuauccauggacaccucuaacaaucaguuuagccucaagcuguccucaguaacagcugcagauacugcccuuuacuucugugcgcgcgaccugcaguggaucuuuguggucgauccuuggggacaaggcaccuuggugacaguuaguagcgcuucuaccaaaggc

SEQ ID NO: 27203 - RNA, 378 nt, Artificial Sequence
  derived and/or modified sequence opt3 from anti-HIV_Chain
agcgugguccagcugguugaguccggccccgggcucgugaagccuucugaaacccuuucacugacaugcaguguaagcaacggauccaucucuucggguggcuacuauuggucaugguugagacaauucccagggaaaggauuagaguggauuggcagcauacacuacacugguaggacgauguauaauccgagucugauggggcggcccgcccuauccauggacaccucuaacaaucaguuuagccucaagcugcgcuccgugacagcugcagauacugcccuuuacuucugugcgcgagaccugcaguggaucuuugucguggauccuuggggacagggcaccuugguuacagugucaagugcuagcaccaaaggc

SEQ ID NO: 27204 - RNA, 378 nt, Artificial Sequence
  derived and/or modified sequence opt3 from anti-HIV_Chain
agcggcgggagacuggugcagcccggagguucccucaggcuuucuugcucagccaguggcuucacccugagcaacuccgcuaugucuuggguccggcaagcaccugggaagggauuggaguggguuucgucaaucuuaagcaguggcguggguacauuuuacgccgacuccguaaaagggcgcuucacugugucucgagauaauagccguaacacgcuguaucuacagaugaagucccucagagcggaagacaccgcucuguacuauugugccaaaguccagauucagcaacuuaauuuuggagugauaacagaugcaggccuggacguuuggggcaaggggacuaccuugaucgugucaagugccagcacaaaagga

SEQ ID NO: 27205 - RNA, 378 nt, Artificial Sequence
  derived and/or modified sequence opt3 from anti-HIV_Chain
caggugcaacugguccagagcggcgccgcuguuaagaaacccggggcauccgugaagguaucuugcgaggccuacggauauaaauucaccgaccacuuuaugcauugguggagacaggcgccuggucagggccucgaauggaugggguggaucaacccauacacaucagcugugaauuauaguccgaaguaccaaggaagggucacuaugacgcgggauaccuuccuugagacaguguauauggaacugcgcggcuugcgaguugacgauacugccauuuacuauugugcaacccccaaaagcggucgugacuacugguccuuugauuuaugggggcagggaacacuggugaccgucucuucggccucaacuaagggc

SEQ ID NO: 27206 - RNA, 378 nt, Artificial Sequence
  derived and/or modified sequence opt3 from anti-HIV_Chain
caggugcaacugguccagagcggcgccgcuguuaagaaacccggggcauccgugaagguaucuugcgagaccuacggauauaaauucacagaccacuuuaugcauugguggagacaggccccuggucagggccucgaauggaugggguggaucaacccauacucaagugcggugagcuauuccccgagguaccaaggacgggucacuaugacgcgcgauaccuuccuugagacaguguauauggaacugcgaggcuugcguuuugacgauacugcuauuuacuauugugccacccccaagucugguagagacuacuggucguucgauuuaugggggcagggaacacugguuaccgugucaagcgcaaguacuaaaggc

SEQ ID NO: 27207 - RNA, 378 nt, Artificial Sequence
  derived and/or modified sequence opt3 from anti-HIV_Chain
caggugcaacugguccagagcggcgccgcuguuaagaaacccggggcauccgugaagguaucuugcgagaccuacggauauacauucacugaccacuuuaugcauugguggagacaggccccuggucagggccucgaauggaugggguggaucaacccauacucaagugcggugagcuauuccccgagguaccaaggacgggucacgaugacccgcgauacauuccuugagacuguguauauggaacugcgaggcuugaaauuugacgauaccgcuauuuacuauugugccacacccaagucuggucgugacuacuggucguucgauuuaugggggcagggaacccugguuacugugucaagcgcaaguacaaaaggc

SEQ ID NO: 27208 - RNA, 378 nt, Artificial Sequence
  derived and/or modified sequence opt3 from anti-HIV_Chain
caggugcaacugguccagagcggcgccgagguuaagaaacccggguccucugugaagguaucaugcaaaaccaguggagugagauucagcuccaacgcuaucucuugggucaggcaggcaccuggucagggccucgaauggauggggcggacaacuccaaugcuuggaggcgccaaucacgcgccgucguuuaagggucgcgugacgauuucagcugacgagagcacccgaacaguuuacauggaaaugaguucccugcguuaugaggauacugccguguacuauugugcaucugggagaagggaaggauugaacuucuuacuggacuacuggggccaaggcacccuagucacagugagcuccgccucaaccaaaggg

SEQ ID NO: 27209 - RNA, 378 nt, Artificial Sequence
  derived and/or modified sequence opt3 from anti-HIV_Chain
caggugcaacugcaggagagcggccccgggcucgucaagccuuccgaaacccuuucucugacaugcacuguuucaggagguaguaucagcacguacuauugguccuggauuagacagccaccgggcaaaggguuggaguggauaggauacaucucuuauucgggcucaaccaacuacaaucccagcuuaaagaguagggugacaauuuccguagacacuucuaaaaaccaguucagccugaagcuauccucagugaccgccgcugauacagcagucuauuacugugcccggcacaaaagugugcuccugugguuucgcgaacuugacuauuggggucaagggacccugguuacugugagcucugcguccacaaaggga

SEQ ID NO: 27210 - RNA, 378 nt, Artificial Sequence
  derived and/or modified sequence opt3 from anti-HIV_Chain
caggugcaacugguccagagcggcgccgagguuaagaaacccggggcugcagugaagaucuccugcaaagccucuagauucaccuuuucaaguuacuauauucacuggguaaggcaggcgccuggacagggucucgaauggaugggcauaaucaacccaagcgggggauccacaucuaaugcucaaaaguuccaggaccgggugacucuuacgcgcgauaugucgaccggcacagucuacauggagcugucacgauugacuagcgaagacaccgccguguauuacugugcaacaccggagcccaguuccauuguugccccuuuauauuacuggggucaggggacccuggugacugucucuagcgcuuccacaaaagga

SEQ ID NO: 27211 - RNA, 378 nt, Artificial Sequence
  derived and/or modified sequence opt3 from anti-HIV_Chain
caggugcaacugguccagagcggcgccgagaugaagaaacccggggcuuccguuaaggugucuugcaaagcaucaggacacaccuucacaaacuacuauaugcauuggguaagacaggccccuggucagggccucgaauggauggggaugaucaauccaacuggagacaguacgagguacgcgcaacgguuucagggccgcgugaccaugacacgagauacuagcacccguacagucuauauggagcuuuccucucugagaucggacgauaccgcuguguacuauugugccagggcacaccaugacuucuggcgggccccgguugaugugugggguaaggggacuacagucaccgugucaagcgcuaguacgaaagga

SEQ ID NO: 27212 - RNA, 378 nt, Artificial Sequence
  derived and/or modified sequence opt3 from anti-HIV_Chain
caggugguccugauccaaagcggcgccgagguuaagagacccggguccucugugaaaguaucaugcaaggcuaguggagguagcuucccuauuaccugggugaggcaggcaccaggccacgggcucgaauggaugggaggcauaaacccguuuuucgguacaacuaauuacgcccagaaauuucaggggcgggucuccaucacggcggacgagucuaccucgacaacuuaucuucaucugucagauuugcgcagcgaagacaccgcuguguacuucugugcccgagagaaccgugaaaagugguuaguucugagaaguugguuugcacccuggggacaaggcacccuagugacagucuccucugccagcacuaaaggc

SEQ ID NO: 27213 - RNA, 378 nt, Artificial Sequence
  derived and/or modified sequence opt3 from anti-HIV_Chain
agccagcaacuggugcaguccggcgcccaggucaagaaacccggggcuucuguuagagugucaugccaggcaaguggauacaccuucacaaaccacuuucuccauugguggaggcaagccccucggcagggucuugaguggaugggcuggaucaauccaguacacgggggacgcaacuaugcgcgacguuuccagggcagaauuaauuuugguagggacguguaccaggaaacugcuuauauggagcugagcggguugcggaacgaugacacggccaccuacuucugugcacgcggaggcggcgaugggagaaauuggcauuuacacccguggggacaagguacacuggucauaguguccgccgcuucuacuaagggc

SEQ ID NO: 27214 - RNA, 378 nt, Artificial Sequence
  derived and/or modified sequence opt3 from anti-HIV_Chain
gaggugcaggucguugaaagcggcgggggacuggugcaacccgguggcucccucagacuuucuugcguagccucaggguucaccuuuagugaguacuggaugagcugggugaggcaggcuccuggaaagggccuggaaugggucgcaacaaucaaacgggacgguuccgaggaaucuuauguggauucgguuaaggggcgcuucacuauuucacgagacaacgccaaaaauagcuuguacuuacagaugaacagucugcgugcggaggauacggcuguguauuacugugccagagucagggacccaaauuauaaccuacacuuugauuccuggggacagggcacccucgugacaguaucuagcgcauccacuaagggc

SEQ ID NO: 27215 - RNA, 378 nt, Artificial Sequence
  derived and/or modified sequence opt3 from anti-HIV_Chain
cuggugcagcucgucgagagcggcgggggaguugugcaacccgguaagucccuuagacugucuugcgccaccucaggcuucacauuuaguacuuacgggaugcacuggguaaggcaggcuccuggaaaaggcuuggaauggguggcagucaucugguaugacgguagcuacaaguauuacgccgauuccgugaaagggcgguucacgauuucucgcgacaacucgaagaauaccuuauuucugcagaugaacucacuacgagcggaggauacagcuauguauuacuguggacgugaaauggccguuggcggcacuaaagcacucgaccauugggggcagggaacccuggugacagucagcagugccuccaccaagggu

SEQ ID NO: 27216 - RNA, 378 nt, Artificial Sequence
  derived and/or modified sequence opt3 from anti-HIV_Chain
gaguuccagcuggugcaaagcggcgggggacucgucaagcccgguggcucccuuagacugucuugcaccgggucaacauuuaguuucagcuccgacgauaugaacuggguuaggcaggccccuggaaaaggcuuggaaugggugucuucgaugucagacagcgguagucacaucuacuaugcugauuuuguaaaggggcgguucacuauuucccgcgacaaugccaaaaagucuuuauaccugcagaugaacagccuacgagcagaggauacggcgguguauuacugugcucagucccguccaccgcaaagacucuauggaauggacgucuggggccagggcaccacagugacuguuucaagugccagcaccaaaggg

SEQ ID NO: 27217 - RNA, 381 nt, Artificial Sequence
  derived and/or modified sequence opt3 from anti-HIV_Chain
gaggugcagcuggucgaaagcggcgggggaguugugcaacccgguggcucccucagacuuucuugcgccgcuucaggguucauguuuaagaacuacgcaaugcacuggguaaggcagccuccaggaaaaggccuggaguggguggccgucaucugguauggugggcgggaccagaauuacgcggauagugugaagggacgcuucaccauuagccgagacgauuccgacaacacauuguauuuacagaugaacucucugcgugcuggcgauacugccguuuacuuuugugcaagaaauucgcaagugggcaggcuaaugccggccgcuggggucuggggacaggguacgcucgugaccguaucaagcgcaaguacaaaaggc

SEQ ID NO: 27218 - RNA, 381 nt, Artificial Sequence
  derived and/or modified sequence opt3 from anti-HIV_Chain
cagggccaccuggugcaaagcgggggaggugucaagaaacucggcaccuccguuacaaucucuugccuugccucagaguacacuuucaacgaauuugugauucauuggauaagacaggcucccgggcagggaccucugugguugggcuuaaucaagaggaguggucggcugaugacgagcuaucaguuccaagaccgccuaucccuccgacgugauagaucuaccgggacaguauuuauggagcugaggggacuucggguggacgauacugcagucuacuauugugcccgcgacggccugggcgaaguggcgccagcuuacuuguaugggauugaugccuggggacaggguaccacaguuaucgugaccucggcaucaacu

SEQ ID NO: 27219 - RNA, 381 nt, Artificial Sequence
  derived and/or modified sequence opt3 from anti-HIV_Chain
caggugcaacugcucgagagcggcgggggacuuguccagagagguggcucccugagguugucuugcaccgccucaggguucguuuuuaacaauuacuggaugacaugggugcggcaggcucccggaaacggcuuagaauggguagcaaauaucgaccaggaugguagugagaagcacuaucuggacagcgugaaagggcgcuucacuauuucccgagauaacgccaaaaauucucuauaccuccaaaugaacucgcugcgugcggaagacacggcuauauauuacugugccagagucagguuuaaggugaccgcauggcaucgguucgauucauggggacagggcgaccuuguuacagugagcaguacuuccaccaagggc

SEQ ID NO: 27220 - RNA, 381 nt, Artificial Sequence
  derived and/or modified sequence opt3 from anti-HIV_Chain
cagagcgcccugacccaacccccuuccgcuucuggcacaccagggcagagagugacuaucucaugcaguggaagcuaccacaacauugguuccaaugcagucaacugguaucagcagcucccgggcacggcccccaaacuucugauauacucuaaugaccaaaggccuucggggguuccagaucgguucucaggaagcaagaguggcaccuccgcgucuuuggcuaucagcgguuuacaguccgaggacgaagccgauuauuacugugcagccugggacgauucacugcauguguuugggacaggaacuaagguaaccgugcuaggccagcccaaagcuaacccuacagucacccucuucccacccaguagcgaggaacug

SEQ ID NO: 27221 - RNA, 381 nt, Artificial Sequence
  derived and/or modified sequence opt3 from anti-HIV_Chain
cagagcgugcugacccaaguccucuccguuucuggcacacccgggcagagagugaucauuucaugcaguggaacuagcuccaacguagguggcaaucuugugucuugguaccagcaucugccuggggccgcuccaagguuguuaauacaccgggacgaucagcgcccgucgggaguccccgaccgauucucaggcagcaagagugguaacuccgcaucucuggugaucagcgggcuacguuccgaugacgaggccgauuauuuuugugcggcuuacgacucaacguucagucucccuguuuuuggaggcggcaccagacugacagugcuuagccaaccaaaagccgcacccucugucacucuguucccuccauccucagaa

SEQ ID NO: 27222 - RNA, 381 nt, Artificial Sequence
  derived and/or modified sequence opt3 from anti-HIV_Chain
caggugcaacugcuccagagcggcgccgcugucaccaagcccggggcauccguuagagugucuugcgaggccucaggauacaacaucagggacuauuucauucacugguggcggcaggcgccuggucagggccuucaauggguaggguggauaaauccaaaaacaggacagccgaacaaucccugucaguuucagggccgcgugagucugacucgacaugcuagcugggauuucgacacguuuuccuucuacauggauuugaaggccuuacguucugacgauaccgcagucuauuuuugcgccagacaaaggucggacuacugggauuucgacgugugggguucagggacacagguuacugugagcagugcuuccaccaaa

SEQ ID NO: 27223 - RNA, 381 nt, Artificial Sequence
  derived and/or modified sequence opt3 from anti-HIV_Chain
caggugcaacugguccagagcggcggggagguuagaaagcccggauccucugugaaaguaccuugcaagaucucagguaacgccuucaguaauuacggcgugaacugggucaggcaggcuccagggcagggacucgaaugggugggccggauuauaccgguuaucgguguggcacaacacgcccccaaauuucaggggcgcgucaccauuacagcggacaagagcacuacgaccgcuuaucuugagcuguccucuuugcgaucggaugacacagccguguacuucugugcaaaagaucauggagacccucguacuggcuauuacuuugauuauuggggccagggggccuuaguaaccguuucaagcgcuaguacaaaggga

SEQ ID NO: 27224 - RNA, 381 nt, Artificial Sequence
  derived and/or modified sequence opt3 from anti-HIV_Chain
caggugcaacugggccagagcgggaccgaggucaagaaacccggauucuccguuaaggugucuugcaaagccucagguggcaguagcacagcuuacggguauuccuggguaagacaggcaccuggacagggcuuugaauggauggguaggaucauuccauucuacgggauaaucacuuaugccccgaaguuucaaggacgggugacgauuaccgcggaccgcucuacaucgacugucuacauggagcucaccucacuuacauucgcugauaccgcccuguuuuucugugcacgagacuuuggcgauccccguaacggcuauuacuucgacagcugggaucagggguugugguuaacugugaguuccgccucuacaaaagga

SEQ ID NO: 27225 - RNA, 381 nt, Artificial Sequence
  derived and/or modified sequence opt3 from anti-HIV_Chain
caggugcaacugguccagagcggcgccgagguuaagaaacccggguccucugugaagguaucaugcaaagcuaguggagguaccuucagcaacuacgcaaucuccugggugagacaggccccuggccaggggcucgaauggaugggaggcauuauaccaaucuuugaggcggcuucuuaugcccaaaaguuccaggacaggcuuacaauuacuacggaugaaucgaccacaacugcauacauggaccugagcucauugcggagugaggauaccgccaucuauuacugugcucgcgcacagggugacauuuuaacagaaggguauuuugauuacuggggacagggcacccuggucacuguguccucugccagcacaaaaggc

SEQ ID NO: 27226 - RNA, 381 nt, Artificial Sequence
  derived and/or modified sequence opt3 from anti-HIV_Chain
caggugcaacugcaggagagcggccccgggcucgucaagccuuccgaaacccuuucucugacaugcacuguuucaggagguaguaucagcuccgccggcuacuauuggucuuggauuagacagcacccagagaaaggguuggaguucauaggauacaucuauuacuuaggcacgaccuauuacaacccgucgcugaagucaagggugagcauuaguaucgacacauccaauaaccaguuuucucuagaacucagcuccguaucagcugcagauacugccauuuauuacugugcgcgggacuacaccgcuaguggucgccauuucuuugauuauugggggcaaggaacacuggugaccgucagcucugccuccacuaaaggc

SEQ ID NO: 27227 - RNA, 381 nt, Artificial Sequence
  derived and/or modified sequence opt3 from anti-HIV_Chain
caggugcaacugguccagagcggcgccgagguuaagaaacccggggcuuccgugaagguaucuugcaaagcaccuggauacaccuucaucggucacuauaugcauuggauuagacaggccccaggccaggggcucgaauggaugggauggauaaaccccaauucaggcgacacaaacuacgcgcaaacuuuucaggguagggugacgaugacccgggauacaaguaucagcacugcuuauauggagcuuacccgccugcgauccgacgauacagccgucuacuauugugcacgugacuugagaccgaugagggggaauugggccaugcacguguggggagaaggcaccacuguuacagugucuucggcuucaaccaagggc

SEQ ID NO: 27228 - RNA, 381 nt, Artificial Sequence
  derived and/or modified sequence opt3 from anti-HIV_Chain
caggugcaacugcaggagagcggccccgggcucgucaagccuuccgaaacccuuucucugacaugcacuguuuucggagccucaaucagaaguuuuuacuggcacuggauuaggcagagcccagguaaaggcuuggagugguuaggguccguguucgacaacggacugacgaccuauaauccgucucuaaagaaccggcucucgauaucagaagaucccagccgcaaucagaucagucugaaccuucgauccaugacagcugcagacacugccguauacuauugugcgcgugcugauuacgaccuguugaccucuagcuaucauuuugauuccuggggccaagguacacucgugaccgucucaagugccagcacuaaaggg

SEQ ID NO: 27229 - RNA, 381 nt, Artificial Sequence
  derived and/or modified sequence opt3 from anti-HIV_Chain
agccagcaacuggugcaguccggcacccaggucaagaaacccggggccucuguuagagugucaugccaggcuaguggauacacauucacugacuauguacuccacugguggaggcaagcaccuggucagggccuugaguggaugggguggaucaagccaguguacggagcccggaacuaugcgcaucgcuuucagggccgaauuaauuucgaucgugacgucuacagagaaauagcuuauauggaucugagcgguuugagguccgacgauacggccguguacuuuugugcacgggacgggucuggagaugccaccucguggcacuuacauccguggggccagggcacacugguuaucgugucaagcgcuaguacuaaaggg

SEQ ID NO: 27230 - RNA, 381 nt, Artificial Sequence
  derived and/or modified sequence opt3 from anti-HIV_Chain
agccagcaacuggugcaguccggcacccaggucaagaaacccggggccucuguuagagugucaugccaggcuaguggauacacauucacuaacuauauccuccacugguggaggcaagcaccuggucggggccuugaguggauggggcugauuaagccaguauacggagccgugaauuaugcgcgccaguuucagggccgaauacaguugacgcgugacaucuacagagaaauugcuuucuuagaucugagcggucuaaggccggacgauaccgccgucuauuacugugcacgggacgaguccggguaugaucucaacuggcaucuggacucuuggggacaaggcacacaggugaucguuucgcccgccucaacuaaaggc

SEQ ID NO: 27231 - RNA, 381 nt, Artificial Sequence
  derived and/or modified sequence opt3 from anti-HIV_Chain
agccagcaacuggugcaguccggcgcccaggucaagaaacccggggcuucucucagaguuucaugccaggcaaguggauacaccuucaugaacuaucuucugcacugguggaggcaagccccuggucagggcuuggaguggaugggguggaucaauccaguguacggagcgguaaacuaugcucaucgguuucagggccgcuuaacauucagccgagacguguaccgugaaauugccuauauggaucugaauggucuaagauccgacgauacugcagucuacuuuugugccagggacgggucuggagaugaccggaacuggcaccucgauccguggggccagggcacgcuggugauaguuucgucagcuagcaccaagggg

SEQ ID NO: 27232 - RNA, 381 nt, Artificial Sequence
  derived and/or modified sequence opt3 from anti-HIV_Chain
agccagcaacuggugcaguccggcacccaggucaagaaacccggggccucuguuagaaucucaugccaggcuaguggauacacauucacugacuaugugcuccacugguggaggcaagcaccuggucagggccuugaguggaugggguggauuaagccaguauacggagcccggaacuaugcgcgccgauuucagggccguauaaauuucgauagagacaucuacagggaaauugcuuuucuggauuugagcgguuuacgguccgacgauacggcccgcuauuucugugcaagagacgggucuggagaugacaccucguggcaucugcacccguggggccagggcacucuagugaucgucucagccgcuagcacaaaaggg

SEQ ID NO: 27233 - RNA, 381 nt, Artificial Sequence
  derived and/or modified sequence opt3 from anti-HIV_Chain
agccagcaacuggugcaguccggcacccaggucaagaaaacaggggccucuguuagagugucaugccaggcuaguggauacgacuucacuaaguaucucauccacugguggaggcaagcacccggucagggccuugaguggaugggguggaugaaaccuguauacggagccacgaacuaugcgcaucgguuucagggccgcauuagcuucacccgagauauauaccgugaaaucgcuuuuauggaccugaaugguuugagauccgaugacacagccguguauuucugugcaagggaugggggaggcgacgaucggacuugguuacuggacgccuggggccaggggacccuagucauugugucuucggcuucaacaaaggga

SEQ ID NO: 27234 - RNA, 381 nt, Artificial Sequence
  derived and/or modified sequence opt3 from anti-HIV_Chain
agccagcaacuggugcaguccggcacccaggucaagaaacccggggccucuguuagagugucaugccaggcuaguggauacacauucaugaacuauaucauucacugguggaggcaagcaccuggucagcggcucgaguggaugggcuggauaaauccaguauuuggggcccgcaacuacgcgcaucgauuccagggacguaucaauuuugacagagauauuaacagggaaacuuuccagauggaccuuacgggccugcggagcgaugacaccgcuguguauuacugugcccgcgaugguuccggggacgcaagagauuggcacuugcauccguggggacaaggcacauuagucaucgugucuucggccucaacuaagggc

SEQ ID NO: 27235 - RNA, 381 nt, Artificial Sequence
  derived and/or modified sequence opt3 from anti-HIV_Chain
agccagcaccuggugcaauccggcacccaggucaagaaacccggggccucuguuagagugucaugccaggcuaguggauacacauucacuaacuauauccuccauugguggaggcaggcaccuggucaaggccuugaguggauggggcugauuaagccaguauuuggagccgugaauuacgcgcggcaguuccagggccgcauacaguugacgcgagacaucaaccgugaaauugcuuuucuggaucugagcggucuaagauccgacgauaccgccgucuauuacugugcaagggacgagucuggggaugaccucaaauggcacuuacauccguggggacaaggcacacaggugaucguuucgcccgccucaacuaagggc

SEQ ID NO: 27236 - RNA, 381 nt, Artificial Sequence
  derived and/or modified sequence opt3 from anti-HIV_Chain
agccagcaacuggugcaguccggcacccaggucaagaaacccggggccucuguuagagugucaugccaggcuaguggauacacauucaugaacuauaucauucacugguggaggcaagcaccuggucagcggcucgaguggaugggcuggauaaauccaguauuuggggcccgcaacuacgcgcaucgauuccagggacguaucaauuuugacagagauauuaacagggaaacuuuccagauggagcuuacgggccugcggagcgacgauaccgcuguguauuacugugcccgcgacgguuccggggaugcaagagacuggcacuuggauccguggggacaaggcacauuagucaucgugucuucggccucaacuaagggc

SEQ ID NO: 27237 - RNA, 381 nt, Artificial Sequence
  derived and/or modified sequence opt3 from anti-HIV_Chain
agccagcaacuggugcaguccggcacccaggucaagaaacccggggccucuguuagaaucucaugccaggcuaguggauacacauucacugacuaugugcuccacugguggaggcaagcaccuggucagggccuugaguggaugggguggauuaagccaguauacggagcccggaacuaugcgcgccgauuucagggccguauaaauuucgauagagacaucuacagggaaauugcuuauauggaucugagcgguuugcgguccgacgauacggcccgcuacuuuugugcaagagacgggucuggagaugacaccucguggcauuuacacccguggggccagggcacacuggugaucgucucagccgcuagcacuaaaggg

SEQ ID NO: 27238 - RNA, 381 nt, Artificial Sequence
  derived and/or modified sequence opt3 from anti-HIV_Chain
agccagcaacuggugcaguccggcacccaggucaagaaacccggggccucuguuagaaucucaugccaggcuaguggauacagcuucacagacuaugugcuccacugguacaggcaagcaccuggucagggccuugaguggaugggguggauuaagccaguauauggagcccggaacuacgcgcgccgauuucagggccguauaaauuucgauagagacaucuauagggaaauugcuuuuauggaucuguccgguuugcggucugacgauacugccuuauacuucugugcacgcgacgggucgggagaugacacgucaugguaucuggauccguggggccagggcacccuagugaucgucagcgccgcuaguacaaaaggg

SEQ ID NO: 27239 - RNA, 381 nt, Artificial Sequence
  derived and/or modified sequence opt3 from anti-HIV_Chain
agccagcaacuggugcaguccggcacccaggucaagaaacccggggccucuguuagaaucucaugccaggcuaguggauacagcuucacagacuaugugcuccacugguggaggcaagcaccuggucagggccuugaguggaugggguggauuaagccaguauacggagcccggaacuaugcgcgccgauuucagggccguauaaauuucgauagagacaucuacagggaaauugcuuuuauggaucuguccgguuugcggucugacgauacugccuuauauuucugugcacgcgacgggucgggagaugacacgucauggcaucuggauccguggggccagggcacccuagugaucgucagcgccgcuaguacaaaaggg

SEQ ID NO: 27240 - RNA, 381 nt, Artificial Sequence
  derived and/or modified sequence opt3 from anti-HIV_Chain
agccagcaccuggugcaauccggcacccaggucaagaaacccggggccucuguuagagugucaugccaggcuaguggauacacauucacuaacuauauccuccauugguggaggcaggcaccuggucaaggccuugaguggauggggcugauuaagccaguauuuggagccgugaauuacgcgcggcaguuccagggccgcauacaguugacgcgagacaucuaucgugaaauugcuuuucuggaucugagcggucuaagauccgacgauaccgccgucuacuauugugcaagggacgagucuggggaugaccucaaauggcacuuacauccguggggacaaggcacacaggugaucguuucgcccgccucaacuaagggc

SEQ ID NO: 27241 - RNA, 381 nt, Artificial Sequence
  derived and/or modified sequence opt3 from anti-HIV_Chain
caggugcaacuggucgagagcggcgggggaguugugcagcccgguaagucccucagacuuucuugcgccaucucaggcuuccuguuuaacaauuacgggggacaguggguaaggcaggcuccuggcaaagguuuggaauggguggcagccauuaguuaugacgggaacaaucgguacuaugcggauagcgcuaagggacgcuucuuaauaucccgagacaccccgaaaaacauccuguaccuacaaauuuauucucuccgucuggaugacacagccgucuacuauugugcaagagauucggugucaaagagcuacagugccccacccgaguuuuggggccagggcacuguugugacggucuccucugcuagcaccaaaggg

SEQ ID NO: 27242 - RNA, 381 nt, Artificial Sequence
  derived and/or modified sequence opt3 from anti-HIV_Chain
caggugcaccuggaggaaagcggccccgggcucgucaagaccucccaaacacuuucucugacuugcucaguuaguagcuacuccaucucuagaucgggauauuucuggacguggauuaggcagcggccugguaaaggcuuggaguggauaggguacaucuauuuuaacggacgcaccacauacaauccaucauuaaagagccgaauuacuaucagucgugacaccucccauucucaguucagccugacacuaaacucccucucagccgcugauaccgcaguguauuacuguggcagaugccaggacggucuggccaguaggccgauugauuuuugggggcaaggaacucuuguaacagugagcucugcguccaccaaaggc

SEQ ID NO: 27243 - RNA, 381 nt, Artificial Sequence
  derived and/or modified sequence opt3 from anti-HIV_Chain
caggugcaacuggucgagagcggcgggggaguugugcagcccgguagaucccucaggcuuucuugcgccaccucaggcuucacaaguaagaauuacgggguacacugggugcggcaggcuccuggaaaaggccuggaaugggucgcagugaucugguaugacgguagcaauaaguuuuacgccgauuccguuaaagggcgcuucacuauuucucgagaccguucgaagaacaugguguauuugcagaugaacucauuaagagucgaggauacggcgauauacuauugugcuagggacagcguggccuuuguacuggaaggaccaaucgauuacuggggccaaggcacccuaguuacagugaguuccgcaucuacuaaaggg

SEQ ID NO: 27244 - RNA, 384 nt, Artificial Sequence
  derived and/or modified sequence opt3 from anti-HIV_Chain
caggugcaacugguccagagcggcgggggaguuaagaaacccgguaccuccgccucuuucucaugcagaacaagugacgauaucuacgacaacgaguuuuucgauagcgcuuuuaugcacugggugaggcucauuccuggccagcggccagaauggaugggguggaugaauccgcgcuccggagcaguaaacuaugcccgacagcuucaaccccgugugucuauguacagagacagggaucugucgacugcguauauggaguucaagucauugacgagcgcugacaccggcacauacuuuugugcccggaaaaagcgcggugauggguucaauuuauauuuugaccuguggggaagaggcagucaggucauaguguccucugca

SEQ ID NO: 27245 - RNA, 384 nt, Artificial Sequence
  derived and/or modified sequence opt3 from anti-HIV_Chain
cagggccaccuggugcaaagcgggggaggugucaagaaacucggcaccuccguuacaaucucuugccuugccucagaggacacuuucaacgaauuugugauucauuggauaagacaggcucccgggcagggaccucugugguugggcuuaaucaagaggaguggucggcugaugacgagcuaccaguuccaagaucgccuaucccuccgacgugacagaucuaccgggacaguauuuauggagcugaggggacuucggguggaugacacugcagucuauuacugugcccgcgauggccugggcgaaguggcgccagcuuauuuguacgggauugacgccuggggacaggguaccacaguuaucgugaccucggcaucaacuagc

SEQ ID NO: 27246 - RNA, 384 nt, Artificial Sequence
  derived and/or modified sequence opt3 from anti-HIV_Chain
cagagcgcccugacccaacccccuuccgugucuggcgcuccagggcagagagucacaaucucaugcaguggagguccgagcaacguuggcgggaauuacguguauugguacaggcaguuccccggaacugcaccuaagcuccuuauucugcgggacgaucagcgcccauccggcguacccgaccgauuuucugccucgaaaucagguaacagcgcgaguuuggcuauauccggguuacguccugaugacgaggccuucuauuuuugugcaacguacgauucucaaggcagcuucagaguguuuggaggcgggaccgcccugacaguccuaucccagccaaaggcugcacccucagugacucucuauccuccaaguagcgaagag

SEQ ID NO: 27247 - RNA, 384 nt, Artificial Sequence
  derived and/or modified sequence opt3 from anti-HIV_Chain
aacuucaugcugacccagcccccuagcgccuccggcacaccagggcaaagagugacuaucucuugcucaggagguggcaguaauauugggggaaaccucgucagcugguaccagcacuuuccgggcgcugcacccaaacuucugauauauaggaaugaccagcggccuuccgguguuccagaucgcuucucugggucgaagucaggaacgagcgccaguuuggcgaucuccggcuuacgaucugacgauaaggcuaccuacuuuugugccgcauaugacagcacacugucccuacgucucuucggcgggggaacuacccugacagugcuuucacagcccaaagccgcuccuaguguaacccuguuuccacccagcucugaggaa

SEQ ID NO: 27248 - RNA, 384 nt, Artificial Sequence
  derived and/or modified sequence opt3 from anti-HIV_Chain
aacuucaugcugacccagcccccuagcguguccgccacaccaggccaaacugucacgaucucuugcucagggaguggaagcaauguugguggcaaccacguguacugguauagacagcucccgggggcugcacccacccuuguaauuuccaagacagaccauaggccuucucgggugccagaucgcuucucgggaucaaaaagcggcaauagugccucccuggcgauaucugguuugcgacccgacgaugaggcugucuacuucugugccacuuaugacaccggguuaagccugcgucuauuuggaggcggcacaagacucaccgugcugucccagccuaaggcagccccaucaguuacucaguuucccccuaguagcgaagag

SEQ ID NO: 27249 - RNA, 384 nt, Artificial Sequence
  derived and/or modified sequence opt3 from anti-HIV_Chain
cagagcgcccugacccaacccccuuccgcuucuggcgcaccagggcagagagugacaaucucaugcaguggagguccgagcaacgucggcgggaauuacguuuauugguacaggcaguuccccggaacugccccuaagcuccuuauucugcgggacgaucagcgcccauccggcgugcccgaccgauuuucugcgucgaaaucagguaacagcgcuaguuuggccauauccggguuacguccugaugacgaggcacuguauuucugugccacguacgauucugacggaagcaucagacuauuuggcggcgggaccgcucucacaguacugucccaaccaaaggcagcccccucagugacucuuuucccuccaggaugggaagag

SEQ ID NO: 27250 - RNA, 384 nt, Artificial Sequence
  derived and/or modified sequence opt3 from anti-HIV_Chain
caggugcaacugcuccagagcggcgccgcugucaccaagcccggggcauccguuagagugucuugcgaggccucaggauacaacaucagggacuauuucauucacugguggcggcaggcgccuggucagggccuucaauggguaggguggauaaauccaaaaacaggacagccgaacaauccccgccuguuucagggccgagugaguuugacucgucaugcuagcugggauuucgacacguuuuccuucuacauggauuuaaaggccgucagaucugacgauaccgcaguguauuuuugugccaggcagcggucggacuacugggauuucgacguuugggguucagggacacaagugacugucagcagugcuuccaccaaagga

SEQ ID NO: 27251 - RNA, 384 nt, Artificial Sequence
  derived and/or modified sequence opt3 from anti-HIV_Chain
caggugcaacugcuccagagcggcgccgucguuaccaagcccggggcuuccgugagaguaucuugcgaggcaucaggauacaaaaucagggacuauuucauucacugguggcggcaggccccuggucagggccuucaaugggugggguggauaaacccacagacaggacagccgaauaucccccgcccuuuucagggccgagucacucugacgcgucaugcgaguugggauuucgacaccuuuagcuucuacauggauuugaaggcuuuaagauccgacgauacagccauuuauuuuugugcaaggcggcgcucugacuacugcgauuucgacgugugggguucggggacucacguuaccgugucaagcgccaguacaaaagga

SEQ ID NO: 27252 - RNA, 384 nt, Artificial Sequence
  derived and/or modified sequence opt3 from anti-HIV_Chain
caggugcaacugcuccagagcggcgccgcugucaccaagcccggggcauccguuagagugucuugcgaggccucaggauacaacaucagggacuauuucauucacugguggcggcaggcgccuggucagggccuucaauggguaggguggauaaauccaaaaacaggacagccgaacaauccccgccaguuucagggccgagugagucugacucgucaagcuagcugggauuucgacacgaucuccuuuuacauggauuugaaggccuuaagacuggacgauaccgcagucuauuucugugccaggcagcggucugacuacugggauuuugacgugugggguucggggacacagguuacugugucaagcgcuaguaccaaagga

SEQ ID NO: 27253 - RNA, 384 nt, Artificial Sequence
  derived and/or modified sequence opt3 from anti-HIV_Chain
caggugcaacugcuccagagcggcgccgcugucaccaagcccggggcauccguuagagugucuugcgaggccucaggauacaacaucagggacuauuucauucacugguggcggcaggcgccuggucagggccuucaauggguaggguggauaaauccaaaaacaggacagccgaacaauccccgccaguuucagggccgagugagucugacucgucaugcuagcugggauuucgacacguuuuccuucuacauggauuugaaggccuuaagaucugacgauaccgcagucuauuuuugugccaggcaacggucggacuacugggauuucgacgugugggguucagggacacagguuacuguguauagcgcuaguaccaaagga

SEQ ID NO: 27254 - RNA, 384 nt, Artificial Sequence
  derived and/or modified sequence opt3 from anti-HIV_Chain
caggugcaacugcuccccuucggcggggccgucaccaagccuggagcuagcguuagaguguccugcgaggcaucugguuacaacaucagggacuauuuuauucacugguggcggcaggccccaggccaggggcuucaguggguaggauggauaaauccgaaaacaggccaacccaacaauccuugucaguuccagggucgcgugucacugacucgaccagcgaguugggauuuugacacgaucagcuucuacauggauuugaaggcuuuacgucuggacgauaccgccgucuauuuuugcgcaagacagagguccgacuacugggauuucgacgugugggggucuggaacacaaguuacugugucgucagccagcaccaaaggc

SEQ ID NO: 27255 - RNA, 384 nt, Artificial Sequence
  derived and/or modified sequence opt3 from anti-HIV_Chain
caggugcaccugagccaauccggcgccgcugucaccaagcccggggcaucuguuagagugucaugcgaggccaguggauacaaaaucagcgaccauuucauucacugguggaggcaggcgccuggucagggccuccaguggguaggguggauaaacccaaagacaggacaaccgaauaacccccggcaguuucagggccgcgugucccuuacucgacaggcuucuugggauuucgacacguauucguuuuacauggaucugaaagccuugcguucagacgauaccgcaaucuauuucugugccagacaaaggagcgacuuuugggauuucgacgucugggguagugggacacaggugacuguuuccucugcuagcaccaaggga

SEQ ID NO: 27256 - RNA, 384 nt, Artificial Sequence
  derived and/or modified sequence opt3 from anti-HIV_Chain
caggugcaccugagccaauccggcgccgcugucaccaagcccggggcaucuguuagagugucaugcgaggccaguggauacaaaaucagcgaccauuucauucacugguggaggcaggcgccuggucagggccuccaguggguaggguggauaaacccaaagacaggacaaccgaauaacccccggcaguuucagggccgcgugucccuuacucgacaggcuucuugggauuucgacacguauucguuuuacauggaucugaaagccguccguucagacgauaccgcaaucuauuucugugccagacaaaggagcgacuuuugggauuucgacgugugggguagugggacacagguuacuguguccucugcuagcaccaaggga

SEQ ID NO: 27257 - RNA, 384 nt, Artificial Sequence
  derived and/or modified sequence opt3 from anti-HIV_Chain
caggugcaacugcuccagagcggcgccgcugucaccaagcccggggcauccguuagagugucuugcgaggccucaggauacaaaaucagugaccacuucauucauugguggaggcaggcgccuggucagggccuucaauggguaggguggauaaacccaaagacaggacagccgaauaacccccggcaguuucagggccgcaucagccugacucgacaggcuuccugggauuucgacacguuuucuuucuauauggauuugaaagccuuacguucggacgauaccgcaguguacuuuugugccagacaaaggucagacuauugggauuucgacgucugggguagcgggacacaggugacuguuaguuccgcuucuaccaaggga

SEQ ID NO: 27258 - RNA, 384 nt, Artificial Sequence
  derived and/or modified sequence opt3 from anti-HIV_Chain
caggugcaacugcuccagagcggcgccgcugucaccaagcccggggcauccguuagagugucuugcgaggccucaggauacaacaucagggacuauuucauucacugguggcggcaggcgccuggucagggccuucaauggguaggguggauaaauccaaaaacaggacagccgaacaauccccgccaguuucagggccgagugagucugacucgucaugcuagcugggauuucgacacguuuuccuucuacauggauuugaaggguuuaagaucugacgauaccgccaucuauuuuugugcaaggcaacggucggacuacugggauuucgacgucugggggucaggaacacaggugacuguuagcagugccuccaccaaaggc

SEQ ID NO: 27259 - RNA, 384 nt, Artificial Sequence
  derived and/or modified sequence opt3 from anti-HIV_Chain
caggugcaacugcuccagagcggcgccgcugucaccaagcccggggcauccguuagagugucuugcgaggccucaggauacaacaucagggacuauuucauucacugguggcggcaggcgccuggucagggccuucaauggguaggguggauaaauccaaaaacaggacagccgaacaauccccgccaguuucagggccgagugagucugacucgucaugcuagcugggauuucgacacguuuuccuucuacauggauuugaaggccuuaagaucugacgauaccgcagucuauuuuugugccaggcaacggucggacuacugggauuucgacgugugggguucagggacacagguuacugugagcagugcuuccaccaaagga

SEQ ID NO: 27260 - RNA, 384 nt, Artificial Sequence
  derived and/or modified sequence opt3 from anti-HIV_Chain
cacgugcagcugcuccaaagcggcgccgcugucaccaagcccggggcauccguuagagugucuugcgaggccucaggauacaacaucagggacuauuucauucauugguggcggcaggcgccuggucagggccuucaguggguaggguggauaaauccaaaaacaggacaaccgaacaauccccgccaguuucagggccgagugagucugacucgucaggcuagcugggauuucgacacguuuuccuucuacauggauuugaaggccuuaagacuggacgauaccgcaaucuauuuuugugccaggcaacggucugacuacugggauuucgacgucugggguucggggacacaggugacuguuucaagcgcuaguaccaaagga

SEQ ID NO: 27261 - RNA, 384 nt, Artificial Sequence
  derived and/or modified sequence opt3 from anti-HIV_Chain
caggugcaccugagccauuccggcgccgcugucaccaagcccggggcaucuguuagagugucaugcgaggccaguggauacaaaaucagcgaccacuucauucauugguggaggcaagcgccuggucagggccuccaguggguaggguggauaaacccaaagacaggacagccgaauaacccccggcaauuucagggccgcaucucccuuacucgacaggcuucuugggauuucgacacguuuucguucuauauggaucugaaagccuugcguucagacgauaccgcaguguacuuuugugccagacagaggagcgacuauugggauuucgacgucugggguagugggacacaagugacuguuuccucugcuagcaccaaggga

SEQ ID NO: 27262 - RNA, 384 nt, Artificial Sequence
  derived and/or modified sequence opt3 from anti-HIV_Chain
caggugcaccugagccaauccggcgccgucguuaccaagcccggggcuucugugagaguaucaugcgaggcaaguggauacaaaaucagcgaccauuucauucacugguggaggcaggccccuggucagggccuccagugggugggguggauaaacccaaagacaggacaaccgaauaacccccggcaguuucagggccgcaucucccuuacucgacaggcgucuugggauuucgacacguuuucguucuauauggaucugaaggcuuugcguucagacgauaccgccgucuacuuuugugcaagacaaaggagcgacuauugggauuucgacgugugggguagugggacacagguuacuguguccucugccagcaccaaagga

SEQ ID NO: 27263 - RNA, 384 nt, Artificial Sequence
  derived and/or modified sequence opt3 from anti-HIV_Chain
caggugcaccugagccaauccggcgccgucguuaccaagcccggggcuucugugagaguaucaugcgaggcaaguggauacaaaaucagcgaccauuucauucacugguggaggcaggccccuggucagggccuccagugggugggguggauaaacccaaagacaggacaaccgaauaacccccggcaguuucagggccgcaucucccuuacucgacaggcgucuugggauauugacacguucucguuuuauauggaucugaaggcuuugcguucagacgauaccgccgucuacuucugugcaagacauaggagcgacuauugggauuuugacgugugggguagugggacacaaguuacuguguccucugccagcaccaaagga

SEQ ID NO: 27264 - RNA, 384 nt, Artificial Sequence
  derived and/or modified sequence opt3 from anti-HIV_Chain
caggugcaccugagccaauccggcgccgucguuaccaagcccggggcuucugugagaguaucaugcgaggcaaguggauacaaaaucagcgaccauuucauucacugguggaggcaggccccuggucagggccuccagugggugggguggauaaacccaaagacaggacaaccgaauaucccccggcaguuucagggccgcauuucccuuacucgacaggcgucuggugauuucgacacguuuucguucuauauggaucugaaggcuuugcguucagacgauaccgccgucuacuuuugugcaagacaaaggagcgacuauugggauuucgggguguggggaaguggcacacagguuacuguguccucugccagcaccaaaggc

SEQ ID NO: 27265 - RNA, 384 nt, Artificial Sequence
  derived and/or modified sequence opt3 from anti-HIV_Chain
caggugcaccugagccaauccggcgccgucguuaccaagcccggggcuucugugagaguaucaugcgaggcaaguggauacaaaaucagcggucauuucauucacugguggaggcaggccccuggccaggggcuccagugggugggauggauaaacccaaagacaggccaaccgaauaacccccggcaguuucagggucgcaucucccuuacucgacaggcgucuugggacuucgauacguuuucguucuauauggaccugaaggcuuugcguucagaugacaccgccgucuacuuuugugcaagacauaggagcgauuauugggacuucgaugugugggggaguggaacacaaguuacuguguccucugccagcaccaaaggc

SEQ ID NO: 27266 - RNA, 384 nt, Artificial Sequence
  derived and/or modified sequence opt3 from anti-HIV_Chain
caggugcaccugagccaauccggcgccgcugucaccaagcccggggcaucuguuagagugucaugcgaggccaguggauacaaaaucagcgaccauuucauucacugguggaggcaggcgccuggucagggccuccaguggguaggguggauaaacccaaagacaggacaaccgaauaacccccggcaguuucagggccgcaucucccuuacucgacaggcuucuugggauuucgacacguuuucguucuauauggaucugaaagccuugcguucagacgauaccgcaguguacuuuugugccagacauaggagcgacuauugggauuucgacgucugggguagugggacacaagugacuguuuccucugcuagcaccaaggga

SEQ ID NO: 27267 - RNA, 384 nt, Artificial Sequence
  derived and/or modified sequence opt3 from anti-HIV_Chain
caggugcaccugagccaauccggcgccgcugucaccaagcccggggcaucuguuagagugucaugcgaggccaguggauacaaaaucagcgaccauuucauucacugguggaggcaggcgccuggucagggccuccaguggguaggguggauaaacccaaagacaggacaaccgaauaacccccggcaguuucagggccgcgugucccuuacucgacaggcuucuugggauuucgacacguauucguuuuacaugggucugaaagccguccguucagaugacaccgcaaucuauuucugugccagacaaaggagcgauuuuugggacuucgaugugugggggaguggaacacagguuacuguguccucugcuagcaccaagggc

SEQ ID NO: 27268 - RNA, 384 nt, Artificial Sequence
  derived and/or modified sequence opt3 from anti-HIV_Chain
caggugcaccugagccaauccggcgccgucguuaccaagcccggggcuucugugagaguaucaugcgaggcaaguggauacaaaaucagcgaccauuucauucacugguggaggcaggccccuggucagggccuccagugggugggguggauaaacccaaagacaggacaaccgaauaacccccggcaguuucagggccgcaucucccuuacucgacaggcgucuugggauuucgacacguuuucguucuauauggaucugaaggcuuugcguucagacgauaccgccgucuacuuuugugcaagacauaggagcgacuauugggauuucgacgugugggguagugggacacaaguuacuguguccucugccagcaccaaagga

SEQ ID NO: 27269 - RNA, 384 nt, Artificial Sequence
  derived and/or modified sequence opt3 from anti-HIV_Chain
caggugcaccugagccaauccggcgccgucguuaccaagcccggggcuucugugagaguaucaugcgaagcaaguggauacaaaaucagcgaccauuucauucacugguggaggcaggccccuggucagggccuccagugggugggguggauaaacccaaagacaggacaaccgaauaacccccggcaguuucagggccgcaucucccuuacucgacaggcgucuugggauuucgacacguuuucguucuauauggaucuggaggcuuugcguucagacgauaccgccgucuacuuuugugcaagacaaaggagcgacuauugggauuucgacgugugggguagugggacacagguuacuguguccucugccagcaccaaagga

SEQ ID NO: 27270 - RNA, 384 nt, Artificial Sequence
  derived and/or modified sequence opt3 from anti-HIV_Chain
caggugcaccugagccaauccggcgccgcugucaccaagcccggggcaucuguuagagugucaugcgaggccaguggauacaaaaucagggacuauagcauucauugguggcggcaggcgccuggucagggccuccaguggguaggguggauaaacccacaaacaggacagccgaauaucccccgcccuuuccagggccgaauuucccuuacucgucaggcuucuugggauuuugacacguucucguuuuacauggaucuggaagccuugagaucagacgauaccgcaguguauuucugugccaggcaacggagcgacuacugggauuuugacgucugggguagugggacacaggugacuguuuccucugcuagcaccaaggga

SEQ ID NO: 27271 - RNA, 384 nt, Artificial Sequence
  derived and/or modified sequence opt3 from anti-HIV_Chain
caggugcaccugagccaauccggcgccgcugucaccaagcccggggcaucuguuagagugucaugcgaggccaguggauacaaaaucagcgaccauuucauucacugguggaggcaggcgccuggucagggccuccaguggguaggguggauaaacccaaagacaggacaaccgaauaacccccggcaguuucagggccgcaucucccuuacucgacaggcuucuugggauuucgacacguuuucguucuauauggaucugaaagccuugcguucagacgauaccgcaguguacuuuugugccagacaaaggagcgacuaucgggauuucgacgucugggguagugggacacaggugacuguuuccucugcuagcaccaaggga

SEQ ID NO: 27272 - RNA, 384 nt, Artificial Sequence
  derived and/or modified sequence opt3 from anti-HIV_Chain
caggugcaccugagccaauccggcgccgucguuaccaagcccggggcuucugugagaguaucaugcgaggcaaguggauacaaaaucagcgaccauuucauucacugguggaggcaggccccuggucagggcccacagugggugggguggauaaacccgaagacaggacaacccaauaacccucggcaguuucagggccgcaucucccucacucgacaggcgucuugggauuucgacacguuuucguucuauauggaucuuaaagcucugcguucagacgauaccgccgucuacuuuugugcaagacauaggagcgacuauugggauuucgacgugugggguagugggacacaaguuacuguguccucugccagcaccaaggga

SEQ ID NO: 27273 - RNA, 384 nt, Artificial Sequence
  derived and/or modified sequence opt3 from anti-HIV_Chain
caggugagacugcuccaaagcggcgccgcugucaccaagcccggggcauccguuagggugucuugcgaggccucaggauacgaaauccgggacuauuucauucacugguggcgccaggcgccuggucagggccuucaguggguaggguggauaaacccaaaaacaggacaaccgaauaacccccgacaguuucagggccgugugagucugacuagacaggcuagcugggauuucgacuccuacucuuuuuauauggauuugaaggccuuaaggucggacgauacggcagucuacuucugugcccggcaacgcucagacuauugggauuuugacgugugggguagcgggacccagguuacagugaguuccgcuucuacuaaagga

SEQ ID NO: 27274 - RNA, 384 nt, Artificial Sequence
  derived and/or modified sequence opt3 from anti-HIV_Chain
caggugagacugcuccaaagcggcgccgcugucaccaagcccggggcauccguuagggugucuugcgaggccucaggauacgaaauccgggacuauuucauucacugguggcgccaggcgccuggucagggccuucaguggguaggguggauaaacccaaaaacaggacaaccgaauaacccccgacaguuucagggccgugugagucugacuagacaggcuagcugggauuucgacuccuacucuuuuuauauggauuugaaggccuuaaggucggacgauacgggugucuacuucugugcacggcaacgcucagacuauugggauuuugacgugugggggagcggaacccagguuacagugaguuccgccucuacuaaaggc

SEQ ID NO: 27275 - RNA, 384 nt, Artificial Sequence
  derived and/or modified sequence opt3 from anti-HIV_Chain
caggugagacugcuccaaagcggcgccgcugucaccaagcccggggcauccguuagggugucuugcgaggccucaggauacgaaauccgggacuauuucauucacugguggcgccaggcgccuggucagggccuucaguggguaggguggauaaacccaaaaacaggacaaccgaauaacccccgacaguuucagggccgugugagucugacuagacaggcuagcugggauuucgacuccuacucuuuuuauauggauuugaaggccuuaaggucggacgauacggcagucuacuucugugcccggcaacgcucagacuauugggauuuugacgugugggguagcgggagucagguuaccguguccucugcuagcacaaaagga

SEQ ID NO: 27276 - RNA, 384 nt, Artificial Sequence
  derived and/or modified sequence opt3 from anti-HIV_Chain
caggugcaacugcuccagagcggcgccgcugucaccaagcccggggcauccguuagagugucuugcgaggccucaggauacaacaucagggacuauuucauucacugguggcggcaggcgccuggucagggccuucaauggguaggguggauaaauccaaaaacaggacagccgaacaaucccugucaguuucagggccgcgugagucugacucgacaagcuagcugggauuucgacacgaucuccuuuuacauggauuugaaggccuuacgucuggacgauaccgcagucuauuucugcgccagacagaggucugacuacugggauuuugacgugugggguucggggacacagguuacugugucaagcgcuaguaccaaagga

SEQ ID NO: 27277 - RNA, 384 nt, Artificial Sequence
  derived and/or modified sequence opt3 from anti-HIV_Chain
caggugcaacugcuccagagcggcgccgcugucaccaagcccggggcauccguuagagugucuugcgaggccucaggauacaacaucagggacuauuucauucacugguggcggcaggcgccuggucagggccuucaauggguaggguggauaaauccaaaaacaggacagccgaacaauccccgccaguuucagggccgagugagucugacucgucaugcuagcugggauuucgacacguuuuccuucuacauggauuugaaggccuuaagaucugacgauaccgcagucuauuuuugugccaggcaacggucggacuacugggauuucgacgugugggguucagggacacagguuaucgugagcagugcuuccacuaaagga

SEQ ID NO: 27278 - RNA, 384 nt, Artificial Sequence
  derived and/or modified sequence opt3 from anti-HIV_Chain
caggugcaacugguccagagcggcgccgacguuaagaaacccggggcuaccgugacaguauccugcaagacugaugaggacgaagaugacuucagagcacaccucaugcaguggaugaggcaggccccuggacaacggcuugaguggguggguuggaucaaaccacagacgggccagccgucuuacgggcagaaguuucaaggacgcgucacccugacacgagaagugucaaccaguacuguuuucuugcaguuacguaaccugagaagcgaugacacagcgguguauuacugugcuaggccccggggcggucgcgauaauugguccuuucaugucugggggagaggaacccuagugacuguaucuucggccucaacaaaaggc

SEQ ID NO: 27279 - RNA, 384 nt, Artificial Sequence
  derived and/or modified sequence opt3 from anti-HIV_Chain
gaggugcagcuggucgaaagcggcgccgagguuaagaaacccggggcuuccgugaagguaucuugcaaagugucaggaaacagucucaccgaguucagcauccacugggucagacaagcaccugguaagggccuugaauggaugggaggguuugacccagaagagggcgagacagugccggcccagaaauucaaggguaggcugacuaugacggaagauaccuccacaaauacugcguacauggaguugucuucguuacggucagaagacaccgcuguuuauuacuguagcacagagccccgcgagauggggacccugacugccggauuugaauauuggggccagggcacccuagugacagucaguuccgcaucuacgaagggg

SEQ ID NO: 27280 - RNA, 384 nt, Artificial Sequence
  derived and/or modified sequence opt3 from anti-HIV_Chain
agagugcagcugggccaaagcggggccgaggucaagaaacccggagcuuccguuaaggugucuugcaaaguaucagguaacagucucaccgaguucagcauccacugggugaggcaggcaccuggcaaggggcuugaauggaugggaggcuuugacccagaagagggugaaacagucccggcccagaaauucaaggggcgggugacuaugacggaggauaccuccacaaauacugcguacauggagcugucuucguugcgcucagaagacaccgcuguuuauuacuguagcacagagccccgagaaaugggaaccuuaacugccggcuuugaguauuggggccaggggacacuggugauugucaguuccgcaucuaccaaggga

SEQ ID NO: 27281 - RNA, 384 nt, Artificial Sequence
  derived and/or modified sequence opt3 from anti-HIV_Chain
caggugcaacugguccagagcggcgccgacguuaagaaacccggggcuuccgugaccguaucuugcaagacagaugaggacgaagaugacuucagagcacaccucgugcaguggaugaggcaggccccuggacaacggcuugagugggucgguuggaucaaaccacagacuggccagccgucauacgcgcagaaguuucaagggcgcgugacgcugacccgagaaguuaguacaagcacuguguucuugcaguuacguaaccugagauccgaugacaccgcugucuauuacugugccaggccccggggaggccgcgauaauuggucuuuucaugugugggguagagggacccuaguaacaguuucgucagcaagcacuaaagga

SEQ ID NO: 27282 - RNA, 384 nt, Artificial Sequence
  derived and/or modified sequence opt3 from anti-HIV_Chain
caggugcaacugcaggagagcggccccgggcucgucaagccuuccgaaacccuuucucugacaugcucaguuaguggagccagcaucuccaacuucuacuggacuuggauuagacagccagcugguaaaggcuuggaguggguggggagguuauauucuucggaccggacgaauuacaacccgucacugaauggacgcguaaccaugagccuagauacaaguaagaaccaguuuucccuccgacugacuucuaugaccgacgcagauacagccauauauuucugugcgcgugaaaaaggccaauggcuuaccgugcccccuuacuauuuugacagcuggggucaggggauccuggucacuguguccucagcuaguacaaaggga

SEQ ID NO: 27283 - RNA, 384 nt, Artificial Sequence
  derived and/or modified sequence opt3 from anti-HIV_Chain
caggugcaacugguccagagcggcgccgagguuagaaagcccggggcuuccgugaaaguaucuugcaagaccucaggauacacauucacuaacaguuauauccacugggugaggcaggcaccuggucagggccucgaauggauggggauuauaaauccaccgggaggcaacacguacuaugcccaaaaauuucauggucgggucacccuuacacgcgacacuagcaccuccacaguguacauggagcugaacucuuugcgaucggaagauaccgcgguuuauuucugugcucguccccacucaccuacuaauaucccaagcagacccuuagacuacugggggcagggaacacuggugaccgucaguuccgccucuacgaagggc

SEQ ID NO: 27284 - RNA, 384 nt, Artificial Sequence
  derived and/or modified sequence opt3 from anti-HIV_Chain
caggugcaacugcaggagagcggccccgggcucgucaagccuuccggaacccuuucucugacaugcaacguuuacgguggcucaaugaucaguuauuacuggagcuggauuagacagccaccggggaaaggauuggaauggauaggccacguguauaauuccgguaacacuaaguacucucccucgcugaaaaauaggguaacgaucucaauggacaccagccggaacuuauucagucuaaaggugacauccgucacuccugccgauaccgcuguguauuacugugcacgcgccgacuaugauaauauuugggacucucgagggggauuugaucucuggggccagggcacacugguuaccgugagcuccgcgucaacuaaaggg

SEQ ID NO: 27285 - RNA, 384 nt, Artificial Sequence
  derived and/or modified sequence opt3 from anti-HIV_Chain
caggugcaacugguccagagcggcgccgagguuaagaaacccggguccucugugaagguaucaugcaaagcuaguggagguacccucagcuccuacacaaucucuugggugagacaggcaccuggccaggggcuugaauggaugggaaggcugauuccauuggucgacauaacuacguaugcccaaaaguuccagggccgggugaccaucacagcggauacuucgaccaacacagcuuacauggaguuaucaaaucugcgcagcgaagacaccgccauuuaucacugugcaacaaguacuaugaucgccgcuguuauuaacgaugcauuugaccuauggggucaggggaccacggugacugucuccucugccagcaccaaagga

SEQ ID NO: 27286 - RNA, 384 nt, Artificial Sequence
  derived and/or modified sequence opt3 from anti-HIV_Chain
caggugcaacugguccagagcggcgccgagguuaagaaacccggggcuuccgugaagaucucuugcaaagcaucaggauacaguuucagaaacuaugccguacacugggugaggcaggcgccuggucagggccucgaauggaugggggagauuaauggaggcaacgguaauaccgaauacagccaaaagucccaggggcggcuuacaauaacucgcgacaucucugcuacgaccgccuauauggagcugucgucauugcgaagcgaugacacagcagucuacuauugugcccguguggcuuacguucauguggucacuaccagaaguuuagauaacuggggacagggcacacuggugaccguauccucugcaagcacuaaaggc

SEQ ID NO: 27287 - RNA, 384 nt, Artificial Sequence
  derived and/or modified sequence opt3 from anti-HIV_Chain
caggugagacugagccaauccggcgccgcugucaugaagaccggggcaucuguuacaaucucaugcgagacugaaggauucaacuuugugaauuacauuauacacuggguaaggcggcccccuggucgcggcuucgaguggcucgggaugaucgacccacgaaacggacauccgugguuugcccagacggugcguggcagacuuagucugaggcgggauaccuucaaugaaauugucuauaugacauugagcgguuuaacuaccgacgauacagggcuguacuuuugugcgcgcaacgagccccaguaucacucccuaccuggaauguucgacuacuggggccagggcaccccagugacuguuucuucggcuucaacaaaaggg

SEQ ID NO: 27288 - RNA, 384 nt, Artificial Sequence
  derived and/or modified sequence opt3 from anti-HIV_Chain
caggugagacugagccaauccggcgccgcugucguuaagaccggggcaucugugacaaucucaugcgagacugaaggauacaacuucguaaauuauauuauacacugggugaggcggcccccuggucgcggcuuugaguggcucgggaugaucgacccacgaaacggacauccgugguucgcccagacgguccguggcagacuuagucugaggcgggauaccuuuaaagaaacaguguacaugacuuugagcgguuuaaccuccgacgauacagggguuuauuucugugcgcgcaaugagccccaguaccacucucugccuggaauguuugacuauuggggccauggcaccccagugacugucucgucagcuagcacaaagggg

SEQ ID NO: 27289 - RNA, 384 nt, Artificial Sequence
  derived and/or modified sequence opt3 from anti-HIV_Chain
cagggccaacuggugcagagcgggggaggugucaagaaacucggcaccuccguuacaaucucuugccuugccucagaguacacuuucaacgaauuugugauucacuggauaagacaggcucccgggcagggaccucugugguugggcuuaaucaagaggaguggucggcugaugacgagcuaucaauuccaggaccgccuaucccuccgacgugauagaucuaccgggacaguauuuauggagcugaggggacuucggguggacgauacugcagucuacuauugugcccgcgacggccugggcgaaguggcgccagcuuacuuguaugggauugaugccuggggacaggguaccacaguuaucgugaccucggcaucaacuagc

SEQ ID NO: 27290 - RNA, 384 nt, Artificial Sequence
  derived and/or modified sequence opt3 from anti-HIV_Chain
caggugcaacugguccagagcggcgccgagguuaagaaacccggggcuuccgugaagguaucuugcaaagcaucaggauacaccuucacaaguuaugacaucaacugggugagacaggccacuggucagggccucgaauggaugggguggaugaauccuaacagcggaaauacgggcuacgcgcaaaccuuucaggguagggucacaaugacucggaacaccuccauuucuacagcuuauauggagcuuucgucacugcgcagcgaagauaccgccguguacuauugugcacgagaccguugguugccacaguacuauuacuacgggauggauguuuggggacagggcacuacagugaccgucaguuccgccucuacgaagggc

SEQ ID NO: 27291 - RNA, 384 nt, Artificial Sequence
  derived and/or modified sequence opt3 from anti-HIV_Chain
caggugcaacugguccagagcggcgccgagguuaagaaacccggguccucuaugaaggugucaugcaaaaguagcggagguaccuucuccaaccacgcuaucucuuggguaagacaggcaccuggcaaggggcucgaauggaugggaggcauuauaccaaugucggguacaacuaauuaccuucagaaauuucaagggagggugacgaucaccgccgacgaguucgcgacaacugcuuauauggaacugagcucauugaccagugaggauacagccgucuacuauugugcacgggcccgcgcugacucccauaccccgauugaugcauuugacaucuggggacccggcacucgagugauuguuucuagcgccuccacaaagggc

SEQ ID NO: 27292 - RNA, 384 nt, Artificial Sequence
  derived and/or modified sequence opt3 from anti-HIV_Chain
caggugcaacugguccagagcggcgccgagguuaagaaacccggggcuuccgugaagguaucuugcaaagugucaggauacacccucacagaacuuaguauccacugggucagacaggcaccugguaagaggcuggaguggaugggcggguucgacccagaagauggagagcggauuuaugcccagaaauuucaaggccgcgugacuaugacggaagacaccagcacagauacugcguacauggaguugaacuccuuacgaucugacgauaccgcuguuuauuacugugccacaggugggcuguauugcucgucaauaagcuguaucauggacguguggggacagggcaccacugucacagugaguuccgcaucuaccaagggc

SEQ ID NO: 27293 - RNA, 384 nt, Artificial Sequence
  derived and/or modified sequence opt3 from anti-HIV_Chain
caggugcaacugguccagagcggcgccgagguuaagaugcccggggcuuccgugaaaguaucuugcaaggugucaggauacagucucaccgaacuuagcauccacugggucagacaggcaccugguaaaaggcuggaguggaugggcggguucgacccagaagaugacgagcggauuuaugcccagaaguuucaagaucgcgugacaaugacugaagacacguccaccgauacagcguacauggacuugaacucuuuacgaucggaggauacugcuguuuauuacuguaccacaggaggccuguauugcucaagcauaaguuguaucauggacguguggggucaggggaccacugucauuguguccucugccagcacaaaagga

SEQ ID NO: 27294 - RNA, 387 nt, Artificial Sequence
  derived and/or modified sequence opt3 from anti-HIV_Chain
gaggugcagcugagcgaauccggcgggggauucgucaagcccgguggcucucucagacuuucaugcgaggccaguggguuuaccuucaacaauuacgcuaugagcuggguuaggcaagcaccuggaaaaggccuggaauggguguccguaacaucugcccacggugggucggcguauuacggagaguuugugaagggccgguucacuaugucacgcgaccauuuuaucgauacggucuauuuggaaaugaacggcuuaaccguggaggacacagcuguuuacuauugugugcgagucacuuucuaccacgaggggagcggauauuacuaccgugccgguaauuauuuugauaguuggggcaaagggaccagagugguaguuuccgca

SEQ ID NO: 27295 - RNA, 387 nt, Artificial Sequence
  derived and/or modified sequence opt3 from anti-HIV_Chain
gaggugcagcugagcgaauccggcgggggauucgucaagcccgguggcucucucagacuuucaugcgaggccaguggguuuaccuucaacaauuacgcuaugagcuggguuaggcaagcaccuggaaaaggccuggaauggguguccguaacaucugcccacggugggucggcguauuacggagaguuugugaagggccgguucacuaugucacgcgaccauuuuaucgauacggucuauuuggaaaugaaccgauuaaccguggaggacacagcuguuuacuauugugugcgugucacuuucuaccacgagggcagcggguauuacuacagagccggaaauuauuuugauaguugggguaaaggcaccagggugguaguuuccgca

SEQ ID NO: 27296 - RNA, 387 nt, Artificial Sequence
  derived and/or modified sequence opt3 from anti-HIV_Chain
gaggugcagcugagcgaauccggcgggggagucguuaagcccgguggcucucucagacuuucaugcgaggccaguggguucaccuuuagcaacuacgcuauguccugggugaggcaagcaccuggaaaaggccuggaauggguaucugugacaggugggcacggaacuuauggcuacuauggcgaguucgucaaggggcgguuuacgaucucgcgcgaccauucaauggauaccguguacuugcagaugaaucgauuacguguugaagacacagccguguauuacugugucagaacuccauauuaccacgagagcaguggauacuauuacagggcggguaacuauuucgauuuuuggggcaaagggacccuggugauuguauccgcu

SEQ ID NO: 27297 - RNA, 387 nt, Artificial Sequence
  derived and/or modified sequence opt3 from anti-HIV_Chain
gaggugcagcugagcgaauccggcgggggauucgucaagcccgguggcucucucagacuuucaugcgaggccaguggguuuaccuucaacaauuacgcuaugggauggguuaggcaagcaccuggcaaaggucuggaaugggugagcguaacauccgcccacgggggaucugcguauuuuggcgaguucgugaagggccgguuuacuaugucgcgcgaccauuucaucgauacggucuacuuggaaaugaaccgauuaaccguggaggacacagcuguuuauuacugugugcgugucacuuuuuaucacgaggggucaggauacuauuacagagccgguaauuacuucgauagcuggggccaggggacccuggugauuguaagugca

SEQ ID NO: 27298 - RNA, 387 nt, Artificial Sequence
  derived and/or modified sequence opt3 from anti-HIV_Chain
caggugcaacuggucgagagcggcgggggacucguucagcccgguggcucccuuagacugucuugcgccgcuucaggguucaccuuuaguacacacuggaugcauugggugaggcaggcaccuggaaagggcuugguaugggugagccggauccacuccgacggucgcucuacuucguacgccgauucagucaaagggcgauucacgauuagccgugacaacgcgaagaauaccuuauaucugcagaugaacagucuaagagcugaagauacagccguguacuauugugcaaggggagccgcuguuuuuggcguggucauaaucggcgggauggaccucuggggacaagguacuaccgugacaguauccucugcaagcaccaaaggc

SEQ ID NO: 27299 - RNA, 387 nt, Artificial Sequence
  derived and/or modified sequence opt3 from anti-HIV_Chain
caggugcaacuggucgaaagcggcggggcccucguucagcccggagguucccuuagacugucuugcgcugcaucaggcuucaguuuuagcuccuacgccaugucuugggugaggcaggcgccugggaagggauuggaauggguaucggcuaucucacggagcggcgguaguaccuauuacgccgacuccgugaaagggcgcuucacaauuucuauagauaauagcaauaacacuuuauaucugcagaugaacucccuacgagucgaggacacggcaguguacuauugugccaagcgugaggcuuuuuacuauggagcaggcggcuacgggauggauguuuggggacaagguaccacagugacugucucaagugccagcaccaaaggc

SEQ ID NO: 27300 - RNA, 387 nt, Artificial Sequence
  derived and/or modified sequence opt3 from anti-HIV_Chain
uuccagggccaccuggugcaaagcgggggaggugucaagaaacccggcaccuccguuacacucucuugccuugccucagaguacacuuuuacggaguucaccauccauuggauuagacaggcuccugggcagggaccacugugguugggcuuaauaaagaggaguggucggcugaugacaagcuaucgcuuucaggaccgacuaucccuccguagagauaggucuacugggaccguguucauggaacugcggucgcuucgcacagacgauaccgcaguauacuauugugccagagacggacugggcgaauuggcgccggcuuaccacuauggcaucgaugccugggggcaaggaacuacagugauugucaccucagcaagcacgagu

SEQ ID NO: 27301 - RNA, 387 nt, Artificial Sequence
  derived and/or modified sequence opt3 from anti-HIV_Chain
cagggccugcucgugcaaagcgggggaggugucaagaaacuuggcaccuccguuacaaucucuugccuggccucagaguacacuuucaacgaauuugugauucacuggauaagacaggcucccgggcagggaccuuugugguuaggccugaucaagaggaguggucggcuaaugacgagcuaucaguuccaagaccgccucucccugcgacgugauagaucuaccgggacaguauuuauggagcuuaggggacugcggguggacgauacugcagucuacuauugugcccgcgacggcuugggcgaaguggcgccagcuuaccucuaugggauugaugccuggggacaggguaccacaguuaucgugaccucggcaucaacuaaaggc

SEQ ID NO: 27302 - RNA, 387 nt, Artificial Sequence
  derived and/or modified sequence opt3 from anti-HIV_Chain
aacuucaugcugacccagcccgccagcguguccggcucuccugggcaaucaaucacaauuaguugcagcggaacugguuccgacauaggcgucuacaauuauguuucuugguaccagcagcacccagggaaggcuccgagacucaugaucuaugaugugacgaacaggcccucgggaguaucaaaucgguucagcggcaguaaauccgguuucaccgcaucucuuacaauuagcgggcugcagggagacgaugaggccgacuacuauuguuccucauacaguagcacuaacaccuauguguuuggcacaggcacccaugucacuguguuggggcaaccuaaggcgaauccaacaguuaccuuauuucccccuucuuccgaggaacug

SEQ ID NO: 27303 - RNA, 387 nt, Artificial Sequence
  derived and/or modified sequence opt3 from anti-HIV_Chain
cagagcgcccugacccaacccagauccgugucuggcucaccugggcagagugucacaaucagcugcacuggaacguccucugacguuggugcuuacaacuaugugucgugguacaggcagcacccaggcaaggcaccgaaacucaugauuaaugauguaucaaagcggcccagcggggugccugaccgcuucaguggauccaaaucuggcaacaccgccagccuuacaauauccggucugcaggcggaggaugaagcugacuauuacuguugcucauaugccgggacuuacaguuaugucuuuggaaccggcacaaaggugaccguuuugggccaaccaaaagcaaaucccacugugacauuauucccuccaagcucugaggaacug

SEQ ID NO: 27304 - RNA, 387 nt, Artificial Sequence
  derived and/or modified sequence opt3 from anti-HIV_Chain
cagggccaacuggugcagagcgggggaggucucaagaaacccggcaccuccgucacaaucucuugccuugccucagaguacacuuucaacgaauuuguuauucacuggauaagacaggcuccugggcagggaccacugugguugggcuuaaucaagaggaguggucggcugaugacggcauauaauuuccaagaccgccuaagccuccgacgugauagauccaccgggacaguguuuauggagcugaggggacuucggccggacgauacugccguauacuauugugcgcgcgacggccugggcgaaguggcucccgauuacagauaugggauugacgucuggggacaggguucuaccgugaucguuacagccgcaucgaccaaaggc

SEQ ID NO: 27305 - RNA, 387 nt, Artificial Sequence
  derived and/or modified sequence opt3 from anti-HIV_Chain
aacuucaugcugacccagcccccuagcgccuccggcgcuccagggcaaagagugacaaucucuugcucaggagguccgaguaaugucggcgggaacuacguuuauugguacaggcaguuucccggaacugcaccuaaucuccuuauucugcgggacgaucagcgcccaagcggcgugcccgaccgauucuccgccucuaagucggguaacucagcgagcuuggcuauaaguggguuacguccugaugacgaggccuuuuauuucugugcaacguacgauuccgacggaucuaucagacuguuuggcggcgggaccacacuaacuguacucagccagccaaaagccgcucccuccgugacccuguucccuccaucaagugaggaacuu

SEQ ID NO: 27306 - RNA, 387 nt, Artificial Sequence
  derived and/or modified sequence opt3 from anti-HIV_Chain
cagcuggugcucacccaacccccuagcgucuccggcgccccagggcagagaguuacaaucucuugcucaggagguccgaguaacgugggcgggaaucuuguauacugguauaagcaguuccccggaacugcuccuaaacuguugauuaggcgggacgaucagcgcccaagcggcgugcccgaccgauuuuccgguucuaagucggggaacucagcaagccugacgauaaguggacugcguccugaugacgaggccuucuacuuuugugcgaccuaugauucccaaggcucuacaagacuauucggcgggggaacuguccucaccgugcugagccagccaaaagcugcccccuccguuacacuuuuuccuccaucaagugaagaguua

SEQ ID NO: 27307 - RNA, 387 nt, Artificial Sequence
  derived and/or modified sequence opt3 from anti-HIV_Chain
aacuucaugcugacccagcccccuagcguguccggcgccccagggcaaagagucacaaucucuugcucaggagguccgaguaauguuggcgggaaccucguguacugguauaagcaguuucccggaacugcuccuaaacuucugauuaggcgggacgaucagcgcccaagcggcguacccgaccgauucuccgguucuaagucggggaauagcgcaucauuggccauaaguggauuacguccugaugacgaggcguuuuacuucugugcuacguaugauucccacggcucuaucagacuguuuggcgggggaacccuacucacagugcugagccagccaaaagccgcacccuccgucacucuuuucccuccaucaagugaggaacug

SEQ ID NO: 27308 - RNA, 387 nt, Artificial Sequence
  derived and/or modified sequence opt3 from anti-HIV_Chain
cagagcgcccugaccagaacacccuccgugucuggcgcuccugggcaaagggucacuaucucaugcaguggagguccaagcaacguuggcgggaauuacguguauugguaccagcaguucccgggagcagcccccaagcuccuuauucggcgcgacgaucagcgaccuuccggcguaccagaccguuuuucugguucgaaaucagggaacagcgcgagucuggcuauauccggauugagauuagaugacgaggccuauuacuucugugcaacguaugauucuggcuggagcaucaggcuguuuggcgggggaacccggcuaacagugcucucccaacccaaggccgcuccuucagucacucuguucccacccaguagcgaggaacuu

SEQ ID NO: 27309 - RNA, 387 nt, Artificial Sequence
  derived and/or modified sequence opt3 from anti-HIV_Chain
cagagcgcccugacccaacccccuuccgugucugcuacaccaggccagacugucacgaucucaugcagugggagcggauccaacguugguggcaaucacguguacugguauagacagcucccgggggcagcccccacccuucugauuucuaagacagaccauaggccuucgcggguaccagaucgcuucucagcgagcaaaaguggaaacuccgcuucuuuggccauaagcggcuuacgacccgacgaugaggcaaucuacuuuugugccacuuaugacaccggucugucccuacgucucuucgggggaggcacaagacugaccgugcuuucacagccuaaggcugcaccaagugucacucuguuucccccuagcucugaagaguug

SEQ ID NO: 27310 - RNA, 387 nt, Artificial Sequence
  derived and/or modified sequence opt3 from anti-HIV_Chain
caggugcaacugcucgagagcggccccgggcuugucaccccuuccggaacacugucuuuggccugcgcuguuucaggugcaaguaucagcuccucucacugguggacuugggugagacagucgccaggcaagggguuagaauggauuggagagauagacaggcggggcacgaccaacuacaauccgucacugcgcagccgaguaacaauccuacucgauaacaguaaaaaucaguucucccugucucuucguagcgugacugccgcggacaccgcugucuauuacuguacaaagguguaugccggucuguuuaacgaaagaaccuacgggauggauguuuggggacauggcacuacaguguuggucuccucagcaaguaccaaaggc

SEQ ID NO: 27311 - RNA, 387 nt, Artificial Sequence
  derived and/or modified sequence opt3 from anti-HIV_Chain
caggccguggucacccaacccccuagcguuuccgcuacaccaggccagacugugacgaucucuugcucagggaguggaagcaacguagguggcaaucacguguacugguauagacagcugccgggggcagcccccacccuccuuauuuccaagacaaacaggcggccuucucaggucccagaccgcuucucgggaucaaaaagcggcaauagugcgucccuggcuauaucugguuugcgacccgaugacgaggccgauuacuuuugugcaacuuaugacaccgauuuaagccugcgucuauucgggggaggcacaagacucaccgugcugucccaaccuaaggccgcuccaucaguuacucuuuuucccccuaguagcgaggaacug

SEQ ID NO: 27312 - RNA, 387 nt, Artificial Sequence
  derived and/or modified sequence opt3 from anti-HIV_Chain
cagagcgcccugacccaacccccuuccgugucuggcacaccagggcagaacgucacuaucucaugcaguggagguggcagcgacguugggggaaaucucguguccugguaccagcacuucccgggcgcugcacccaaacuucugauucauagagauaaccagaggccuucugguguaccagaccgguuuucggccuugaagucagggaauagcgcgaguuuagcuauauccggacugcgcucugaugacgaggccuucuauuuuugugcaguguacgauagcucccuaucacucggccuguucggcgggggaacgaaacuuaccguccugagucaacccaaggccgcuccuagcgugacauuguuuccacccucuuccgaggaacuc

SEQ ID NO: 27313 - RNA, 387 nt, Artificial Sequence
  derived and/or modified sequence opt3 from anti-HIV_Chain
cagagcgcccugacccaacccccuuccgcuucuggcacaccagggcagagagugacuaucucaugcaguggagguggcagcaacauugggggaaaucucgucuccugguaccagcacuucccgggcacggcacccaaacuucugauauauaggaacgaccagcggccuucugguguuccagaucgcuuuucggggucaaagagcggaaccagugccuccuugacaaucucuggcuuacgaagcgacgaugaggcgacuuacuucugugcugccuaugacuccucacugagucuacgucucuuuggcgggggaaccacacugaaugugcuuagccaacccaaggcagccccuucuguaacccuguucccacccuccucagaagaguug

SEQ ID NO: 27314 - RNA, 387 nt, Artificial Sequence
  derived and/or modified sequence opt3 from anti-HIV_Chain
cagagcgcccugacccaacccccuuccgugucugcuacaccaggccagacugucacgaucucaugcagugggagcggauccaacguugguggcaaucacguguacugguauagacagcucccgggggcagcccccacccuucugauuucuaagacaaaccauaggccuucgcagguaccagaccgguucucagcgagcaaaaguggaaauuccgcuucuuuggccauaagcggcuuacgccccgaugacgaggcagauuacuuuugugguacuuaugacaccucccugucacuacgacucuucgggggaggcacacgucugaccgugcuuagucaaccuaaggccgcuccaagcgucacucuguuucccccuucuuccgaagaguug

SEQ ID NO: 27315 - RNA, 387 nt, Artificial Sequence
  derived and/or modified sequence opt3 from anti-HIV_Chain
cagagcgugcugacccaaguccucuccguuucuggcacacccgggcagagagugaucauuucaugcaguggaacuagcuccaacguagguggcaaucuugugucuugguaccagcaucugccuggggccgcuccaagguuguuaauacaccgggacgaucagcgcccgucgggaguccccgaccgauucucaggcagcaagagugguaacuccgcaucucuggugaucagcgggcuacguuccgaugacgaggccgauuauuuuuguggagcguacgacucaacguucagucucccuguuuuuggcggcgggaccagacugacagugcuuagccaaccaaaagcugcccccucugucacucuguucccuccauccucagaagaguug

SEQ ID NO: 27316 - RNA, 387 nt, Artificial Sequence
  derived and/or modified sequence opt3 from anti-HIV_Chain
cagagcgcccugacccaacccccugcuacauccggcacuccagggcagagagugacgaucucuugcucaggagguggcaguaacgucgggggaaaucucguuagcugguaccagcaguucccgggcgcagcccccaaacuuauucugcacagggacggucaacggccuuccggggugccagaucgcuuuucugcgucgaagucaggaaccagcgcuaguuugacaauauccggcuuacgaucugacgaugaggccacuuauuucugugcagccuuugacagcgcucugucccuaccccucuucggcgggggaaccaagcugacaguacuuucacagccuaaagcagccccaagugugacccuguuucccccuagcucugaagaguug

SEQ ID NO: 27317 - RNA, 387 nt, Artificial Sequence
  derived and/or modified sequence opt3 from anti-HIV_Chain
cagcuggugcucacccaacccccuagcgucuccgccacaccaggccagacuguuacgaucucuugcucagggaguggaagcaacguggguggcaaucacguauacugguauagacagcuuccgggggcugcacccacccuggugauuuccaagacagaccauaggccuucucgggucccagaucgcuucucgggaucaaaaagcggcaacagugccuccuuggcgauaucugguuuacgacccgacgaugaggcugccuacuuuugugcaacuuaugacaccgggcugagccuacgucucuucggaggcggcacaagacuggccgugcuuucccagccuaaggcugcaccaucaguuacccuguuucccccuaguagcgaagaguug

SEQ ID NO: 27318 - RNA, 387 nt, Artificial Sequence
  derived and/or modified sequence opt3 from anti-HIV_Chain
cagagcgcccugacccaacccccuuccgugucuggcacaccagggcagaacgucacuaucucaugcaguggagguggcagcaauguugggggaaaccucguguccugguaccagcacuucccgggcgcugcacccaaacuucugauucauagagacaaucagaggccuucugguguaccagaucgguuuucgguguugaagucagggaacagcgccaguuuagcgauauccggaccccgcucugacgaugaggcuuucuauuuuugugccgucuacgacagcucccugucacuaggccucuucggcgggggaacgaagcugaccgugcuuagucaaccuaaagcagccccaagcguuacacuguuucccccuucuuccgaagaguug

SEQ ID NO: 27319 - RNA, 387 nt, Artificial Sequence
  derived and/or modified sequence opt3 from anti-HIV_Chain
cagaccguggucacacaacccccuagcgccuccggcacuccagggcagagaguuacgaucucuugcucaggagguggcaguaacauugggggaaaucuggugagcugguaccagcacuucccgggcgcugcacccaagcuccuuauauauaggaacgaccagcggccuuccgguguaccagaucgcuuuucugggucgaaaucaggaaccagcgccagucugacaaucuccggcuugcgaucugacgaugaggcgacuuacuucugugcugccuaugacugcaccuuaagccugcgucuauuuggcgggggaacaacccucaaugugcugucccaacccaaggcagccccuucagucacucuuuucccacccaguagcgaggaacug

SEQ ID NO: 27320 - RNA, 387 nt, Artificial Sequence
  derived and/or modified sequence opt3 from anti-HIV_Chain
cagagcgcccugacccaaacacccuccgugucuggcgcuccugggcagagagucacuaucucaugcaguggagguccaagcaacguuggcgggaauuacguguauugguaccagcaguucccgggagcagcccccaagcuccuuauuaggcgggacgaucaacgcccuuccggcguaccagaccgauuuucugguucgaaaucagggaacagcgcgagucuggcuauauccggauugcguuuagaugacgaggccuauuacuucugugcaacguaugauucuggcuggagcaucagacuguuuggcgggggaaccaggcuaacagugcucucccagcccaaggccgcuccuucagucacucuguucccacccaguagcgaggaacuu

SEQ ID NO: 27321 - RNA, 387 nt, Artificial Sequence
  derived and/or modified sequence opt3 from anti-HIV_Chain
cagagcgugcugacccaacccccuuccgccucuggcgcuccagggcagagagucacaaucucaugcaguggagguccgagcaacguuggcgggaauuacguguauugguacaggcaguuccccggaacugcaccuaaccuccuuauucugcgggacgaucagcgcccauccggcguacccgaccgauuuucugccucgaagucagguaauagcgcgaguuuggcuauauccggguuacguccugaugacgaggccuucuauuuuugugcaacguacgauucugacggaagcgugagacuguucggcggcgggaccacacuaacuguccucucccaaccaaaagccgcucccucagugacccuguuuccuccaaguaacggagguagg

SEQ ID NO: 27322 - RNA, 387 nt, Artificial Sequence
  derived and/or modified sequence opt3 from anti-HIV_Chain
cagggccaacuggugcagagcgggggaggugucaagaaacccggcaccuccguuacaaucucuugccucgccucagaguacacuuucaacgaauuugugauucacuggauaagacaggcuccugggcagggaccacuuuggcugggcuugaucaagaggaguggucgguuaaugacgagcuauaaauuccaagaccgccugaaucuacgacgugauagauccaccgggacaguauuuauggagcucaggggacugcggccggacgauacugcaguguacuauugugcccgcgacggccuuggcgaagucgcgcccgauuacagauaugggauugacguguggggacaggguucuaccguuaucgugacagcugccucgaccaagggc

SEQ ID NO: 27323 - RNA, 387 nt, Artificial Sequence
  derived and/or modified sequence opt3 from anti-HIV_Chain
gaggugcagcuggucgaaagcggcgccgagguuaagaaacccggggcuuccgugaagguagcaugcaaagugucuggaaagaaacucucagaccuuaguauccacugggucagacaagccccugguaagggccuggaauggaugggaggguucgaugaggaagacggcaagauuagcuacgagaggaaauuucagggucgggugaccaugacagaggauacugcgcgcgacacggcuuucauggaaauguccucuuugcgaucggaugacaccgccguuuauuuuugugcagccgcuccacguuuagaucugggggagcuaucaagcggauuccauuuuuggggccucggcacacuggugagugucuccucugcaagcacuaagggg

SEQ ID NO: 27324 - RNA, 387 nt, Artificial Sequence
  derived and/or modified sequence opt3 from anti-HIV_Chain
cagggccaacuggugcagagcgggggagguggcaagaaacucgggaccuccgucacaaucucuugccuugccucagaguacacuuucaacgaauuuguuauucacuggauaagacaggcucccggacagggcccucugugguuggguuuaaucaagaggagugggcggcugaugacgagcuaucaauuccaggaccgccuaucccuccgacgugauagaucuaccggaacaguguuuauggagcugaggggccuucggguagacgauacugcaguguacuauugugcccgcgacggccugggggaagucgcgccagcuuacuuguauggaauugaugccuggggucagggcaccacagugaucguuucgucagcaagcaccaaaggg

SEQ ID NO: 27325 - RNA, 387 nt, Artificial Sequence
  derived and/or modified sequence opt3 from anti-HIV_Chain
gaggugcagcuggucgaaagcggcgccgagguuaagaaacccggggcuuccgugaagguaucuugcaaagugucaggauacacccucagugaccuuagcaugcacugggucagacaagcaccugguaagggccuggaauggaugggaggguucgaugaggaagacggcgagaucacauaugcccagaaauuucaggguaggguguccaugacugaggauacgucucgggacaccgcguacauggaauugucgucauuacgcagcgaggauacagcuguuuauuacugugccacugcaccacgacuggaacuaggggagcucaguuccggauuccauuauuggggccugggcacccuugugacagucucuagcgccuccaccaagggg

SEQ ID NO: 27326 - RNA, 387 nt, Artificial Sequence
  derived and/or modified sequence opt3 from anti-HIV_Chain
cagggccaacuggugcagagcgggggaggugucaagaaaaccggcacauccguuacuaucucuugccucgccucagaguacacguucaccgaauuuacaauucacuggauaagacaggcucccgggcagggaccucuuuggcugggcuugaucaagaggaguggucgguuaaugacugcaaaccgcuuccaagaccgacugagccuacguagagauagguccaccgggacaguguuuauggagcuccggucucugcgcauugacgauaccgccguauauuacugugcgagagacggacuuggcgaacuggcuccagccuaucauuacggcaucgaugugugggggcagggaacuacaauuaucgucaccucggcaucaacgaaaggu

SEQ ID NO: 27327 - RNA, 387 nt, Artificial Sequence
  derived and/or modified sequence opt3 from anti-HIV_Chain
cagggccaacuggugcagagcgggggaggugucaagaaacucggcaccuccguuacaaucucuugccuugccucagaguacacuuucaacgaauuugugauucacuggauaagacaggcucccgggcagggaccucugugguugggcuuaaucaagaggaguggucggcugaugacgagcuaucaauuccaggaccgccuaucccuccgacgugauagaucuaccgggacaguauuuauggagcugaggggacuucggguggacgauacugcagucuacuauugugcccgcgacggccugggcgaaguggcgccagcuuacuuguaugggauugaugccuggggacaggguaccacaguuaucgugaccucggcaucaacuaaaggc

SEQ ID NO: 27328 - RNA, 387 nt, Artificial Sequence
  derived and/or modified sequence opt3 from anti-HIV_Chain
cagggccaacuggugcagagcgggggaggugucaagaaacucggcaccuccguuacaauccccugccuugccucugaguacacuuucaacgaauuugugauucacuggauaagacaggcuccugggcagggaccacugugguugggcuuaaucaagaggucaggucggcugaugacgaguuaucaauuccaggaccgccuaagccuccgacgugauagauccaccgggacaguauuuauggagcugaggggacuucggguggacgauacugcagucuacuauugugcccgcgacggccugggcgaaguggcgccggcuuacuuguaugggauugaugccuggggacaggguaccacaguuaucgugaccucugcaucgacuaaaggc

SEQ ID NO: 27329 - RNA, 387 nt, Artificial Sequence
  derived and/or modified sequence opt3 from anti-HIV_Chain
cagggccaacuggugcagagcgggggaggugucaagaaacccggcaccuccguuacaaucucuugccucgccucagaguacacuuucaacgaauuugugauucacuggauaagacaggcuccugggcagggaccaguauggcuuggccugaucaagaggaguggucgguugaugacgagcuauaaauuccaagaccgcuuaucccugcgacgugauagaucuaccgggacaguguuuauggagcuaaggggacuccggcuggacgauacugcagucuacuauugugcccgcgacggccuuggcgaaguggcgccggcuuaccuguaugggauugaugccuggggacaggguucgaagguuaucgugacccccgcaucaacaaaaggc

SEQ ID NO: 27330 - RNA, 387 nt, Artificial Sequence
  derived and/or modified sequence opt3 from anti-HIV_Chain
caggccagacuggaccaauggggcaccgggcuccuuaagcccagcgagacacuguccuugaaaugcgcuguguucggagucuuauuuacugauuacaacuggacguggguuaggcagucuccugguaaggaacuggaguggaucggccaccuagaccaucgcgggggaggcaauuauaacccaucacucgaaagucgggugaccauuagccuggauuacuccaaagcacaguucucucuucaccugaagucgguaacaguggccgacacugcgcgauauuacugugcuggugccgucaaaggguuuugguucgaugacccguauaccugguuuggacccuggucacagggcacauuggugaccguugcaagcgccaguacuaagggc

SEQ ID NO: 27331 - RNA, 387 nt, Artificial Sequence
  derived and/or modified sequence opt3 from anti-HIV_Chain
caggccagacuggaccaauggggcaccgggcuccuuaagcccagcgagacacuguccuugaaaugcgcuguguucggagucuuauuuacugauuacaacuggacguggguuaggcagucuccugguaagggccuggaauggaucgggcaccuagaccaucggggaggcgguucauauaauccaagucucgagagccgcguguccauuucucuggauuacucgaaagcacaguucucacuucaccugaaaagcguaaccguggccgacacagcguuguauuacugugcuggggccgucaagggauuuugguucgaugaaccgaguacuugguuuggccccuggucccagggcaccauggugacaguugcaucugccagcaccaagggg

SEQ ID NO: 27332 - RNA, 387 nt, Artificial Sequence
  derived and/or modified sequence opt3 from anti-HIV_Chain
cagggccaccuggugcaaagcgggggaggugucaagaaacucggcaccuccguuacaaucucuugccuugccucagaggacacuuucaacgaauuugugauucauuggauaagacaggcucccgggcagggaccucugugguugggcuuaaucaagaggaguggucggcugaugacgagcuaccaguuccaagaucgccuaucccuccgacgugacagaucuaccgggacaguauuuauggagcugaggggacuucggguggaugacacugcagucuauuacugugcccgcgauggccugggcgaaguggcgccagcuuauuuguacgggauugacgccuggggacaggguaccacaguuaucgugaccucggcaucaacuaaaggc

SEQ ID NO: 27333 - RNA, 387 nt, Artificial Sequence
  derived and/or modified sequence opt3 from anti-HIV_Chain
caggugcaacugguccagagcgaggccgaaguuaagaaacccggcuccucugugaagguaucaugcaaagcuagugggggaaccuucagagguuacacaaucagcugggugaggcaggcaccuggccaggggcucgaguggaugggacggauuauaccaauccuuggcaaggccauuuaugcgccguccuuucaaggucgcgucacucugacggcugacaaaucuaccgggacagccuacauggaauugucgcgauuacguucagaugacacugcaguguauuacugugccaagguuaagaugagaggaagcaguggcuauuacuaucuguucgaugacuggggccaggggacccuagugacagucuccucugcuagcaccaaagga

SEQ ID NO: 27334 - RNA, 387 nt, Artificial Sequence
  derived and/or modified sequence opt3 from anti-HIV_Chain
caggccagacuggaccaauggggcaccgggcuccuuaagcccagcgagacacuguccuugaaaugcgcuguguucggagucuuauuuacugauuacaacuggacguggguuaggcagucuccugguaagggccuggaauggaucgggcaccuagaccaucggggaggcgguaauuauaacccaucacucgagagucgcgugaccauuagccuggauuacuccaaagcacaguucucucuucaccugaagucgguaacaguggccgacacugcguuguauuacugugcuggggccgucaaaggauuuugguucgaugaaguguauaauugguuuggcccguggucacagggcacccucguuacaguggcaagcgccaguaccaagggg

SEQ ID NO: 27335 - RNA, 387 nt, Artificial Sequence
  derived and/or modified sequence opt3 from anti-HIV_Chain
cagggccaacuggugcagagcgggggaggugucaagaaacccggcaccuccguuacaaucucuugccucgccucagaguacacuuucacggaauuuaccauucacuggauaagacaggcuccugggcagggaccacuuuggcugggcuugaucaagaggaguggucgguuaaugacagcauaucgcuuccaagaccgacugagccuacguagagauagguccacugggaccguguuuauggagcuccggaaccugcgcauggacgauacagccguauacuauugugcgagagacggacuuggcgaacuggcuccggccuaccaguauggcauugaugugugggggcagggaaccacugucaucgugucuucggcaucaacaaaaggu

SEQ ID NO: 27336 - RNA, 387 nt, Artificial Sequence
  derived and/or modified sequence opt3 from anti-HIV_Chain
caggugagacugguccaaagcggcccccagguuaagaggccuggggccuccauccggcucucuugcgagucaaguggauaccgcuuccaggacuauauuguggcuuggauacgacagacccguggucaaggcuuugaguucguagggauggugaacccaagaggaggcaggccguggcccagcucccgguuucgcgauagagucacacuuacuagggacaucgaaucugaaacguucuaccuggguuugaaugauuuaaccucggacgauacagcaacuuauuuuugugcccggcuggaggcggacgggucagauuacagcccuaaaauguucgacuuuuggggacagggcaccaagauugugguuaguccagcuuccacaaaaggc

SEQ ID NO: 27337 - RNA, 387 nt, Artificial Sequence
  derived and/or modified sequence opt3 from anti-HIV_Chain
caggugagacugguccaaagcggcccccagguuaagaccccuggggccuccaugagggugucuugcgaggcuucaggauaccgguuccucgacuauaucauuguauggauacgccagacacacggucagcauuuugaauacgugggcaugaucaacccacgagggggaacuccguggcccaguagcaaauuccgugauagacuuucccugacgagggacauucacaccgauacauuuuauuugggcuuaaauaaccuggguucugacgauacugcaaucuacuucugugcccggcuagaggcggacggggaugacuauucgccuaagauguuugaucauuggggacaaggcacccgcauuaucgucucagcugccagcacaaaaggc

SEQ ID NO: 27338 - RNA, 387 nt, Artificial Sequence
  derived and/or modified sequence opt3 from anti-HIV_Chain
caggugagacugguccaaagcggcccccagguuaagaccccuggggccuccaucaggcucucuugcgaggcuucaggauaccgguuccuugacuauuuuauuguguggguacgccagacaccaggucagggcuucgaauacguggggaugauaaacccgcgaggaggccgucccuggaguagcuggaaauuuagagauaggcuguccuugacucgggagaucgacacggauaccuucuauuuaggucugucuaaucuacgcucggacgauacagcaauuuacuuuugugccagacucgaagcggacggggaugacuauucaccuaagauggucgauuacuggggacaaggcacuaaaaucauugugagcgcugccaguaccaagggc

SEQ ID NO: 27339 - RNA, 387 nt, Artificial Sequence
  derived and/or modified sequence opt3 from anti-HIV_Chain
caggugagacugguccaaagcggcccccagguuaagaggccuggggccuccauccggcucucuugcgagaccucaggauaccgcuuccaggacuauauuguggcuuggauacgacagacacguggucaaagauuugaguucguaggcauggugaacccaaggggagggcggccguggcccaguagcaaauuucgcgauagagucacucuuacgagggacaucgaauccgaaaccuuccaccugggcuugaaugauuuaacaucugacgauacugcaaccuacuuuugugcccggcuggaggcggacggugcugauuauucgccuaagauguucgacuuuugggggcagggaacaaaaauugugguuucaccagccagcaccaagggc

SEQ ID NO: 27340 - RNA, 387 nt, Artificial Sequence
  derived and/or modified sequence opt3 from anti-HIV_Chain
caggugagacugguccaaagcggcccccagguuaagaccccuggggccuccaugaggaucucuugcgaggcuucaggauaccgguuccaggacuauauuauaguguggauccgccagacacacggucaaggcuuugaauacguagggaugauuaacccacgaggaggcacuccguggaguagcuccaaauuccgugauagacucucucuuacgagggacaucuauaccgauacauuuuaccuggguuugaauaacuuagggucggacgauacugcaauuuauuucugugcccggcuggaggcggacggaggcgauuacucacccaagauguuugacuauuggggccaggggacccgcaucauagugagcgcugccaguacaaaagga

SEQ ID NO: 27341 - RNA, 387 nt, Artificial Sequence
  derived and/or modified sequence opt3 from anti-HIV_Chain
cagggccaacuggugcagagcgggggaggugucaagaaacccggcgccuccguuaccaucucuugccucgcuucagaguacacauucaacgaauuugugauucacuggauaagacaggcaccugggcagggaccacuuuggcugggcuugaucaagaggaguggucgguuaaugacugccuauaaauuccaagaccgccugagccuacgacgugauagauccacggggaccguauuuauggagcucaggggacugcggccggaagacacagcgguguacuauugugcucgcgauggccuuggcgaggucgcccccgacuacagauaugggauugauguguggggacaggguucuacuguuaucgugucggcagccucaaccaagggc

SEQ ID NO: 27342 - RNA, 387 nt, Artificial Sequence
  derived and/or modified sequence opt3 from anti-HIV_Chain
caggugagacugguccaaagcggcccccagaugaagaccccuggggccucccucaggcuuucuugcgagguuucaggauaccgguuccuggacuauuuuaucguguggguacgccagacagguggccagggguucgaauacgugggaaugauuaacccacgaggcggucguccguggaguagcuggaaauuuagagauagguuguccuuaacucgggacauagagacggauaccuucuaucuggggcuaaauaaccuccgcucugacgauacagcuaucuacuuuugugcaagacuggaagccgacggagauaauuauucgcccaagauggucgacuacuggggccaaggcacuaaaauuaucgugagcccugcgucaaccaagggg

SEQ ID NO: 27343 - RNA, 387 nt, Artificial Sequence
  derived and/or modified sequence opt3 from anti-HIV_Chain
caggugagccugguccaauccggcccccagguuaagaccccuggggccucuaugagagugucaugcgagacaaguggauacagguuccucgacuauaucauuguauggauacggcagacucacggucagcauuuugaauacgugggcaugaucaacccacgcgggggaacgccguggcccagcuccaaauuccgagaucgucuuaccaugacaagagacauucacacugauaccuuuuaucugggcuugaauaacuuaaggucugacgauacagcuaucuacuucugugcacggcuggaggccgacggugaugacuauucgccuaagauguuugauuacugggggcaaggaacccgcauuaucgucucagcggcuagcacuaaaggc

SEQ ID NO: 27344 - RNA, 387 nt, Artificial Sequence
  derived and/or modified sequence opt3 from anti-HIV_Chain
caggugagacugguccaaagcggcccccagguuaagaccgccggggcuuccaugagggugucuugcgaggcaucaggauaccgguuccucgacuauaucauuguauggauacgccagacacacggucagcauuuugaauacgugggcaugaucaacccucgagggggaacuccauggccgaguagcaaauuccgugauagacuuacgcugaccagggacauuuauacagauacuuuuuacuugggcuuaaauaaccuggguuccggggacaccgccaucuauuucugugcgcggcuagaggcugauggagacgauuacucucccaagauguuugacuauuggggccaaggcacacgcauuaucgucucggccgcaucaaccaaaggg

SEQ ID NO: 27345 - RNA, 387 nt, Artificial Sequence
  derived and/or modified sequence opt3 from anti-HIV_Chain
cagggccaacuggugcagagcgggggaggugucaagaaacccggcaccuccguuacaaucucuugccucgccucagaguacacuuucaacgaauuugugauucacuggauaagacaggcuccugggcagggaccaguauggcuuggccugaucaagaggaguggucgguugaugacgagcuauaaauuccaagaccgcuuaucccugcgacgugauagaucuaccgggacaguguuuauggagcuaaggggacuccggcuggacgauacugcagucuacuauugugcccgcgacggccuuggcgaaguggcgccggcuuaccuguaugggauugaugccuggggacaggguucgaccguuaucgugacaucagcaagcaccaagggc

SEQ ID NO: 27346 - RNA, 387 nt, Artificial Sequence
  derived and/or modified sequence opt3 from anti-HIV_Chain
cagggccaacuggugcagagcgggggaggucucaagaaacccggcaccuccgucacaaucucuugccuugccucagaguacacuuucaacgaauuuguuauucacuggauaagacaggcuccugggcagggaccacugugguugggcuuaaucaagaggaguggucggcugaugacggcauauaauuuccaagaccgccuacgacuccguagagauaggagcaccgggacaguguuuauggagcugcggggacuucgcccggacgauacugccguauacuauugugcgagagacggccugggcgaaguggcucccgauuacagguaugggauugacgucuggggacaggguuccaccgugaucguuacagccgcaucuaccaaaggc

SEQ ID NO: 27347 - RNA, 387 nt, Artificial Sequence
  derived and/or modified sequence opt3 from anti-HIV_Chain
cagggccaccuggugcaaagcgggggaggugucaagaaacucggcaccuccguuacaaucucuugccuugugucagaguacacuuucaacgaauuuguaauucauuggauaagacaggcccccgggcagggaccucugugguugggcuuaaucaagaggaguggucggcugaugacgagcuaucaguuccaagaccgccuaucccuccgacgugauagaucuaccgggacaguguuuauggagcugaggggacuucgggucgacgauacugcuguguacuauugugcacgcgacggccugggcgaaguugccccagcguacuuguaugggauugaugcuuggggacaggguaccacagugaucgucaccucggccucaacuaaaggc

SEQ ID NO: 27348 - RNA, 387 nt, Artificial Sequence
  derived and/or modified sequence opt3 from anti-HIV_Chain
cagggccaacuggugcagagcgggggaggugucaagaaacucggcaccuccguuacaaucucuugccuugccucagaguacacuuucaacgaauuugugauucacuggauaagacaggcucccgggcagggaccucugugguugggcuuaaucaagaggaguggucggcugaugacgagcuaucaauuccaggaccgccuaucccuccgacgugauagaucuaccgggacaguauuuauggagcugaggggacuucggguggacgauacugcagucuacuauugugcccgcgacggccugggcgaaguggcgccagcuuacuuguaugggauugaugccuggggacaggguaccacaguuaucgugucgucagcaagcaccaaaggc

SEQ ID NO: 27349 - RNA, 387 nt, Artificial Sequence
  derived and/or modified sequence opt3 from anti-HIV_Chain
cagggccaccuggugcaaagcgggggaggugucaagaaacucggcaccuccguuacaaucucuugccuugccucagaguacacuuucaacgaauuugugauucauuggauaagacaggcucccgggcagggaccucugugguugggcuuaaucaagaggaguggucggcugaugacgagcuaucaguuccaagaccgccuaucccuccgacgugauagaucuaccgggacaguauuuauggagcugaggggacuucggguggacgauacugcagucuacuauugugcccgcgacggccugggcgaaguggcgccagcuuacuuguaugggauugaugccuggggacaggguaccacaguuaucgugaccucggcaucaacuaaaggc

SEQ ID NO: 27350 - RNA, 387 nt, Artificial Sequence
  derived and/or modified sequence opt3 from anti-HIV_Chain
caggugcaacugguccagagcggcuccgagcucaagaaacccggggccucuguuaaggugucaugcaaagcuaguggauacaccuucacaagcuaugcaaucaacuggguaagacaggccccuggucagggccuugaauggaugggguggauuaauacuaacacgggaaauccaaccuacgcgcaaggcuuuacagguagguucguguuuucccuggagacuucugucucgaccgcuuauuugcagauaaacucauuaaaggccgaagacacagcaguguacuauugugcccgggaucugcuagagagccgcaccuacuauaaugacauccgagauugcugggggcagggaacucucguuacagugaguuccgcuucuaccaaaggc

SEQ ID NO: 27351 - RNA, 387 nt, Artificial Sequence
  derived and/or modified sequence opt3 from anti-HIV_Chain
caggugcaacugguccagagcggcgccgagguuaagaaacccggggcuuccgugaagguaucuugcaaagcaucaggauacaccuucacagacuauuacauccacugggugagacaggccccuggucagggccucgaauggaugggguggauuaacccaaguacuggaggcacgaauuuuguccaaaaguuccuugguagggugaccaugacaagcgauacuuccauaaacaccgcguauauggagcugcggcgcuugaaaaaugacgaugcugccaucuacuauugugcaacauacucuacccgacaguuuuuccauuauuacuacguuacugacgugugggggcagggaacaaccgucacggugucgucagccagcacuaagggc

SEQ ID NO: 27352 - RNA, 387 nt, Artificial Sequence
  derived and/or modified sequence opt3 from anti-HIV_Chain
uuccagggccaacuggugcagagcgggggaggugucaagaaacccggcuccucuguuaccaucucaugccucgccagugaguacacauuuacugaguucacgauucacuggauaagacaggcuccugggcagggaccacuuuggcugggcuugaucaagaggagcggucgguuaaugaccuccuauggguuucaagaccgccugucugugcgacgugauagaucgacaggaacuguauucauggaacuaaggucacuccggaccgacgauacagcaguguacuauugugcccgcgacggccugggcgaacuugcgccggcuuaccauuaugggauugaugucuggggacaggguaccacugugaucguuacaagcgccaguaccucc

SEQ ID NO: 27353 - RNA, 387 nt, Artificial Sequence
  derived and/or modified sequence opt3 from anti-HIV_Chain
caggugcaacuggucgagagcggcgggggaguugugcagcccgguagaucccucaggcuuucuugcgccgcuucaggcuucaccuuuaguagcuacgcaaugcacuggguacggcaggccccugggaagggacuggaauggguggcggucaucuccuaugacggcucuaacaaauacuaugcugauucggugaagggucgcuucacaauuucacgagacgauagcaaaaguacuguuuacuugcagauaaauuccuuacgugccgcagacacggccguguauuuuugugcuagagaagggggacugagguuccuagaguggcucuuuuggggccaaggcacccuggucacagugucuagcggggaguccucagcaaguacuaaggga

SEQ ID NO: 27354 - RNA, 390 nt, Artificial Sequence
  derived and/or modified sequence opt3 from anti-HIV_Chain
caggugcaacugguccagagcggcgccguugugaagucccccgggucuucagcuaaacucaguugcagacuucugggagacgaguucgguaccuacuuuaucagcuggauuaggcaggcaccuggccggggguuggaauggguaggaggcauagugccacacucccaguuacaaucuucggcccagaaguuccauggucgcuuuuucaucacagggggagucacuccgcccauuaucuuucugcagcuaacgaacgugaccuucgaggauacaggcacuuauuuuugugcgcgagaacguggcagacacagggacccuaaaaccgggaagucacuccggggacgcuacuucgauuuuugggguagaggcacagggguuaccgugagccca

SEQ ID NO: 27355 - RNA, 390 nt, Artificial Sequence
  derived and/or modified sequence opt3 from anti-HIV_Chain
cagaucgagcugagacaaagcggcgccgcuaugaagucccccgggucuucagugaaacucaguugcaccguccuuggagaaaacuucgguacauacuuuauuagcuggauaaggcaggcaccuggccaggggcuggaguggguuggaggcaucgugccacacucccaguugcaaucuucggcccagaaguuccauggucggauuaaaaucucagggggaggcacuccgcccguagugagcuuagaacugacgaaugucaccuuugacgauacaggcacuuauuucugugcgcgcgagcgagggcgucacguggaaccuaagaccggagacagacuagcugguagguacuuugauauuuggggccgggggacaggacuccgcguuagucca

SEQ ID NO: 27356 - RNA, 390 nt, Artificial Sequence
  derived and/or modified sequence opt3 from anti-HIV_Chain
gaggugcagcuggucgaaagcggcgggggacucguuaagcccgguggcucccuuagacugucuugcgaggccucaggguucaccuuuacaaacgcuuggaugaauugggugaggcaagcaccuggaaaaggcuuggaauggguaggucggaucaagagucagacucacgggggaacgacccgcuacgccgcgccagugaaaggccgauucacaauuagccgugacgauuccaagcauacuuuauaucugcagauggacagacuaaccacagaggauaccgcugucuacuauuguacuggcacaauaaccgggucuacguuuuacuauuacggaauggacguguggggucagggcacuaccguuacagugucgccggccucaacuaaaggg

SEQ ID NO: 27357 - RNA, 390 nt, Artificial Sequence
  derived and/or modified sequence opt3 from anti-HIV_Chain
gugguccagcugguucaaagcggccccgggcucgugaagccuucccagacccuuucucugacaugcacuguaucaggagguaguaucagcuccggcgacuucuacuggucuuggauuagacagccaccggggaaaggauuggaguggauaggcuauaucuacuauucggguucaacguacuauaaccccagcuuaaagaguaggcugaccauuuccguggauacaucuaaaaaucaguuuagccuacggcucuccucagucacugccgcugacaccgcaguguacuauugugcccgcgaucugaacagucgaaucguuggggcgcuugacgcuuucgauauuuggggacaaggcacaauggugaccgucagcucugccuccacuaagggc

SEQ ID NO: 27358 - RNA, 390 nt, Artificial Sequence
  derived and/or modified sequence opt3 from anti-HIV_Chain
gaggugcagcugguccaaagcggcgggggacucguucagcccgguagaucccuuaggcugucuugcgccgcuucaggcuucaccuuugacgauuacgcaaugcacugggugcggcaggccccugggaagggauuggaauggguaaguggcaucagcuggaacuccgguacaauuggguaugcggacucugugcgcggacgauucacuauaucgcgugaugacgcuaaaagcucauuauaccugcagaugaauagucuaagaacggaggauaccgcccucuauuacugugcaaaggacggcugggucggcuccgggucuagcacacugaggggauccgauuauuggggucaaggcacucuugugaccguuucaagugccagcacaaaaggg

SEQ ID NO: 27359 - RNA, 390 nt, Artificial Sequence
  derived and/or modified sequence opt3 from anti-HIV_Chain
cagagcgugcugacccaacccccuuccgccucuggcucaccagggcagaguaucacaauuagcugcacuggaacguccucugacgucgguggcuacaacuauguuucgugguaccagcagccgcccgggaaggcuccuaaagugauaaucuaugagguaucaaagagaccaagcggagugcccgauagguucaguggcuccaaaucugguaauaccgcaagccucacagucuccgggcuucaagccgaagacgaggcggauuacuauuguucaaguuacgcuggaagcaacaauuuuguguucggcacuggcaccgaaguuacaguggucgggcagccuaaggccaacccaaccgugacucuguuucccccuucuuccgaggaauuguua

SEQ ID NO: 27360 - RNA, 390 nt, Artificial Sequence
  derived and/or modified sequence opt3 from anti-HIV_Chain
caggccguggucacccaagagcccagccugacaguuuccccuggcgggacugugacgcuuaccugcgcuucuucaacaggagcaguaacaagugguuucuacccacacugguuucagcagaagccgggccaggcccccagagcgcuuaucuauagcaccuccaacagguacucuuggacuccugcucgguucucggggucacuguugggaggcaaagccgcauuaacccugagcggugugcaaccagaagacgaggccgaauauuacugucuacuccugcccuauuacgggggaccuuggauuuuuggcggcgggacuaagcucacaguccugggacagccaaaagcugcacccagugugaccuuguucccuccauccucugaggaacuc

SEQ ID NO: 27361 - RNA, 390 nt, Artificial Sequence
  derived and/or modified sequence opt3 from anti-HIV_Chain
cagagcgcccugacccaacccccuuccgcuucuggcgcaccagggcagagagugacaaucucaugcaguggagguccgagcaacgucggcgggaauuacguuuauugguacaggcaguuccccggaacugccccuacgcuccuuauucugcgggacgaucagcgcccauccggcgugcccgaccgauuuucugcgucgaagucagguaacagcgcuaguuuggccauauccggguuacguccugaugacgagggauucuauuuuugugcaaccuacgauucugacggcagcaucagacuguucggcgggggaacagcccuaacuguacucucccaaccaaaagcugcacccucagugacccuguuuccuccaaguagcgaggaacuuaag

SEQ ID NO: 27362 - RNA, 390 nt, Artificial Sequence
  derived and/or modified sequence opt3 from anti-HIV_Chain
caggugcaacuggucgagagcggcuccgacguuagaaagcccggggccaccgugacaguaucuugcaaagcugaugaagacgaggaugacuucacugcauacaacuauuuuaugcacugggugaggcaggccccuggacauggucucgaauggaucggcuggauuaauccacggacggggcagccgaaccacgcgaagcaguuccaaggacgcgucacccuuacacgagagcguucaaccaguacuguguuuaugaaacugacaaauuugagauuagaugacaccgcuguuuacuucugugccaggccccugcggggcggugauacuuggcauuaucacagcugggggcgcggaacaucccuaaccgugucuucggcaucaacgaagggc

SEQ ID NO: 27363 - RNA, 390 nt, Artificial Sequence
  derived and/or modified sequence opt3 from anti-HIV_Chain
gaggugcagcuggucgaaagcggcuccgacguuagaaagcccggggccaccgugacaguaucuugcaaagcugaugaggacgaagaugacuucacugcauacaacuauuuuaugcacugggugaggcaagccccuggacauggucucgaguggaucggcuggauuaauccacggacggggcagccgaaccacgcgaagcaguuccagggacgcgucacccuuacacgagaacguucaaccaguacuguguuuaugaaacugacaaauuugagauuagaugacaccgcuguuuacuucugugccaggccccugcggggcggugauacuuggcauuaucacagcugggggcgcggaacaucccuaaccgugucuucggcaucaacgaagggc

SEQ ID NO: 27364 - RNA, 390 nt, Artificial Sequence
  derived and/or modified sequence opt3 from anti-HIV_Chain
gaggugcagcugguccaaagcggcuccgacguuagaaagcccggggccaccgugacaguaucuugcaaagcugaugaagacgaggaugacuucacugcauacgauuauuuuaugcacugggugaggcaggccccuggacauggucucgaauggaucggcuggauuaacccacggacggggcagccgaaucacgcgaagcaguuccaaggacgcgucacccuuacacgagagcguucaaccaguacuguguuuaugaaacugacaaacuugagauuagacgauaccgcuguuuacuucugugccaggccccugcggggcggugacacuuggcauuaucacagcugggggcgcggaacaucccuaaccgugucuucggcaucaacgaagggc

SEQ ID NO: 27365 - RNA, 390 nt, Artificial Sequence
  derived and/or modified sequence opt3 from anti-HIV_Chain
caggugcaacugguccagagcggcuccgacguuagaaagcccggggccaccgugacaguaucuugcaaagcugaugaggacgaagaugacuucacugcauacaacuauuuuaugcacugggugaggcaggccccuggacauggucucgaguggaucggcuggauuaauccacggacggggcagccgaaccacgcgaagcaauuccagggacgcgucacccuuacacgagaacguucaaccaguacuguguuuaugaaacugacaaauuugagauuagaugacaccgcuguuuacuucugugccaggccccugcggggcggugauacuuggcauuaucacagcugggggcgcggaacaucccuaaccgugucuucggcaucaacgaagggc

SEQ ID NO: 27366 - RNA, 390 nt, Artificial Sequence
  derived and/or modified sequence opt3 from anti-HIV_Chain
caggugcaacugguccagagcggcuccgacguuagaaagcccggggccaccgugacaguaucuugcaaagcugaugaggacgaagaugacuucacugcauacaacuauuuuaugcacugggugaggcaggccccuggacauggucucgaguggaucggcuggauuaauccacggacggggcagccgaaccacgcgaagcaauuccagggacgcgucacccuuacacgagaacguucaaccaguacuguguuuaugaaacugacaaauuugagauuagaugacaccgcuguuuacuucugugccaggccccugcggggcggugauacuuggcauuaucacagccgcgggagaggaacaucccuaaccgugucuucggcaucaacgaagggc

SEQ ID NO: 27367 - RNA, 390 nt, Artificial Sequence
  derived and/or modified sequence opt3 from anti-HIV_Chain
gaggugcagcuggucgaaagcggcuccgacguuagaaagcccggggccaccgugacaguaucuugcaaagcugaugaggacgaagaugacuucacugcauacaacuauuuuaugcacugggugaggcaagccccuggacagggucucgaguggaucggcuggauuaauccacggacggggcagccgaaccaugcgaagcaguuccaaggacgcgucacccuuacacgagaacguucaaccaguacuguguuuaugaaacugacaaauuugagauuagaugacaccgcuguuuacuucugugccaggccccugcggggcggugauacuuggcacuaucauagcugggggcgcggaacaucccuaaccgugucuucggcaucaacgaagggc

SEQ ID NO: 27368 - RNA, 390 nt, Artificial Sequence
  derived and/or modified sequence opt3 from anti-HIV_Chain
gugguccagcugguucaaagcggcuccgacgugagaaagcccggggccaccguaacagugucuugcaaagcugaugaggacgaagaugacuucacugcauacaacuauuuuaugcacugggucaggcaggccccuggacauggucucgaguggaucggcuggauuaauccacggacggggcagccgaaccacgcgaagcaguuccaaggacgcgugacccuuacacgagaacguucaaccaguacuguuuuuaugaaacugacaaauuugagauuagaugacaccgcuguguacuucugugccaggccccugcggggcggugauacuuggcauuaucacagcugggggcgcggaacaucccuaaccgucucuucggcaucaacgaagggc

SEQ ID NO: 27369 - RNA, 390 nt, Artificial Sequence
  derived and/or modified sequence opt3 from anti-HIV_Chain
gaggugcagcugguccaaagcggcuccgacguuagaaagcccggggccaccgugacaguaucuugcaaagcugaugaagacgaggaugacuucacugcauacaacuauuuuaugcacugggugaggcaggccccuggacauggucucgaauggaucggcuggauuaauccacggacggggcagccgaaccacgcgaagcaguuccaaggacgcgucacccuuacacgagagcguucaaccaguacuguguuuaugaaacugacaaauuugagauuagaugacaccgcuguuuacuucugugccaggccccugcggggcggugauacuuggcauuaucacagcugggggcgcggaacaucccuaaccgugucuucggcaucaacgaagggc

SEQ ID NO: 27370 - RNA, 390 nt, Artificial Sequence
  derived and/or modified sequence opt3 from anti-HIV_Chain
gaggugcagcugguccaaagcggcuccgacguuaagaaacccgggaccacagugacuaucucuugcaaggccgaugaagacgaggaugacuucacggcuuacaacuauuuuaugcacuggguaagacaggcaccuggacagggucucgaauggauuggcuggauaaauccaaggaccgggcagccgaaccaugccaaacaacuucagggacgggugacacugacucgcgagcgaucaaccaguacagucuucaugaaguugaccaauuuacgucuggaugacacugcgguguacuuuugugcuagaccccuaaggggcggugauacauggcacuaucauagcugggggcggggaaccucccucaucguuucuucggccucaacgaaaggc

SEQ ID NO: 27371 - RNA, 390 nt, Artificial Sequence
  derived and/or modified sequence opt3 from anti-HIV_Chain
caggugcaacuggucgagagcggcgggggacucguuaagcccgguggcucccuuagacugucuugcgccgcuucaggguucaguuuuaacgaauacuauaugagcuggaucaggcaggcaccuggacagggcuuggaguggguggccaauauugguuccucugacgcguacaccauauaugcugauucgguaaaagggcgguucacaaucucacgcgacaacgccgaaaauacuguguacuuacagaugaacagccugcgaggagaggauacggcagucuauuacugugcccguauugaaggcuauugcaguaauuccagauguucuaacuacuuugacccauggggccaaggggcucuagugaccguuagcuccgcaucaacaaaggga

SEQ ID NO: 27372 - RNA, 390 nt, Artificial Sequence
  derived and/or modified sequence opt3 from anti-HIV_Chain
caggugcaacugguccagagcggcgccgagguuaagaaacccggggcuuccgugaagguaucuugcaaagugucaggauacccucucgcagaacuuaguguccacugggugagacagguuccagguaagggccuggagugggucgggggauucgacccggaagagggcaaaaccguguaugcccagaaguuucaagguagggugacaaugacugaagaucggagcacggacaccguauacauggaguugaucuccuuacgcuaugaggauacagcgguuuacuauugugcuacugacaaccccgugcugcagcuaggggaacucucuucgucacuggauuacuggggacagggcacccuugucacagugagcagugccuccaccaagggc

SEQ ID NO: 27373 - RNA, 390 nt, Artificial Sequence
  derived and/or modified sequence opt3 from anti-HIV_Chain
gaggugcagcugguccaaagcggcgccgaaguuaagaaacccggggagucccucagaaucucuugcaagaccucaggauacaacuucaaugacgauuggauugcuugggugaggcagcggccugacaaagguccagaauggaugggcauauuuuauccgggggauagucaggcaacauacagccccuccuuccagggacacguaacuuuuucugccgacacgucgaucucaaccgcguaucuucaauggacaagccugaaggcuagugauacugccauuuacuauugugcacgcacccgaugcuucggcgccaacuguuuuaauuucauggacgugugggguaaagggacagcuuugaccgucacuguguccucugcaagcacaaaggga

SEQ ID NO: 27374 - RNA, 390 nt, Artificial Sequence
  derived and/or modified sequence opt3 from anti-HIV_Chain
caggugcaacugguccagcuccuucagagcggcgccgagguuaagaaacccggguccucugugaagguaucaugccagaucaguggauacgguuucagcaacuaugcuauuuccugggugagacaagcaccuggccaggggcuggaaugguugggaaggauagucccagccgugggcaugaccgaguacgcgcagaaauuucagggucggguuacauucacugcugaccgcucuacgaucaccgccuauauggauuuacgagggcugcguucggacgauacagcaguguacuauugugucagagacccgcaaguggaaguaaggggaaaugccuuugauauuuggggccagggcacuaugguuaccgugucaagcgcuaguacaaagggg

SEQ ID NO: 27375 - RNA, 390 nt, Artificial Sequence
  derived and/or modified sequence opt3 from anti-HIV_Chain
caggugcaucugcaacaguggggcgccgggcuccuuaagcccagcgagacccuguccuugacaugcgcugucucuggagguucauucaguggcuuuuucuggacuuggaucagacagagcccugggaaaggauuagaauggauuggcgagguuaaccacuccgguuuuacgcacucuaauccaucgcuggaaucaagggcaaccauaagcguggccgcgaguaacacacaguucucccuacggcucgcuucuguaacugccgcagacaccgccaucuacuuuugugcucugcgcuauuucgauuggagcccguuucgacgugacacauacgggaccgauguguggggacaaggcacuacagucauuguguccucagcaaguaccaagggc

SEQ ID NO: 27376 - RNA, 390 nt, Artificial Sequence
  derived and/or modified sequence opt3 from anti-HIV_Chain
caggugagacuggagcaaagcggcggggcccucagaaagcccggagcuuccgucacccuuucuugccaggcaucagguuacaacuucguuaaauauaucauucacugggugcggcagcgcccuggccugggguuugaauggguaggaaugauagacccauaccgaggccguccgugguaugcccauaguuucgcggguagauugagcuuauccagggauacaucuacugagacgcuguacaugacccuaucgucacucaagagcgacgauacagcuacuuauuuuugugcccgggcagaagccgcuagugacucccacucucgccccaucauggauuggaccuggaggauucugugccuucuggcaguggucccugccagcacaaaaggg

SEQ ID NO: 27377 - RNA, 390 nt, Artificial Sequence
  derived and/or modified sequence opt3 from anti-HIV_Chain
caggugagacuggagcaaagcggcgccgcugucaggaagcccggggcauccguuacccucucuugccaggccucaggauacaacuucgugaauuauaucauucacuggguacggcagcgcccuggucuugacuuugaaugggugggcaugauagauccauaccgagggcguccguggagugcgcauaaauuccagggaagacugagcuuguccagggacgucucuacagagaucuuauauaugacucugaacucgcuacggucagaugacacggcuaccuacuuuugugcccgcgcagaagccgagagccaaagucacuccagacccauuauguucgauucuuggggccaggguagcagggugacaguuuccucagcuaguacuaagggg

SEQ ID NO: 27378 - RNA, 390 nt, Artificial Sequence
  derived and/or modified sequence opt3 from anti-HIV_Chain
caggugagacuggagcaaagcggcgccgcugucaagaaacccggggcauccguuaccaucucuugccaggccucaggauacaacuucgugaaguuuuucauucacuggguaaggcagcggccuggucagggcuuugaauggguggggaugauagagccauaucgcggacgaccguggagugcgggcaauuuccaaggucgucucagccuuuccagagacgucucuacagaaacucuguacaugacguugaacaauuuaaggucggaugacaccgcuguguauuuuugugcccggcuggaggcagaaucagauagccauagucgccccaucauguucgaccacugggggcauggaucccuaguuacagugucuagcgccuccacuaaaggc

SEQ ID NO: 27379 - RNA, 390 nt, Artificial Sequence
  derived and/or modified sequence opt3 from anti-HIV_Chain
caggugagacuggagcaaagcggcgccgcugucaggaagcccggggcauccguuacccucucuugccaggccucaggauacaacuucgugaauuauaucauucacuggguacggcagcgcccuggucuugacuuugaaugggugggcaugauagauccauaccgagggcguccguggagugcgcauaaauucgagggaagacugagcuuguccagggacgucucuacagaaguguuauauaugacucugucgucacuacggagcgaugacacggcuaccuacuuuugugcccgcgcagaggccgaaagucagucccacucuagacccaucauguucgauuauuggggccaagguagcaggguuacaguguccucagcuaguacuaagggg

SEQ ID NO: 27380 - RNA, 390 nt, Artificial Sequence
  derived and/or modified sequence opt3 from anti-HIV_Chain
caggugagacuggagcaaagcggcaccgccgucaggaagcccggggcuuccguuacaaucucuugccaggcaucaggauacaacuucgugaaauuuuucauucacgguguacggcagcgcccuggccagggguuugaaugggugggaaugauagagccauuccgaggccguccguggagugccgguaauuuucaagggagacucagccuuuccagggacgucucuacugaaacgcuguauaugaccuugaacaauuuacggucggaugacacagcgguguacuucugugcucgccuggaggccgaaucagauagccauaguagacccaucauguuugaccacuggggacauggcucccuaguuacugugucuagcgcauccaccaagggc

SEQ ID NO: 27381 - RNA, 390 nt, Artificial Sequence
  derived and/or modified sequence opt3 from anti-HIV_Chain
caggugagacuggagcaaagcggcaccgccaugaggaagcccggggcuuccgucacacucucuugccaggcaucaggauacaacuucguuaaauauaucgugcacuggguacggcagaagccuggucuuggcuuugaauggguggggaugauugacccauaccgcggacgaccguggagugcccauaaauuccagggccgucugagcuuguccagagauacuucuauggagauauuauauaugacgcugaccucgcuaaagucagacgauacagcgacuuacuuuugugcuagggccgaagcagccagcgacagucacucccggcccaucauguucgaucauuggggucaagggucucgcgucaccgugagcuccgcuucaacaaaagga

SEQ ID NO: 27382 - RNA, 390 nt, Artificial Sequence
  derived and/or modified sequence opt3 from anti-HIV_Chain
caggugagacuggagcaaagcggcgccgcuaugaggaagcccggggcauccgucacccucucuugccaggccucaggauacaacuucguuaaauauaucgugcacuggguacggcagaagccuggucuuggcuuugaauggguggggaugauugacccauaccgcggacgaccguggagugcgcauaaauuccagggccgucugagcuuguccagagauacaucuauggagauauuauauaugacucugacgucgcuaaagucagacgauaccgcuacauacuuuugugccagggcagaagccgcuagcgacagucacucccggcccaucauguucgaucauuggggucaagggucucgcgucacugugagcuccgcaucaaccaaagga

SEQ ID NO: 27383 - RNA, 390 nt, Artificial Sequence
  derived and/or modified sequence opt3 from anti-HIV_Chain
caggugagacuggagcaaagcggcgccgcuaugaggaagcccggggcauccgucacccucucuugccaggccucaggauacaacuucguuaaauauaucauucacugggugcggcagaagccuggucuuggcuuugaauggguagggaugauagacccauaccgcggacgaccguggagugcgcauaaauuccagggccgucugagcuuguccagagauacaucuauggagaucuuauauaugacucugacgucgcuaaagucagacgauaccgcuacauacuuuugugccagggcagaagccgcuagcgacagucacucccggcccauuauguucgaucauuggggucaagggucucgcgugacugucagcuccgcaucaaccaaagga

SEQ ID NO: 27384 - RNA, 390 nt, Artificial Sequence
  derived and/or modified sequence opt3 from anti-HIV_Chain
caggugagacuggagcaaagcggcaacgccgucaggaagcccggggcuuccguuaccaucucuugccaggcaucaggauacaauuucgugaaauuuuucauucacuggguacggcagcgcccuggucagggcuuugaauggguggggaugauagagccauuccgaggacguccguggagugccggcaacuuucaagguagacucagccuuuccagggacgucucuacagaaacucuguauaugacguugaauaacuuacggucggaugacaccgcgguguacuucugugcucgccuggaggccgaaucagauagccauaguagacccaucauguuugaccacugggggcauggaucccuaguuacagugucuagcgcauccacuaagggc

SEQ ID NO: 27385 - RNA, 390 nt, Artificial Sequence
  derived and/or modified sequence opt3 from anti-HIV_Chain
caggugagacuggagcaaagcggcgccgcugucaggaagcccggggcauccguuacccucucuugccaggccucaggauacaacuucgugcgguauaucauucacuggguacgccagcgaccuggucuugacuuugaaugggugggcaugauagauccauaccgugggagaccguggagugcgcauaaauucggaggcaggcugagcuugacacgggacgucuccacugagaucuuauauaugacgcugaccucucuacgcucggaugacacagcuacuuacuuuugugccagagcagaagccgagucacagagccacaguaggcccauuauguucgauuccuggggucaagggucucgggugaccguuagcuccgcuucaacaaaggga

SEQ ID NO: 27386 - RNA, 390 nt, Artificial Sequence
  derived and/or modified sequence opt3 from anti-HIV_Chain
caggugagacuggagcaaagcggcgccgcugucaggaagcccggggcauccguuacccucucuugccaggccucaggauacaacuucgugaauuauaucauucacuggguacggcagcgcccuggucuugacuuugaaugggugggcaugauagauccauaccgagggcguccguggagugcgcauaaauuccagggaagacugagcuuguccagggacgucucuacagagaucuuauauaugacucugucgucacuacggagcgaugacacggcuaccuacuuuugugcccgcgcagaagccgagagucaaucccacucuagacccauuauguucgauuuuuggggccaggguagcagggugacaguuuccucagcuaguacuaagggg

SEQ ID NO: 27387 - RNA, 390 nt, Artificial Sequence
  derived and/or modified sequence opt3 from anti-HIV_Chain
caggugagacuggagcaaagcggcaccgccgucaggaagcccggggcuuccguuacaaucucuugccaggcaucaggauacaacuucgugaaauuuuucauucacuggguacggcagcgcccuggucagggcuuugaauggguggggaugauagagccauuccgaggacguccguggagugccggcaauuuucaagguagacucagccuuuccagggacgucucuacugaaacgcuguauaugaccuugaacaauuuacggucggaugacacagcgguguacuucugugcucgccuggaggccgaaucagauagccauaguagacccaucauguuugaccacugggggcauggaucccuaguuacugugucuagcgcauccaccaagggc

SEQ ID NO: 27388 - RNA, 390 nt, Artificial Sequence
  derived and/or modified sequence opt3 from anti-HIV_Chain
caggugagacuggagcaaagcggcgccgcuaugaggaagcccggggcauccgucacccucucuugccaggccucaggauacaacuucguuaaauauaucgugcacuggguacggcagaagccuggucuuggcuuugaauggguggggaugauugacccauaccgcggacgaccguggagugcgcauaaauuccagggccgucugagcuuguccagagauacaucuauggagauauuauauaugacucugacgucgcuaaccucagacgauacagcuacuuacuuuugugccagggcagaagccgcuagcgacagucacucccggcccaucauguucgaucauuggggucaagggucucgcgucaccgugagcuccgcaucaacaaaggga

SEQ ID NO: 27389 - RNA, 390 nt, Artificial Sequence
  derived and/or modified sequence opt3 from anti-HIV_Chain
gaggugcagcugguccaaagcggcgggggacucguucagcccgguggcucccuuagacugucuugcgccgcuucaggguugaccuucaggaauuuugcaaugaguugggugcggcaggccccuggaaagggcuuagaauggguaagcuccaucucugguucagggggaucgacauacuaugcggacagcgugaaaggccgcuucacuauuagucgagauaauuccaagaacacgcuguaccuacagaugaacucucuccguggcgaggacaccgcugucuauuuuugugccaaaggggugggauacgauauacugacaggucuuggcgacgcauucgauaucugggggcaaggaacuguuguggccgucagcuccgcuucaaccaagggc

SEQ ID NO: 27390 - RNA, 393 nt, Artificial Sequence
  derived and/or modified sequence opt3 from anti-HIV_Chain
caggugcaacugguccagagcggcgccgcuguuagaaagcccggggcauccgugaccguaucuugcaaauucgccgaggacgaugacuacucaccucacugggugaacccagcgccggaacauuauauccacuuucucaggcaggcucccggacagcaacuugaguggcuggccuggaugaauccuacaaacggugcagucaauuacgccuggcaguugcauggccgguuaacugcuacgcgcgaugggaguaugaccacagcauuccuggaagugcgaagccuacguuccgacgauacugccguuuauuacugugcuagagcccagaagaggggacggucugagugggcguaugcacacuggggccaggguaccccagugcucgucucguca

SEQ ID NO: 27391 - RNA, 393 nt, Artificial Sequence
  derived and/or modified sequence opt3 from anti-HIV_Chain
caggugcaacugcagcaguggggcgccgggcuccuuaagcccagcgagacccuguccuugacaugcgcugucuacgcaggaucuuucucagguuauuacuggacuuggaucagacagccuccaggcaaaggguuagaauggauuggagagguuaaccacggcgguaguacgaauuauaacccgagccugaaguccagggugacccuaucuguagacacaucgaaaaaucaauuuucacucaagcugacuagcgugaccgccgcggauacagcugucuacuauugugcccgggugagucgcuacgacuucugguccgggaacuauggaucuuacggccuugauguuuggggccaggggaccacugugacagucagcuccgcaucaaccaaagga

SEQ ID NO: 27392 - RNA, 393 nt, Artificial Sequence
  derived and/or modified sequence opt3 from anti-HIV_Chain
gaggugcagcugguccaaagcggcgggggaguugugcagcccgguagaucccucaggcuuucuugcguagugucaggcuucaccuuuaguagcuucacauuucacuggguccggcaggccccugggaagggacuggaauggguggcuggcauguccuuccaugcaacuuacaucuauuacgccgacucuguuaaaggucgcuuuacgauuucgcgagaugacucacaggauaccuuguauuuagagauggacagccugcguagugaagauacagcgauauacuauugugcuagagacccagggauccacgauuacggagacuaugccccgggcgcauucgauuacuggggccaagggucccccgugacugucucuagcgccuccaccaaggga

SEQ ID NO: 27393 - RNA, 393 nt, Artificial Sequence
  derived and/or modified sequence opt3 from anti-HIV_Chain
caggugcaacugguccagagcggcaccgagguucagaagcccggggccuccgugaaaguaucuugcaagacaucaggauacacuuucaguaaauauuacauccacugggugagacaggcuccuggucaaggccucgaaugggucgggaggauuaacacggacagcggaggcaccgauuaugcagagaaguuucagggucgggugacaaugacucgcgacaccuccauaacaaccguuuaccuugaaaugcgagggcugacuucugaugacacagccgcguucuauugugcucguggaccaccgcaugccggcggcuggaccaucuacuauuacggguuggauguguggggacaggguacgucggucauugugucaagcgcaaguacuaaaggc

SEQ ID NO: 27394 - RNA, 393 nt, Artificial Sequence
  derived and/or modified sequence opt3 from anti-HIV_Chain
agaaccguggucacacagcccccuagcguuuccggcgccccagggcaaagggugacuaucucuugcacgggaucaaguagcaacauuggugcuggcuacgacguacacugguaucagcagcugccggggaccgcacccaagcuccuuauauacggaaauuccaaccggccuucuggcgugccagaucgcuucucggguucaaaaagcgggacaagugccucccuggcgaucacuggauugcaggcugaggacgaagccgauuauuacugucaaucuuaugacagcuccuuaucaggcaguggcgucuuugggaccggaacaaaggugaccguucugggucagcccaaagcaaauccuacugugacacuauucccacccagcucugaggaacuc

SEQ ID NO: 27395 - RNA, 393 nt, Artificial Sequence
  derived and/or modified sequence opt3 from anti-HIV_Chain
caggugcagcugcagcaguggggcagcgggcuccuuaagcccuccgagacccugucuuugacaugcgccgucuacggagguucauucagaaguuauuacuggaacuggaucaggcagagcccuggcaaaggguuagaauggauuggagagguuucccacucuggcucgacuaauuauaacccagcucugaagucacgggugacgauaagcguagacaccaguaaaaaucaauuuucccuaaaggugaaaucugucacagcagccgauacugcgcucuacuauuguagccgcggucgagggaagcguugcuccggagcuuacuguuucgccggcuauuuugacucauggggccaagggggacuggugguugugaguagcgcaucuaccaagggu

SEQ ID NO: 27396 - RNA, 393 nt, Artificial Sequence
  derived and/or modified sequence opt3 from anti-HIV_Chain
caggugcaccugguccaaagcggcgccgagguuaagaaacccggguccucugugagaguaucaugcgaagcuaguggauggaccuucgguagcgugaacuccgcaaucacaugggucaggcaggccccuggccaggggcucgaguggaugggacggacuauuccauuucuuggcauaucuaauuacgcgcagaaguuccaaggucgcgugacgaucaccgcugacaaaucgacaaacauugccuauguugaugugacuucacugaccagccaggacacagcagucuacuauugugcccgauugaucaccgggaugacugcuccgugguuuuacuauauggauguguggggaaagggcacaaccguaacgguuaguuccgcaucuacuaaaggc

SEQ ID NO: 27397 - RNA, 393 nt, Artificial Sequence
  derived and/or modified sequence opt3 from anti-HIV_Chain
caggugcaucugcaagagagcggccccagacucgucagguccucugaaacccuuucacugacaugcaguguuccugggggaagcaucgugaacccaauuacuaauuacuauugguccuggauacggcagucuccgcgcaaggguuugcaguggaucggcgacauuuacuauacggggaccucgucacgaaaccccagcuuagauagucguguauccaucucuauggacgugagcagaaaacagauuucccugacacuauacucagucacugccgcugauaccgcagugcacuauugugccagucaaagccucucuugguacaggccuuccggauauuucgagucauggggccaggguauccugguuacagugagcagugcgucuaccaagggg

SEQ ID NO: 27398 - RNA, 393 nt, Artificial Sequence
  derived and/or modified sequence opt3 from anti-HIV_LightChain
augaagcugcccgugagacuccuuguccugauguucuggaucccugccagcuccucugacauuguuaugacccagucaccauugaguuuaccggugacacccggcgagccugcuagcauauccugcaggucuucgcaacggcugcuaucaagcuacgggcacacuuaucuccauugguaccugcagaaaccaggacagaguccccagcuucugaucuaugaaguauccaaccgcuuuucuggugugccugaucgauucagcggcuccgggucaggaacggacuuuaccuugaagauuagucgugucgaggcagaagaugugggcguuuacuauuguagccaaucuacacacgugccacucacuuucggucaggggaccaaagucgagaucaag

SEQ ID NO: 27399 - RNA, 396 nt, Artificial Sequence
  derived and/or modified sequence opt3 from anti-HIV_Chain
caggugcaacugcaggagagcggccccgggcucgucaagccuuccgaaacccuuucuguuacaugcucagugaguggagacagcaugaacaauuacuauuggacuuggaucagacaguccccagguaaaggccuggaguggauuggguacauaucugauagggccucggcuacguauaacccgucauugaauagccggguagugaucagucgcgacaccuccaagaaccaguuaucucugaaacuaaauagcgucacacccgcagauacugccguguacuauugugcgaccgcucgacguggacaaagaauuuacggcguuguguccuucggugaauuuuucuauuacuacucaauggacgucugggggaagggaacaaccgugacuguaaguagc

SEQ ID NO: 27400 - RNA, 396 nt, Artificial Sequence
  derived and/or modified sequence opt3 from anti-HIV_Chain
caggugcaacugcaggagagcggccccgggcucgucaagccuccagaaacccuuucccugacaugcucuguuucaggagccagugugaacgacgcuuacuggagcuggaucagacaguccccggguaaaaggcccgaguggguaggcuaugugcaccauucuggggauacuaauuacaacccuucguugaagcggcgcgucacguucucauuagacaccgccaaaaaugaagugagccugaagcuaguugcacucacagcggcugauagugccguguauuuuugugcacgagcccugcacggaaaacguauuuacggcauagucgcucuuggugagcuguucacuuauuuuuacauggacgugugggggaagggaaccacaguaaccguuuccucu

SEQ ID NO: 27401 - RNA, 396 nt, Artificial Sequence
  derived and/or modified sequence opt3 from anti-HIV_Chain
caggugcaacugcaggagagcggccccgggcucgucaagccuuccgaaacccuuucucugacaugcucaguuaguggagccagcaucuccgacucuuacuggucguggauuagaaggucaccagguaaaggcuuggaguggauaggguaugugcacaagagcggagauacuaacuacaguccguccuuaaaaucucggguaaaucugagccuagacacguccaagaaccaggugucacucagucuggucgcugcaaccgccgcggauagcggcaaauauuacugugcucgcacacuucauggucgacguaucuaugggauuguggccuucaaugaaugguuuacuuacuucuauauggacguuuggggaaacggcacccaggugacagucucuucc

SEQ ID NO: 27402 - RNA, 396 nt, Artificial Sequence
  derived and/or modified sequence opt3 from anti-HIV_Chain
caggugcaucugcaagagagcggccccgggcucgucaagccuuccgaaacccuuucucugacaugcaacguuucaggaacuuuggugagagacaauuacuggaguuggaugaggcagccauuagguaaacagccggaguggaucggcuauguacacgauagcggggacacgaacuacaaucccucccugaagucucgggugcaccuaucgcucgauaaaucaaacaaucuggucagccuucgccugaccgccgugacagcugcagacagugccacuuauuacugugcgaccacaaagcauggacgacguauuuauggcauaguugcuuucaacgaaugguuuaccuacuucuauauggaugugugggguaaagggacuacagucaccguguccucu

SEQ ID NO: 27403 - RNA, 396 nt, Artificial Sequence
  derived and/or modified sequence opt3 from anti-HIV_Chain
caggugcaacugcaggagagcggccccgggcucgucaagccuuccgaaacccuuucuguuacaugcucagugaguggagacagcaugaacaauuacuauuggacuuggaucagacaguccccagguaaaggccuggaguggauuggguacauaucugauagggaaucggccacguauaacccgucauugaauagccggguagugaucagucgcgacaccuccacaaaccaguuaucucugaagcuaaauagcgucacucccgcugauaccgcaguguacuauugugccacagcgcgacguggacaaagaauuuacggcguuguguccuucggugaguuuuucuauuacuacucaauggacgucugggggaggggaaccacugugacaguaaguagc

SEQ ID NO: 27404 - RNA, 396 nt, Artificial Sequence
  derived and/or modified sequence opt3 from anti-HIV_Chain
caggugcaacuggucgagagcggccccgggcucguuaccccuuccgaaacacuuucucugacuugcacggugucaaacggaaguguaagcgguagauucugguccuggaucaggcagucuccaggccggggguuggaguggauuggauacuuuucggacaccgaucgcucagaauauagcccgaguuuacgaucccgucugacacuaucucucgacgccagcagaaaucagcugucccuuaagcugaaaucagugacugcugcagauagugccaccuacuauugugcgagggcucagcaaggcaagcggauauacgguaucgucagcuucggggaguuuuucuauuacuauuacauggacgccuggggaaaaggcacagcagugaccguuucuucc

SEQ ID NO: 27405 - RNA, 396 nt, Artificial Sequence
  derived and/or modified sequence opt3 from anti-HIV_Chain
caggugcaacugcaggagagcggccccgggcucgucaagccuccagaaacccuuucccugacaugcucuguuucaggagccaguaucaacgacgcuuacuggagcuggauuagacaguccccggguaaaaggcccgagugggugggcuauguacaccauucuggggauacuaauuacaacccuucguugaagcggcgcgugacguucucauuagacaccgccaaaaaugaagucagccugaagcuaguggaucucacagcagcggacagugcuguuuauuuuugugcccgagcacugcacggaaaacguauauacggcaucguggcccuuggugagcuguucacuuauuuuuacauggaugucugggggaagggaaccacagugaccguauccucu

SEQ ID NO: 27406 - RNA, 396 nt, Artificial Sequence
  derived and/or modified sequence opt3 from anti-HIV_Chain
caggugcaacugcaggagagcggccccgggcucgucaagccuccagaaacccuuucccugacaugcucuguuucaggagccaguaucaacgacgcuuacuggagcuggauuagacaguccccggguaaaaggcccgagugggugggcuauguacaccauucuggggauacuaauuacaacccuucguugaagcggcgcgugucauucagcuuagacacggccaaaaaugaagucagucugaagcuaguggaucucaccgcagcggacuccgcuauauauuuuugugcccgagcacugcacggaaaacguaucuacggcauuguugcccuuggugagcuguucacauauuuuuacauggaugugugggggaagggaacuaccgucacagugucuagc

SEQ ID NO: 27407 - RNA, 396 nt, Artificial Sequence
  derived and/or modified sequence opt3 from anti-HIV_Chain
caggugcaacugcaggagagcggccccgggcucgucaagccuuccgaaacccuuucuguuacaugcucagugaguggagacagcaugaacaauuccuacuggacuuggaucagacagucuccagguaaaggccuggaguggauuggguauauaucgaagucagaaagcgccaacuacaauccgaguuugaacuccaggguagugaucucucgggauacgagcaaaaaucaguuaucccugaagcuaaacucagucacccccgcugacacagcaguguauuacugugccacugcgcgccacggacaacgaauuuauggcguugugaguuucggugaguuuuucaccuacuauagcauggaugucugggggaaaggaacaaccgugacuguaucuucc

SEQ ID NO: 27408 - RNA, 396 nt, Artificial Sequence
  derived and/or modified sequence opt3 from anti-HIV_Chain
caggugcaacugcaggagagcggccccgggcucgucaagccuuccgaaacccuuucucugacaugcucaguuaguaacggaagcguguccgguagauucuggucuuggaucaggcagucgccaggccggggguuggaguggauuggauacuuuucagacacugagaaaagcaauuauaacccgaguuuacgcucccgacugacgcuaucuguagaugccagcaagaaucagcucucccugaaacuuaacucagugaccgcugcagacagugccacauacuauugugcgcguacucaacagggcaagagaauauacggugucgugagcuucggggaauuuuuccacuauuacuauauggaugcuuggggaaaaggcaccgccguuacagugucuucc

SEQ ID NO: 27409 - RNA, 396 nt, Artificial Sequence
  derived and/or modified sequence opt3 from anti-HIV_Chain
caggugcaacugguccagagcggcaccgcccucaagucccccgggucuucagcuaaacuuaguugcacaguucugggagacgaguucgguacuuacuuuaucagcuggauuagacaggcaccuggccagggguuggaaugggugggaggcauaguaccacacucccaauuacagucuucggcccagaaguuccaugguaggaucauuaucucagcgggggcuggagugacgccgcccgucgugagccugcagcuaaccaaccucacauuugaggauacuggcaccuauuucugugcccgggaacgcggccgacaccgugacccuaaaacaggggaugcacugagaggaagguacuuugacuucuggggucggggcaccgggguuaguguguccgcc

SEQ ID NO: 27410 - RNA, 396 nt, Artificial Sequence
  derived and/or modified sequence opt3 from anti-HIV_Chain
caggugcaacugguccagagcggcaccgcccucaagucccccgggucuucagcuaaacuuaguugcacaguucugggagacgaguucgguacuuacuuuaucagcuggauuagacaggcaccuggccagggguuggaaugggugggaggcauaguaccacacucccaauuacagucuucggcccagaaguuccaugguaggaucauuaucucagcgggggcuggagugacgccgcccgucgugagccugcagcuaaccaaccucacauuugaggauacuggcaccuauuucugugcccgggaacgcggccgacaccgugacccuaaaacagggaaggcaccaagaggaagguacuuugauuucuggggucggggcaccgggguuacugugagugcc

SEQ ID NO: 27411 - RNA, 396 nt, Artificial Sequence
  derived and/or modified sequence opt3 from anti-HIV_Chain
caggugcaacugguccagagcggcaccgcccucaagucccccgggucuucagcuaaacuuaguugcacaguucugggagacgaguucgguacuuacuuuaucagcuggauuagacaggcaccuggccagggguuggaaugggugggaggcauaguaccacacucccaauuacagucuucggcccagaaguuccaugguaggaucacgauuucagcgggggcuggagugaccccgcccgucgugagccugcagcuaacaaaccucacuuuugaggauaccggcacauauuucugugcccgggaacgcggccgacaccgugacccuaaaaccggggaugcacugagaggaagguacuuugacuucuggggucggggcacugggguucgcgugaguaca

SEQ ID NO: 27412 - RNA, 396 nt, Artificial Sequence
  derived and/or modified sequence opt3 from anti-HIV_Chain
caggugcaacugguccagagcggcgccgcuguuaagucccccgggucuucagcaaaacucaguugcaccgugcuuggagacgaguucgguacauacuuuaucagcuggauuagacaggccccuggccaggggcuggaauggguaggaggcauagugccacacucccaauugcagucuucggcgcagagguuccauggucggaucacuauuucagcuggggccggagucacgccgcccgugguuagcuuacagcugaccaaccuaacauuugaugacgcaggcacuuauuucugugcccgcgagcgaggccgucacagagauccuaagaccggggacgcucucaggggacgguacuuugauuucuggggucgcggcacagggaucagugugucccca

SEQ ID NO: 27413 - RNA, 396 nt, Artificial Sequence
  derived and/or modified sequence opt3 from anti-HIV_Chain
gaggugcagcugguccaaagcggcgccgaaguuaagaaacccggggcuuccgugaagguaucuugcaaagugucaggauacacccucacagagcuuaguauccacugggucagacaggcaccugguaagggccuggaauggaugggaggguucgacccagaggaugacgaagccauuuaugagccgaaauuucagggcagguugacuaugacggaggauaccagcacagacacugcguacauggaauuauccucucugcggucggaggauaccgcuguguauuacugugccacagcagaccccuucaagguugcccaggaugaaggucuauaugugauauuugacuacugggggcaaggaacccucgucacugugucaagcgcuaguacaaagggc

SEQ ID NO: 27414 - RNA, 396 nt, Artificial Sequence
  derived and/or modified sequence opt3 from anti-HIV_Chain
gaggugcagcuggucgaaagcggcgggggacuccuucaacccgguggcucccugagauugucuugcgccgcuucaggguucaguuuuaacgacuucgagaugaauuggguuaggcaggcaccuggaaagggcuuagaaugggugagcuacaucuccaacgaugguaccaugauucacuaugccgacucuguaaaagggcgguuuacaauaucgcgcgauaaugcgaagaaaucacuguuccuacagaugaacagccuccgagcugaggacacugccguguacuauugugcacgucuggccgaagucccaccggcuaucagaggaaguuacuauuacggcauggauguguggggccaggggacgaccguuacaguggcauccgccucuacuaaggga

SEQ ID NO: 27415 - RNA, 396 nt, Artificial Sequence
  derived and/or modified sequence opt3 from anti-HIV_Chain
caggugcaacugaugcagagcggcgccgaggucaagagacccggggcuuccguuaaagugucuugcaaggcauucaggcacucacucaacaaucuuggaaucaguuggauucggcgcgccccuggucgaggccuggaaugguugggguggauaaacguauacgagggaaauaccaaauauggccguagauuucaggguagggugacaaugacuacggaccggagcaccaacacagucuccauggaauuacgcucucugacuucggaugacaccgcgguguacuauugugcuagagauaaucauuucuggucagggagcaguagguacuauuacuuuggaauggacguuuggggccagggcacaaccgugaucgucuccucugccagcacuaagggg

SEQ ID NO: 27416 - RNA, 396 nt, Artificial Sequence
  derived and/or modified sequence opt3 from anti-HIV_Chain
caggugcaacugguccaguggggcgccgggcuccuuaagccccuggagaccuugagcuuaacaugcgcuguuuacggagguuccuucaacggcuauuuuuggucuuggaucagacagacuccugggaaaggacuggaauggauuggcgagauaaaucacggugggucagcaaacuucaauccaagucuaaagagcagggugacgauguccguagacaccucuaaaaaccaguuuucgcucaagcuggccucagugacagcggcugauacugccaucuacuauugugcacggggacgcauuaccaugguccgaggcgacccgcaacguggcggggugagaauggauguuuggggacaggguacaagcgugaccgucaguuccgccucuacuaaaggc

SEQ ID NO: 27417 - RNA, 396 nt, Artificial Sequence
  derived and/or modified sequence opt3 from anti-HIV_Chain
cuggugcagcucguccaaagcggcgccgagguuaagaaacccggggcuuccgugaagguaucuugcaaagugucaggacacacccuuagugaacugagcaucaacugggucagacaugugccugguaagggcuuggaguggaugggaggguuagacccagaagauggcgaggcaauucacgaaccgaaauuccaggguaggcugacaaugacugaggacacguccaccgauacagccuacucuacucuaucgguuugggcgcccguggcugccgcaauguauuacugugccaccgcugacccuuuuaaggucgcacaggaugaggggcucuaugugauauucgacuacuggggacagggcacacugguaaccguuucaagcgccaguacuaagggc

SEQ ID NO: 27418 - RNA, 396 nt, Artificial Sequence
  derived and/or modified sequence opt3 from anti-HIV_Chain
caggugcaacugcuccagagcggcggggaggucaagaaacccggagccuccguuaaggugucuugcaaaguaucagguuacacccuuacagaacugaguauccacugggugagacaggcuccuggcaagggguuggaguggaugggaggcuucgacccagaagaugacgaggcaauuuaugaaccgaaauuucaggguagguuaacuaugacggaggauaccagcacagacacugccuacauggagcuguccucucuacggucggaagauaccgcggucuauuacugugcuacagccgaccccuucaagguggcacaagaugaggggcucuauguuauauuugacuacuggggacagggcacccuggugacugucucaagcgccaguacaaagggc

SEQ ID NO: 27419 - RNA, 396 nt, Artificial Sequence
  derived and/or modified sequence opt3 from anti-HIV_Chain
caggugcaacugguccagagcggcgccgagguuaagaaacccggggcuuccgugaagguaucuugcaaagugucaggauacacccucacagaacuuaguauccacugggucagacaggcaccugguaagggccuggaguggaugggaggguucgacagcgaagauggcgaggccuuuuauaaacagaacuuccaagguagggugacuaugacggaagacaccuccacagauacugcguacauggaguugcggcgcuuacgaucugaggacaccgcuguuuauuacugugccacagcagaucguuuuaagguggcccaggacgaagggcuguucgucauuuuugauuauuggggacagggcacccuagugacuguaucgucagcuagcacaaagggc

SEQ ID NO: 27420 - RNA, 396 nt, Artificial Sequence
  derived and/or modified sequence opt3 from anti-HIV_Chain
caggugcaccugguccaaagcggcgccgagguuaagaaacccggggcuuccgugagaguaucuugcaaggcaucaggauacaccuucacaacuuaugguaucaguugggugaggcaggccccuggccaggggcucgaauggaugggauggauuagcgcgcauuccggcgacacgaacuacgcucagaaacuucaagcccgggucaccaugacaacugauaccucuacaaauaccgcauauauggagcugcgcucguugacuucagacgauacagccguguacuauugugcucgagaccguccaagacacuacuaugauagggguggguacuacagcccguuugacuauuggggacagggcaccuuaguuacggugaguuccgcaucuacuaagggc

SEQ ID NO: 27421 - RNA, 396 nt, Artificial Sequence
  derived and/or modified sequence opt3 from anti-HIV_Chain
cuggugcagcuccuucaaagcggcgccgaggucaagaaacccggggcuuccguuaaggugucuugcaaaguaucaggauacacccugacagaauugaguauccacugggugagacaggcaccugguaagggcuuagaguggaugggaggguucgacccagaagaugacgaggccauuuaugaaccgaaauuucagggcaggcugacuaugacggaggauaccagcacagacacugcguacauggagcuauccucucuccggucggaagauaccgcugucuauuacugugccacagcagaccccuucaagguggcccaggaugagggucuguauguuauauuugacuacugggggcaaggaacccuugugacugucucaagcgcuaguacaaagggc

SEQ ID NO: 27422 - RNA, 396 nt, Artificial Sequence
  derived and/or modified sequence opt3 from anti-HIV_Chain
caggugcaacugguccagagcggcgccgagguuaagaaacccggggcuuccgugaagguaucuugcaaagugucaggacacacccucagugaacuuagcaucaacugggucagacaugugccugguaagggccuggaguggaugggaggguuggacccagaagauggcgaggcaauucacgaaccgaaauuccaggguagguuaacaaugacugaggacacguccaccgauacagccuacguugagcugucuucgcuacggucagaagacacugcgauguauuacugugcuaccgccgaucccuuuaagguggcacaggacgaggggcucuaugucauauucgauuacuggggacaaggcacacuggugaccguaagcagugccuccacuaagggc

SEQ ID NO: 27423 - RNA, 396 nt, Artificial Sequence
  derived and/or modified sequence opt3 from anti-HIV_Chain
caggugcaacugcuccagagcggcgccgaggucaagaaacccggggcuuccguuaaggugucuugcaaaguaucaggauacacccuuacagaacugaguaucaacugggugagacaggcaccugguaagggcuuggaguggaugggaggguucgacccagaagaugacgaggccauuuaugaaccgaaauuucagggcagguuaacuaugacggaggauaccagcacagacacugcguacauggagcuguccucucuacggucggaagauaccgcugucuauuacugugccacagcagaccccuucaagguggcccaagaugagggucucuauguuauauuugacuacugggggcagggaacccuggugacugucucaagcgcuaguacaaagggc

SEQ ID NO: 27424 - RNA, 396 nt, Artificial Sequence
  derived and/or modified sequence opt3 from anti-HIV_Chain
cagccccaacuggugcagagcggcuccggggccgaggucaagaaaccuggagcuucuguuagaaucucaugcgaagcaagugaguacaacguguucgaccacuuuaugcaguggguaaggcaggccccaggucaaggccucgaauggaugggguggauuaauccgcggggaggcuaucccagcuacuccccuaccuuccagggucgccuuacauuuacucgacagccaucuugggaugacucgacgauaaccuuccauauggagcugcguggguugggacacgaugacacagcgguguauuacugugcuagaccccauucaccugaugacgccuggagcuuagaugucuggggcaggggcacucuggugaccguuaguuccgcaucuacaaagggg

SEQ ID NO: 27425 - RNA, 396 nt, Artificial Sequence
  derived and/or modified sequence opt3 from anti-HIV_Chain
cagccccaacuggugcagagcggcuccggggccgaggucaagaaaccuggagcuucuguuagaaucucaugcgaagcaagugaguacaacguguucgaccacuuuaugcaguggguaaggcaggccccaggucaaggccucgaauggaugggguggauuaauccgcggggaggcuaucccagcuacuccccucgcuuccagggucgacuuaccuuuacacgucagccaucuugggaugacucgucagugacuuuccauauggagcugagaggguugaggcacgaugacacggcggucuauuacugugcucggccccauagcccugaugacgccuggaguuuagauguguggggacgcggcacccugguuacaguguccucugcaagcacuaagggc

SEQ ID NO: 27426 - RNA, 396 nt, Artificial Sequence
  derived and/or modified sequence opt3 from anti-HIV_Chain
gaggugcagcuggucgaaagcggcgggggaguuguggagcccggugaaucccucagacuuucuugcgccgcuucaggcuucaccuuuaggaguuacgacauguucuggguacggcaagcaacaggaaagagccuggaguggguguccgccaucgggauugcgggcgauacuuauuacucugguucggucaaagggcgcuuuacgauaucacgagaaaacgcucguaccagcuuguauuuacagcugaguggacuaagaguggaggacuccgccguuuacuucugugugaggggcucuccuccacggaucgcagccacagaguauaauuacuauuacggccucgaugucugggggcagggaacuaccgugagcguauuuuccgcuucaacaaagggu

SEQ ID NO: 27427 - RNA, 396 nt, Artificial Sequence
  derived and/or modified sequence opt3 from anti-HIV_Chain
caggugcaacugguccagagcggcgccgagguuaagaaacccggguccucugugaagguaucaugcaaagcuaguggagguaccuucacaacuuacgacaucagcugggugagacaggcaccuggccaggggcucgaauggaugggaggcauucuuccagauuuuggugccccguccuaugcgcaaaaguuccaggacagggucacgauaaccacagaugagucuucgucaacugcuuacauggaacugaacagcuugcggagugaggacaccgccaucuauuacugugcacgcgggcgaggagaugacuuuugguccggcgaaucucccagcugguauuucgauuacuggggccaggggacauuagugaccguuuccucagccaguacuaaagga

SEQ ID NO: 27428 - RNA, 396 nt, Artificial Sequence
  derived and/or modified sequence opt3 from anti-HIV_Chain
cagccccaacuggugcagagcggcuccggggccgaggucaagaaaccuggagcuucuguuagaaucucaugcgaagcaagugaguacaacguguucgaccacuuuaugcaguggguaaggcaggccccaauggaaggucucgaguggaugggcuggauuaauccgcgcgggggauaucccagcuacuccccuaccuuccaaggccggcuuacauuuacucgacagccaucuugggaugacucgacgauaaccuuccauauggaacugcgugguuugagacacgaugacacagcgguguauuacugugcuaggccccauucaccugaugacgccuggagcuuagaugucugggggcggggaacucuggugaccguuaguuccgcaucuacaaagggc

SEQ ID NO: 27429 - RNA, 396 nt, Artificial Sequence
  derived and/or modified sequence opt3 from anti-HIV_Chain
gaggugagacugcucgaaagcggcgggggacuuguccagcccgguggcucccugagguugucuugcucagccaguggguucaccuuuagcaacuccgcuuuaucuuggguucggcaagcaccuggaaagggccuggagugggugucgucaguagugagcagugguggggacacauucuacgccgauuccgucaaaggacgcuuuacuaucucucgagacaauagccguaacacgcuauaucuccagaugaagucccugagagcggaagauaccgcucuuuacuauugugccaaagugcagauucagcaacugaauuucggcguuauaacagacgcaggcauggaugugugggggaagggaacuaccgucaucgugucaagugccagcacaaaaggu

SEQ ID NO: 27430 - RNA, 396 nt, Artificial Sequence
  derived and/or modified sequence opt3 from anti-HIV_Chain
caggugcaacuggucgagagcggcgggggaguugugcagcccgguagaucccucaggcuuucuugcguaggcucaggguucaccuuuaguagcuccggaaugcacugggugcggcaggccccuggcaagggucuggaaugggucgcugugaucucuucggacgggucagaugaguacuauggagacagcguugaaggccgcuucacaauuagucgagauaacuccaaaaauacuuuguuuuuacagcuggacucucuagaggcagaagauagcgccguguacuauugugcgaagacgccaccgcauuacgacgcucucaccggcuaucccuccucaguccuggaguucugggggcuuggaacacuggugacuguaaguagcgccucuaccaaaggu

SEQ ID NO: 27431 - RNA, 396 nt, Artificial Sequence
  derived and/or modified sequence opt3 from anti-HIV_Chain
gaggugcagcugguccaaagcggcgccgaaguuaagaaacccggguccucugugaagguaucaugcaaagcuaguggagguaccuucacaacuuacgacaucagcugggugagacaggcaccuggccaggggcucgaguggauuggaggcauacuuccagauuuuggugccccguccuaugcgcagaaguuccaagacagggucacgaucaccacagaugaaucuucgcggacugcuuacauggagcugaacucauugcgcagcgaagacaccgccauuuauuacugugcacgagggcguggagaugacuuuuggaguggcgagucccccucuugguauuucgauuacuggggccaggggacacaggugaccguuagcuccgccucaacuaaagga

SEQ ID NO: 27432 - RNA, 396 nt, Artificial Sequence
  derived and/or modified sequence opt3 from anti-HIV_Chain
caggugcaacugcuccagagcggcaccgaggucaagaaacccggguccucuguuaaggugucaugcagagccaguggauggacacuugguaacagcccuaauuccgcuaucggcuggguaaggcaggcaccagggcagggacuggaauggauuggccggauaaucccgauuuuggacgugacuaacuacgcccaaaaauuccagggucgcgucacgaucucugcggauaagucgaccaauauugcuuauauggagaucagcucauuagggagugaagacacagccuuuuacuauugugcacgagugauaacuggaaugaccucccccugguacuucuauauggauguuuggggcgagggcacaaccgugaucgucucuagcgccuccacuaaaggg

SEQ ID NO: 27433 - RNA, 396 nt, Artificial Sequence
  derived and/or modified sequence opt3 from anti-HIV_Chain
caggugcaccugguccaaagcggcgccgagguuaagaaacccggguccucugugagaguaucaugcaaggcuaguggauggaccuucggugacagcgugaacuccgcaaucacaugggucaggcaggccccuggccaggggcucgaauggaugggacgguuuauuccaauacuuggccugucuaauuacgcgcagaaauuccaagaucgcgugacuaucaacguugaccgaucgacgaauaccgcuuauauggaguugucagguuuacguagcgaagauacagccguguacuauugugcaagacugauuacugggaugaacgccccgugguuuuacuauauggacgucuggggaaagggcaccacaaucaccgugaguuccgcuucuacuaaaggc

SEQ ID NO: 27434 - RNA, 396 nt, Artificial Sequence
  derived and/or modified sequence opt3 from anti-HIV_Chain
caggugcaccugguccaaagcggcgccgaggcuaagagacccggguccucuguuagggugucaugccgggcaaguggaggugacuucagcuccuacacccucucuuggguacgccaggccccuggccaggggcuugaacgaaugggaggcguggucccaaugcuggauacagugcauuaugcgcagaaauuucaaggucguuugacuuuaucgguugacgaggggacgucaaccgcuuacauggaacugagcagucuaagauccgaggauacagccauguauuacuguacuaggggacggcagaccuuccgcgcaaucuggucuggcccgcccguggucuuugacauuuggggccaggggacacucgugagcguauccucagccaguaccaaggga

SEQ ID NO: 27435 - RNA, 396 nt, Artificial Sequence
  derived and/or modified sequence opt3 from anti-HIV_Chain
caggugcaccugguccaaagcggcgccgaggcuaagagacccggguccucuguuagggugucaugccgggcaaguggaggugacuucagcuccuacacccucucuuggguacgccaggccccuggccaggggaucgaauggaugggaggcguggucccaaugcuugauacagugcauuaugcgcagaaauuucaaggucgacugacuuugucgguugacgaggggacgucaaccgcuuacauggaauuaagcagucugcguuccgaggauacagccauguauuacuguacuagaggaaggcagaccuuccgggcaauuuggucuggcccgcccgccguguuugacauauggggccaggggacccuagucaucgugagcuccgcuucaacaaaggga

SEQ ID NO: 27436 - RNA, 396 nt, Artificial Sequence
  derived and/or modified sequence opt3 from anti-HIV_Chain
caggugcaacugguccagagcggcgccgagcucaagaaacccggguccucuguuaaggugucaugcaaagcuaguggagguaccuucaacaaucacacauuuaacuggguaagacaggcaccuggccaggggcuugaauggaugggaaggacuaucccaauucugggcagccgggacuacgccaagacguuccaagaucgcgugaccauaaucgcggacaaauccacaucuacugucuauuuggaguuacgacgucugaagucggaagauaccgguguguacuauugugcuacaucaauguacuauuuugacagcgggggauacuauagaaauaccgaucuagacaaguggggccagggcagucucguuacuguguccucugccagcacaaaaggg

SEQ ID NO: 27437 - RNA, 396 nt, Artificial Sequence
  derived and/or modified sequence opt3 from anti-HIV_Chain
cagguguaccugguccaaagcggccccgagcucaagaaaccuggggccuccguuaagaucucuugcaaggcuucaggauauaacuucccaaaauacgcaauucacugggugagacaggccccgggucagggccuucaguggaugggguggauaaauggagacaacggcgaugcgagguauagucaaaaacugcagggucggguaacccccagcacagacacuuccgcuucuguggucuacauggaauugaagcgcuuacgaucggaggauacggccguguauuacugugcacgugcccuguauccuugggaaaucgggggaguuccaucaaccaugggcgacgauuacuggggccaggggacacuaauuacugugagcagugcuuccaccaaggga

SEQ ID NO: 27438 - RNA, 396 nt, Artificial Sequence
  derived and/or modified sequence opt3 from anti-HIV_Chain
caggugcaacugguccagagcggccccgagcucaugaagccuggguccucuguuaaagugucaugcagagccaguggagacaacuuccuuaccagcacauuuaauuggcugaggcaggcuccaggucagcgguuggaauggaugggccgcuucaucccguccuuagggcugauuacuucugcacccaaguuuucggaucgacuaacgauaaccgccgaccaagcgacacucacugcuuacauggagcugaccggacuuacaucagaagauaccgcccuguauuacugugcacguggcuugugcagaggugggaacuguaggcucggaccuagcggcuggcuggacccauggggccgggggacucagguaacagugaguuccgccucuaccaaagga

SEQ ID NO: 27439 - RNA, 396 nt, Artificial Sequence
  derived and/or modified sequence opt3 from anti-HIV_Chain
ggcgugcacuuccaggggcaucugguccaaagcggagguggcguuaagaaacccggguccucugugaccaucucaugccucgccagugaguacacauuuacugaguucacgauucacuggauaagacaggcuccuggacagggcccacuuuggcuggguuugaucaagaggagcgggcgguuaaugaccuccuaucgcuuucaggaccgacugucucuacguagagauaggucgacaggaacuguauucauggaacuccggggccugcgcauugacgauaccgcaguguacuauugugccagagacggccuuggggaagucgcgccggcuuaccuguauggaaucgauguguggggucaaggcucaacaguuauugugaccagcgccaguacuucc

SEQ ID NO: 27440 - RNA, 396 nt, Artificial Sequence
  derived and/or modified sequence opt3 from anti-HIV_Chain
caggugcaacugcuccagagcggcgccgaggucaagaaacccggggcuuccguuaaggugucuugcaaaguaucaggauacacccuuacagaacugaguauccacugggugagacaggcaccugguaagggcuuggaguggaugggaggguucgacccagaagaugacgaggccauuuaugaaccgaaauuucagggcagguuaacuaugacggaggauaccagcacagacacugcguacauggagcuguccucucuacggucggaagauaccgcugucuauuacugugccacagcagaccccuucaagguggcccaagaugagggucucuauguuauauuugacuacugggggcagggaacccuggugacugucucaagcgcuaguacaaagggc

SEQ ID NO: 27441 - RNA, 396 nt, Artificial Sequence
  derived and/or modified sequence opt3 from anti-HIV_Chain
caggugcaacugguccagagcggcgccgagguuaagaaacccggggcuuccgugaagguaucuugcaaagugucaggauacacccucacagaacuuaguauccacugggucagacaggcaccugguaagggccuggaguggaugggaggguucgacccagaagauggcgaggccagcuuugaaccgaaauuccaggguagguugacuaugacggaggacaccuccacagauacugcguauauggaguuaucuucgcugcggucagaagacaccgcuguguacuauugugccacagcagaucccuuuaagguugcccaagacgaggggcuauacgugauuuucgauuauuggggacagggcacccucgucacugugagcagugcuuccacaaagggc

SEQ ID NO: 27442 - RNA, 396 nt, Artificial Sequence
  derived and/or modified sequence opt3 from anti-HIV_Chain
ggcgugcacuuccaggggcaucugguccaaagcggagguggcguuaagaaacccggguccucugugaccaucucaugccucgccagugaguacacauuuacugaguucacgauucacuggauaagacaggcuccuggacagggcccacuuuggcuggguuugaucaagaggagcgggcgguuaaugaccuccuaucgcuuucaggaccgacugucucuacguagagauaggucgacaggaacuguauucauggaacuccggggccugcgcauugacgauaccgcaguguacuauugugccagagacggccuuggggaagucgcgccggcuuaccuguauggaaucgauguguggggucaaggcacaaccguuauugugacuucagccagcacaagu

SEQ ID NO: 27443 - RNA, 396 nt, Artificial Sequence
  derived and/or modified sequence opt3 from anti-HIV_Chain
caggugcaacugggcgagagcgggggaggucucgucgaacccggcgggucccuuagacugucuugcgccgcuucaggauucuuguuuagugacuaccagaugagcuggaucagguuagcaccuggcaagggucuggaguggauuuccuucauaucuggguuuggaucgguuuauuacgccgauucaguggaaggccgguucaccaucagccgcgacaacgcgcgaaauagucuauaucuccagaugaacaaucugcgugcugaggauacagccguauacuauugugcaagagccuacggcacugggaacuggaggggacuuuauuacuacuauuacgguauggacguguggggccacgggacgaccgucacaguguccucugcuagcacuaaagga

SEQ ID NO: 27444 - RNA, 399 nt, Artificial Sequence
  derived and/or modified sequence opt3 from anti-HIV_Chain
caggugcaacugguccagagcggcaccgcccucaagucccccgggucuucagcuaaacuuaguugcacaguucugggagacgaguucgguacuuacuuuaucagcuggauuagacaggcaccuggccagggguuggaaugggugggaggcauaguaccacacucccaauuacagucuucggcccagaaguuccaugguaggaucauuaucucagcgggggcuggagugacgccgcccgucgugagccugcagcuaaccaaccucacauuugaggauacuggcaccuauuucugugcccgggaacgcggccgacaccgugacccuaaaacaggggaugcacugagaggaagguacuuugacuucuggggucggggcaccgggcuucgcguuaguacuucc

SEQ ID NO: 27445 - RNA, 399 nt, Artificial Sequence
  derived and/or modified sequence opt3 from anti-HIV_Chain
gaggugcagcugguccaaagcggcgggggacucguuaagcccgguggcucccuuagacugucuugcgccgcuucaggguucaccuuuaaaaacgcauggaugaguugggugaggcaggccccuggaaagggcuuggaauggguaggucacaucaaaagcaagacagacgggggaacuauugauuacgcggcuccagugaaaggccgguucacgauaucccgcgacgauucuaagaauaccuuauaucugcagaugaacucgcuaaagaucgaggacacagccgucuacuauuguacuaccgauauuggcucagggcgaggaugggacuuucauuacuaugauagcaaugacuggggucagggcacacucgugaccguuaguuccgcaucuacuaaaggg

SEQ ID NO: 27446 - RNA, 399 nt, Artificial Sequence
  derived and/or modified sequence opt3 from anti-HIV_Chain
caggugcaacuggucgagagcggcgggggaguugugcagcccgguagaucccucaggcuuuucugcgccgcuucuggcuuugcauucaauaccuacgggaugcacuggguacggcaggccccuggaaagggccuggaauggguggcggucacauggcaugacgguucacagaaauauuacgcugauagugugaaggggcgcuuuacuaucagccgagacaauuccaaaaacacguuguauuuacaaaugaacucucugcgugccgaggauaccgcaauuuacuauugugccucggaccagggaggcuucgaugacucaagcggcuacuuugcuccagggggaauggauguuugggguagaggcacaacugugauagucaguuccgcaccgaccaagggg

SEQ ID NO: 27447 - RNA, 399 nt, Artificial Sequence
  derived and/or modified sequence opt3 from anti-HIV_Chain
ggcuacagcgaggugcagcugguccaauccgggcccggacucguuaagccuucucagacccuuucacugacaugcacugugagugguggcagcaucuccaacgggggacacuauuggaauuggauuagacagcauccaggcaaagguuuggaauggauagggcacaucuacaacauugccacgaccuauuacaauccgucuuuaaagucgaggguaucaaucagcguggacacaaguaaaaaccaguucucccugaagcuaucuagcgucacugcugcagauaccgccguguauuacugugcgcggggauccggccgcuggacaauuggcgcucgaaucuauuuugacaauugggggcaaggagcccucguugcagugucaagugccagcaccaaaggu

SEQ ID NO: 27448 - RNA, 399 nt, Artificial Sequence
  derived and/or modified sequence opt3 from anti-HIV_Chain
cagcugcaacucaaggagagcggccccgggauggugaaaccuuccgaaacccuuucucugacaugcucagucaguggagccagcguuguguccgcuaacgacuacugggguuggaucagacaggcaccaggcaagggguuggaguguauuggaauaaucuuauauacuggcucuacguucuacaauccgucgcugcagucaaggguaaccauuagccgggaucccaguaaaaaccacgugucccuaacacucacuucugucaccgccgcggacagcgcuguguauuacugcgcccgcaucccuuaucauuccgaaucauacuauaauguugugauugguggguuugaugucuggggacagggcacacgagugaccguaaguagcgcaucuacuaagggc

SEQ ID NO: 27449 - RNA, 399 nt, Artificial Sequence
  derived and/or modified sequence opt3 from anti-HIV_Chain
ugccaggugcaacuggucgagagcggcgggggaguugugcagcccgguagaucccucaggcuuucuuguguaggcucaggguucaccuuuaguagcuccggaaugcacugggugcggcaggccccuggcaagggucuggaaugggucgcugugaucucuucggacgggucagaugaguacuauggagacagcguugaaggccgcuucacaauuagucgagauaacuccaaaaauacuuuguuuuuacagcuggacucucuagaggcagaagauagcgccguguacuauugcgcgaagacgccaccgcauuacgacgcucucaccggcuaucccuccucaguccuggaguucugggggcuuggaacacuggugacuguaaguagcgccucuaccaaaggu

SEQ ID NO: 27450 - RNA, 399 nt, Artificial Sequence
  derived and/or modified sequence opt3 from anti-HIV_Chain
caggugcaacugguccagagcggcgccgacguuaagaaacccggggcuuccgugaagguaucuugcaaagugucaggauacaccgucagugagcucagcauccacugggugagacaggcaccugguaagggccuugaauggaugggaggguucgauccagaggacggcaaaacaguuuccgcccagaacuuucaagguagggugacuaugacggaagauaagucuaccgggacagcgaauauggagcugcggucguugcgcucagaagacacugcugucuauuacugugccaccacagugcaguuaauuguagauuucugcaacggaggcccguguuauaauuuugacgauuggggccaggggacccugguuacugugagcagugcauccacaaaggga

SEQ ID NO: 27451 - RNA, 399 nt, Artificial Sequence
  derived and/or modified sequence opt3 from anti-HIV_Chain
ggccuggaccucgagcacgaugggcaucacaaggaagaacccagagccagcgugaccgucuccugcgaggcuucuggauacaacuucguuaauuauaucauucauugggugaggcuuacaccuggucggggcuuugaguggauggggaugauagacccacgccgaggacguccguggucagcacagaaauuccaaggcagacugacuuugacgagggauaucgacagugaacgguuauacaugcagcugagcggucuacgcggggaugacaccgccguauauuuuugugcgagacaggagcccgauuuccacgacggacauggccacacacucaggggcauguuugauuccugggggcagggaucuccugugucggucucaagcgcuaguacuaagggu

SEQ ID NO: 27452 - RNA, 399 nt, Artificial Sequence
  derived and/or modified sequence opt3 from anti-HIV_Chain
caggugagacugguccaaagcggcgcccagcucaagaaacccggggcuuccguuaccgugucuugcgaggcaucaggauacaacuucguaaauuauaucauuaacugggugaggcagacaccuggucggaguuuugaaugggucggcaugauagacccacgccgagggcguccguggagcgcccagaaguuccaaggaagacuuacucugacgagggauaucgacuccgagaaauuguacaugcacuuaucuggccugcggggugaugacaccgcgguguauuacugugcucgccaggauucggacuuucaugaugggcacggacauacacuaagaggcauguucgacucauggggccaggggagccccguuacugugaguuccgccucuaccaaggga

SEQ ID NO: 27453 - RNA, 399 nt, Artificial Sequence
  derived and/or modified sequence opt3 from anti-HIV_Chain
caggugagacugagccaauccggcgccgcugucguuaagaccggggcaucugugacaaucucaugcgagacugaaggauacacguucguaaacuauauuauacacugggugaggcagcccccuggucggggcuuugaguggcucgggaugaucgacccacgcaauggacauccgugguucggccagcgauuucgugguagacuuagucugaggcgggaucgcagcaccgaaacagucuucaugacuuuguccggguuaaccucugacgauaacggaauuuacuuuugugccagaaaugagccccaguauuacgacggcucgggccacucacugccugggauguucgauuauuggggacaagguacaagggugguugugagcagugcguccaccaaaggc

SEQ ID NO: 27454 - RNA, 399 nt, Artificial Sequence
  derived and/or modified sequence opt3 from anti-HIV_Chain
caggugagacugagccaauccggcgccgcugucaugaagaccggggcaucuguuacaaucucaugcgagacugaaggauacaacuucgugaauuauauuauacacuggguaaggcggcccccuggucgcggcuuugaguggcucgggaugaucgacccgaaaaacggacauccaugguucgcccaggcggugcgaggccgucuuagucugagaagggauacguuuaaugaagucguguacaugaccuugagcgguuuaacauccgacgauacugggcuguauuucugugcucggaacgagccccaguaccacgacggaaauggccauucucuaccuggcauguuugauuucugggggcagggaacccucguuacagugucgucagccagcaccaagggu

SEQ ID NO: 27455 - RNA, 399 nt, Artificial Sequence
  derived and/or modified sequence opt3 from anti-HIV_Chain
caggugagacugagccaauccggcgccgcugucguuaagaccggggcaucugugacaaucucaugcgagacugaaggauacacguucguaaacuauauuauacacugggugaggcagcccccuggucggggcuuugaguggcucgggaugaucgacccacgcaauggacauccgugguucggccagcgacuucagggucgucugaguuugagaagggaucggagcaccgaaacagucuuuaugacuuuauccgggcugaccucugacgauacaggaauuuacuucugugcccgcaacgagccccaauauuacgacggcucgggccacucacuaccugggauguuugauuauuggggacaggguaccagagugguugugagcagugcguccacuaaaggc

SEQ ID NO: 27456 - RNA, 399 nt, Artificial Sequence
  derived and/or modified sequence opt3 from anti-HIV_Chain
caggugagacugagccaauccggcgccgcugucguuaagaccggggcaucugugacaaucucaugcgagacugaaggauacacguucguaaaccacauuauacauugggugaggcagcccccuggucggggcuuugaguggcucgggaugaucgacccacgcaauggacacccgugguucggccagcgacuucgugguagacugaguuugaggcgggaucgcagcaccgaaacagucuuuaugacuuuauccgggcugaccucugacgauauuggaaucuauuucugugccagaaacgagccccaguacuuugacggcucgggccauucacuaccugggauguucgauuauuggggacaagguacaagggugguugugagcagugcguccaccaaaggc

SEQ ID NO: 27457 - RNA, 399 nt, Artificial Sequence
  derived and/or modified sequence opt3 from anti-HIV_Chain
caggugcaauucuuucagagcggcuccucuaugaagaaaucaggggccagugucaccaucagcugcgaggcuacaggauacaacauuaagaaucacauacugcauuggguuagacagaaacccgguaggggcuucgaauggguggggaugaucgacccuauuaacggacggccaugguuuggccaggcauuccgcggucgacucacucuuacgcgugaucuguccaccgagacauuuuauaugucuuugucgggguuaacuucagacgauaccgccacauacuucugugcgagaagggaagcugacuaucacgauggaaauggccauacccugccgggcauguuugacuucugggggcccggaacucuaguaacagugagcagugccuccaccaagggu

SEQ ID NO: 27458 - RNA, 399 nt, Artificial Sequence
  derived and/or modified sequence opt3 from anti-HIV_Chain
caggugagacugagccaauccggcgccgcugucguuaagaccggggcaucugugacaaucucaugcgagacugaaggauacacguucguaaacuauauuauacacugggugaggcagagucccggucggggcuuugaguggcucgggaugaucgacccucgcaauggacauccaugguucggccagcgacuucgugguagacugagcuugaggcgggaucgcuccaccgaaacagucuuuaugacuuuaucugggcugaccucggacgauacagccauuuacuucugugcgagaaacgagccgcaguauuacgacggaucaggccacagccuacccggcauguuugauuauugggggcaaggaaccagggugguugugaguuccgcuucuacuaaaggu

SEQ ID NO: 27459 - RNA, 399 nt, Artificial Sequence
  derived and/or modified sequence opt3 from anti-HIV_Chain
caggugagacugagccaauccggcgccgcuaugaagaaacccggggcaucugucaccaucucaugcgagacagaaggauacacuuucauuaacuauauaauccacuggguuaggcagccuccaggucggggcuuugaguggcucgggaugauugacccgcgcaauggacgacccugguucggccagagugugcagggucgucuuagccugagaagggauacguacaccgaaguaguguauaugacauuguccggguuaacuucugacgaugccggacuguacuuuugugcgcggaacgagccucaauaucaugacggcaauggccacucgcuaccagggauguucgauuacuggggacaggguacccucgucgcugugucaagcgccaguacaaagggc

SEQ ID NO: 27460 - RNA, 399 nt, Artificial Sequence
  derived and/or modified sequence opt3 from anti-HIV_Chain
caggugagacugguccaaagcggcgcccagcucaagaaacccggggcuuccguuaccgugucuugcgaggcaucaggauacaacuucguaaauuauaucauuaacugggugaggcagacaccuggucggggcuuugaaugggucgggaugauagacccacgccgaggacguccguggagugcccagaaguuccaaggcagacuuacucugacgagggauaucgacagcgagaaauuguacaugcacuuauccggucugcgcggggaugacaccgcgguguauuacugugcucggcaggauucugacuuucaugauggacacggccauacacuaagaggcauguucgacucgugggggcagggaucacccguuacugugagcagugccuccaccaagggu

SEQ ID NO: 27461 - RNA, 399 nt, Artificial Sequence
  derived and/or modified sequence opt3 from anti-HIV_Chain
caggugcacaccuuccaaagcggcuccucuaugaagaaaucaggggccagugucacaaucagcugcgaggcuacuggauacaacauuaagaauuauauacugcauuggguuagacagaaacccgguaggggcuuugaauggguggggaugaucgacccuauuaacggacggccaugguucggccagccguuucgcggucgacucacgcuuacccgugaucuguccacagagacuuucuacaugucuuugucgggguuaaccucagacgauacagcaaccuauuuuugugccagaagggaagcggacuaccacgauggaaauggccauacucugcccggcauguucgacuuuugggggccuggaacacuaaucaccguaagcagugcuuccacgaagggu

SEQ ID NO: 27462 - RNA, 399 nt, Artificial Sequence
  derived and/or modified sequence opt3 from anti-HIV_Chain
caggugagacuguuccaaagcggcgccgcuaugaagaaacccggggcauccgucaccaucucuugcgaggccucaggauacaacuuuaugaauuauuucguucacugggugaggcagcggccuggucgcggcuuugaauggcucgggaugauuaacccacgaggaggccguccguggagugcgcagagcguacaggguagacuuacacugacuagggacauauccacggagauguucuacaugcgguuggauggguuacgcucugacgauaccgcuacauauuuuugugccagaaaugaagcagacuaccaugauggaaacggccacucgcugaggggcauguucgacuauugggggcaaggaucacuaaucacugugagcagugccuccaccaagggu

SEQ ID NO: 27463 - RNA, 399 nt, Artificial Sequence
  derived and/or modified sequence opt3 from anti-HIV_Chain
caggugcaacuguuccagagcggcgccgcuaugagaaagcccggggcauccgucaccaucucuugcgaggccucaggauacaacuuuaugaauuauuucguucacugggugaggcagcggccuggucgcggcuuugaauggcucgggaugauuaacccacgaggaggccguccguggagugcgcagagcguacaagguagacuuacacugacuagggacacguccaccgagauguucuacaugcgguuggauggguuacgcucugacgauacagcuacuuauuuuugugccagaaaugaagcagacuaccaugauggaaacggccacucgcugaggggcauguucgacuauugggggcagggaucacuaauaaccgugagcagugccuccacaaaaggu

SEQ ID NO: 27464 - RNA, 399 nt, Artificial Sequence
  derived and/or modified sequence opt3 from anti-HIV_Chain
caggugagacugagccaauccggcgccgcuaucaagaaacccggggcaucugucaccauuucaugcgagacagaaggauacacuuucauaaacuauaucauucacuggguuaggcagccuccaggucggggcuuugaguggcucgggaugaucgacccgcgcaauggacgacccugguucggccagagugugcagggucgucuuagccugagaagggauacguacaccgaaguaguguauaugacauuguccggguuaacuucugacgauaccggacuguacuuuugugcccggaacgagccucaauaucaugacggcaauggccacucgcuaccagggauguucgauucauggggacaggguacacucgucgcggugagcagugcuuccaccaagggc

SEQ ID NO: 27465 - RNA, 399 nt, Artificial Sequence
  derived and/or modified sequence opt3 from anti-HIV_Chain
caggugagacuguuccaaagcggcgccgcuaugaggaagcccggggcauccgucaccaucucuugcgaggccucaggauacaacuuucucaauuauuucguucacugggugcggcagcgcccuggucgaggcuuugaauggcuugggaugauuaacccacguggaggcagaccguggagugcgcagagcguacaggguaggcugacauugacucgggacacguccaccgagauguucuacaugcgcuuagaugggcugagaucugacgauacagcuacuuauuuuugugccaggaaugaagcagacuaccaugauggaaacggccacucgcuacggggcauguucgacuauugggggcaaggaucacucauaaccgugagcagugccuccacaaaaggu

SEQ ID NO: 27466 - RNA, 399 nt, Artificial Sequence
  derived and/or modified sequence opt3 from anti-HIV_Chain
caggugagacugagccaauccggcgccgcugucaagaaacccggggcaucuguuaccaucgugugcgagacagaaggauacaacuucauugacuauauaauccacuggguaaggcagccuccaggucggggcuuugaguggcucgggaugauugauccgcgcaauggacgacccuggucaggccagaaggugcauggucgucuuagucuguggagagacacuagcacggaaaaagucuacaugaccuugacaggguuaacuuccgaugacaccggacuguauuucuguggcaggaacgagccucaguaccacgaugacaauggccauucucuaccagggaugaucgauuauuggggacaagguacaauggugaccguuucgucagccagcacuaagggc

SEQ ID NO: 27467 - RNA, 399 nt, Artificial Sequence
  derived and/or modified sequence opt3 from anti-HIV_Chain
caggugagacugagccaauccggcgccgcuaucaagaaacccggggcaucugucaccauuucaugcgagacagaaggauacacuuucauaaacuauaucauucacuggguuaggcagccuccaggucggggcuuugaguggcucgggaugaucgacccgcgcaauggacgacccugguucggccagagugugcagggucgucuuagccugagaagggauacguacaccgaaguaguguauaugacauuguccggguuaacuucugacgaugccggacauuacuuuugugcgcggaacgagccucaauaucacgacggcaauggccauucgcugccagggauguucgauuacuggggacaggguacccuagucgcugugucaagcgccaguacaaagggc

SEQ ID NO: 27468 - RNA, 399 nt, Artificial Sequence
  derived and/or modified sequence opt3 from anti-HIV_Chain
caggugagacuguuccaaagcggcgccgcuaugaggaagcccggggcauccgucaccaucucuugcgaggccucaggauacaacuuuaugaauuauuucguucacugggugcggcagcgcccuggucgaggcuuugaauggcucgggaugauuaacccacguggaggcagaccguggagugcgcagagcguacaggguaggcuuacacugacucgggacacguccaccgagauguucuacaugcgcuuggauggguuaagaucugacgauacagcuacuuauuuuugugccaggaaugaagcagacuaccaugauggaaacggccacucgcugcggggcauguucgacuauugggggcaaggaucacuaauaaccgugagcagugccuccacaaaaggu

SEQ ID NO: 27469 - RNA, 399 nt, Artificial Sequence
  derived and/or modified sequence opt3 from anti-HIV_LightChain
augaagcugcccgugagacuccuuguccugauguucuggaucccugccagcuccucugacauuguuaugacccagucaccauugaguuuaccggugacacccggcgagccugcuagcauauccugcaggucuucgcaacggcugcuaucaagcuacgggcacacuuaucuccauugguaccugcagaaaccaggacagaguccccagcuucugaucuaugaaguauccaaccgcuuuucuggugugccugaucgauucagcggcuccgggucaggaacggacuuuaccuugaagauuagucgugucgaggcagaagaugugggcguuuacuauuguagccaaucuacacacgugccacucacuuucggucaggggaccaaagucgagaucaagagaaaa

SEQ ID NO: 27470 - RNA, 402 nt, Artificial Sequence
  derived and/or modified sequence opt3 from anti-HIV_Chain
cagcccuacaucgugcaaagcggcccugccgucaagggggcuggauccucuguuaccgugacaugcaaaguagacggugaugacgauggcauuuucucauuugggacuuauuucauggugugggucagacaggcaccaggacagggccugcaguacaugggugggcucgugccgaguuaugcccccacguacgcgcacaaguuugagggaaggauaaccaucagcgcugccggcacaccuccaguugugucccuuacucuguugaacuuaaccaaugacgaugcagccacauauuucugugcucgggaacgcggccgacauuacgacucuaaaacccgugagaacagaagggggcgguauuuugauauguggggacgcgguacuagaauuacagucucgccc

SEQ ID NO: 27471 - RNA, 402 nt, Artificial Sequence
  derived and/or modified sequence opt3 from anti-HIV_Chain
cagcccuacaucgugcaaagcggcccugccgucaagggggcuggauccucuguuaccgugacaugcagaguagacggugaugacgauggcauuuucaacuuugggacuuauuucauggugugggucaggcaggcaccaggacagggccugcaguacaugggugggcucgugccgucauaugcccccacguacgcgcacaaauuugagggacggauaaccaucagugcugccggcacaccuccaguugugagccuuacucugauuaauuugaccaacgcagacgccgcuacauauuucugugcacgcgaacgaggccgucauuacgauuccaagaccagagagaauaggcgggggcgcuauuuugacauguggggaagagguacuaggaucacagucucuccc

SEQ ID NO: 27472 - RNA, 402 nt, Artificial Sequence
  derived and/or modified sequence opt3 from anti-HIV_Chain
agagugcacagccagguccaacugguugaguccggccccgggcucgugaagccuucucagacccuuucacugacaugcacuguaaguggagguagcaucuccaacggcgggcauuacuggaauuggauuaggcagcacccaggaaaaggcuuggaauggauaggucauaucuauaacauugccacgaccuacuauaauccgucuuuaaagucgcgggugucaaucagcgucgacacaaguaaaaaccaguucucccugaagcuaucuagcgugacugcugcagauaccgccguuuacuauugugcgcgcggguccggacgauggacaauuggcgcucguaucuacuuugacaauuggggccaaggggcccucguggcagucucaagugccagcaccaaagga

SEQ ID NO: 27473 - RNA, 402 nt, Artificial Sequence
  derived and/or modified sequence opt3 from anti-HIV_Chain
agcguggacgagagacugcucgaguucggcgggaggcuuguccagcccggagguucccugcgguugucuugcucagccaguggcuuuaccuucagcaacuccgcuaugucuuggguucgccaagcaccugggaagggauuagaaugggugucgucaauccugagcaguggcguagguacauuuuacgccgauuccgugaaagggcgauucacugucucucgugacaauagcagaaacacgcuauaucuccagaugaagucccugagggcggaagauaccgcucuuuacuauugugccaaagugcagauucagcaacugaauuuuggaguuauaacagacgcaggcuuggauguguggggcaaggggacuacccucaucgucucaagugccagcacaaaagga

SEQ ID NO: 27474 - RNA, 402 nt, Artificial Sequence
  derived and/or modified sequence opt3 from anti-HIV_Chain
gugcagagccaagucuaccugguucaguccggcggggaggugaagaaacccggaucuucaguaaaggugaguugcaaagccagcggugacuccuucucuucgucagucaucaccugggugagacaggcuccuggccaggggccagaauggaugggaaggauuauaccgguucucggcguggcagccuaugcgcaaaacuuuuacggucgggucacaaucagcgcugauacgaguuccaauacugccuauauggagcuuucuagccugcgcuucgaagacaccgcaguguuuuacugugcccgagagacagggcguggaggcaacuuggcuuuaagacaguauuucuuugauuccuggggccaggggacucugguaaccguuucaagucccagcacaaaggga

SEQ ID NO: 27475 - RNA, 402 nt, Artificial Sequence
  derived and/or modified sequence opt3 from anti-HIV_Chain
cagcugcaacuccaggagagcggccccgggcuugugaagccuuccgaaacccugucuuugacaugcucagucagugacggaagcaucaacuccaauucuuacuauugggccuggauuagacagucgccagguaaaggcuuagaguggauagggucaguuuacuauuucggaggcacuuacuauagcccgagucugaaguccagggugacgaugucuguagaucggagcaaaaaccaguuuucccuaaaugugucaagugucaccgcugcagacacagccaucuacuauugugcgcgccacgugcgacccuacgaucguagcgguuacccugaaagaccaaacugguucgaccccugggggaggggaacucucguuaccgugucuuccgcuucaacaaagggc

SEQ ID NO: 27476 - RNA, 402 nt, Artificial Sequence
  derived and/or modified sequence opt3 from anti-HIV_Chain
caggugcaacugcaccaguggggcgccgggcuccuuaagcccagcgacacccuguccuugacaugcggaaucuuaggugucucuccuccaggcucacugacuggguacuauuggacguggauuagacagccgcccggaaaaggccuagaguggauaggugaaguuuaccauagugggagcaccaacuauaauccuucccucgcuucuagggugacaaucucgaugggaacuaccaagacacaguucucacugcggcuuaccagcguaacugcagccgauagugcgguguacuauugugcuuccggcaaagucuggggcauuacagcccgcccacgagacgcagggcuggauguguggggacaagguaccacgguuacugugaccucugccagcacaaagggc

SEQ ID NO: 27477 - RNA, 402 nt, Artificial Sequence
  derived and/or modified sequence opt3 from anti-HIV_Chain
caggugcaacugguccagagcggcgccgagguuaagaaacccggguccucugugaagguaucaugcagagcuaguggagguagcuucggcaacuacgcaaucaauugggugaggcaggccccuaugcaggggcucgaauggaugggaggcauuauaccaaucuuugguaccacaaacuaugcgcaaaauuuccgggggcgcgucacuauuaacgcugacacguuuaccaauacagugaacauggaucuuuccucucugcgaucggaggacacugccguuuacuauuguggacguucaaucaaugcagccgugccgggcuuggaaggcgucuacuauuacuaugggauggcuguguggggacaggguaccacaguaaccguuagcagugcauccacuaaaggc

SEQ ID NO: 27478 - RNA, 402 nt, Artificial Sequence
  derived and/or modified sequence opt3 from anti-HIV_Chain
uucgugcagcuggucgagagcggcgggggacucguucaacccgguggcucccuuagacugucuugcgccgcuucaggguuuaacuucaauaccuacuggaugaacugggugaggcaggcaccuggaaagggcuuggaauggguagccaauaugaaagaggacgguagugaaaaguauuacguggauagcgucaaagggcgguuuacaaucucccgcgacaacgcgaaaaauucuuuauaucugcagaugaacucgcuacgagcugaggauacugccguguacuauugugcacguaauccagaaucaagaugcauuguuggaaggaaccggggcuggugucgcuacuucgaccucuggggcagagggagccuggugacggucaguccggccuccaccaaggga

SEQ ID NO: 27479 - RNA, 405 nt, Artificial Sequence
  derived and/or modified sequence opt3 from anti-HIV_Chain
cagcugcaacucgaccagcccggcgccgcuaugaaaagccuuggguccucucugaccaucacaugcagagugucaggagaugacuuggguaguuuccacuuuggcacuuacuucaugauuugggucaggcaggggccuggacagggcuuagaguauaugggugggauacugccaagcacgaagaccccgacauacgcacauaaguuucggggacgcguuuccaucucugcccccggcgugccuccaguacuaucgcucgcgcugacuaaccuuaccuaugaugacacagcuaccuacuucugugcccgagaacguggcagacacuuugagcccaaaaauagggaucaucuggaagggaaguucuuggaccucuggggacgggguacuuuugugcgcgucucaccu

SEQ ID NO: 27480 - RNA, 405 nt, Artificial Sequence
  derived and/or modified sequence opt3 from anti-HIV_Chain
caggugcaacugguccagcccggcaccgccaugaaaagccucggguccucucuuacaaucacuugcagaguuucaggagacgaucuggguaguuuccacuuuggcacguacuucaugauuugggugaggcaggcuccugggcagggauuggaguauaugggcgguauauuaccaagcaccaagacaccgacuuacgcacauaaguuucgggggcgcguauccaucucugcccccggagugccuccaguccugucgcuagcgcucaccaaccugacauaugacgauaccgcuacuuacuucugugcccgagaacguggcagacacuuugagcccaaaaauagggacaaccuugaaggcaaguucuuugaucugugggggcggggaacauucgugcgcguuucaccu

SEQ ID NO: 27481 - RNA, 405 nt, Artificial Sequence
  derived and/or modified sequence opt3 from anti-HIV_Chain
caggugcaacugguccagcccggcaccgccaugaagacacucgggagcucccuuacuaucucuugcagaguuucaggagacgaugguaacuuccacuuuggcacguacuucauggcuugggugaggcagguaccugggcagggacuggaguauaugggcgguauuuugccaaguaccaaaagcccgacauacgcacauaaguuucgggggcgcguguccauaucuacugccggagugcccccugucguuucguuagcgcugaccaaucuaacauaugacgauaccgcuacuuacuucugugcccgagaacguggcagacacuaugacagcaaaaagcaagagaacuacaggggcaaauuuuucgaucucugggggcggggaacaugggugcgcgucucaccaacc

SEQ ID NO: 27482 - RNA, 405 nt, Artificial Sequence
  derived and/or modified sequence opt3 from anti-HIV_Chain
caccuggugcagagcggcaccgaggucaagaaacccggguccucuguuacagugucaugcaaggccuacggaguaaacacuuucggucucuaugcugugaauugggucagacaagcaccuggccagagucuugaauacaucgggcagauuuggagguggaaaagcuccgccucucaucacuuucggggacgcgugcugauaucggcgguugacuugacgggcucaagcccaccgaucaguuccuuagagauuaagaaccugaccucugaugacacagcuguguauuucuguacuaccacaagcaccuacgaucagugguccggucuacaucacgacggggucauggccuuuucaaguuggggacaaggcacucucaucagcgugucugcagccuccacaaaaggc

SEQ ID NO: 27483 - RNA, 405 nt, Artificial Sequence
  derived and/or modified sequence opt3 from anti-HIV_Chain
caggugcaacugguccagagcggcgccgagguuaagaaacccggguccucugugaagguaucaugcaaagcuaguggagguaccuucagcacauacgcauuuuccugggugagacaggccccuaucgaaggccucgaguggaugggagggauuauaccaaucuucggcacugaaaacuaugcgcagaaguuucaagguagggucacgauuaccgcugacaaaucuacaucgacugccuacauggagcuuucaagccugcggagugaagauaccgcaguguauuacugugcccgcgaccgauccucugcuaucggguauugcagcuccauuucauguuacaagggaaguuucgauaucuggggccagggcacaaugguuaccgugagcucugcauccacuaagggg

SEQ ID NO: 27484 - RNA, 405 nt, Artificial Sequence
  derived and/or modified sequence opt3 from anti-HIV_Chain
caggugcaacugguccagagcggcgccgagguuaagaaacccggguccucugugaagguaucaugcaaagcuaguggagguaccuucagcacauacgcauuuuccugggugagacaggccccuggccaggggcucgaauggaugggaggcaucauuccaauauucgguacugagaacuaugcgcaaaaguuucaggggagggucacgaucaccgcugacaaaucuacaucgacugccuacauggaacuuucaagccugcggagugaggauaccgcaguguauuacugugcccgcgaccgauccucugcuauuggauauugcagcuccaucucauguuacaagggcaguuucgauauuuggggccaggggacaaugguuaccgugagcucugcauccacuaaggga

SEQ ID NO: 27485 - RNA, 405 nt, Artificial Sequence
  derived and/or modified sequence opt3 from anti-HIV_Chain
gaggugcagcuggucgaaagcggcgggggacucguucaacccgguggcucccuuagacugucuugcgccgcuucaggguucaccuuuaguagcuacuccaugaacugggugaggcaggcaccuggaaagggcuuggaguggguaucuuauaucucggguucaagcuacacaauuuauuacgccgacagugugcgggggcgcuucacuauaucccgagauaaugcgaaaaacucuuuauaucugcagaugaauagccuacgugacgaagauacggcugucuacuuuugugccagagcaaccccaccgaacccccucaaucuguauaacuacgacuccucaggaaguagcuucgauuacuggggccagggcacacuugugacuguuucuuccgccucaaccaagggg

SEQ ID NO: 27486 - RNA, 405 nt, Artificial Sequence
  derived and/or modified sequence opt3 from anti-HIV_Chain
gaggugcagcugguccaaagcggcgccgaaguuaagaaacccggguccucugugaagguaucaugcaaagcuaguggagguaccuucagcacauacgcauuuuccugggugagacaggccccuggccaggggcucgaguggaugggaggcaucauuccaauauucgguacugaaaacuaugcgcagaaguuucaagggagggucacgaucaccgcugacaaaucuacaucgacugccuacauggagcuuucaagccugcggagugaagauaccgcaguguauuacugugcccgcgaccgauccucugcuauuggauauugcagcuccaucucauguuacaagggcaguuucgauauuuggggccaggggacaaugguuaccgugagcucugcauccacuaaggga

SEQ ID NO: 27487 - RNA, 405 nt, Artificial Sequence
  derived and/or modified sequence opt3 from anti-HIV_Chain
gaggugcagcuggucgaaagcggcgccgagguuaagaaacccggguccucugugaagguaucaugcaaagcuaguggagguaccuucagcacauacgcauuuuccugggugagacaagccccuggccaggggcucgaauggaugggaggcaucauuccaauauucgguacugagaacuaugcgcagaaguuucaggggagggucacgaucaccgcugacaaaucuacaucgacugccuacauggaacuuucaagccugcggagugaggauaccgcaguguauuacugugcccgcgaccgauccucugcuauuggauauugcagcuccaucucauguuacaagggcaguuucgauauuuggggccaagggacaaugguuaccgugagcucugcauccacuaaggga

SEQ ID NO: 27488 - RNA, 405 nt, Artificial Sequence
  derived and/or modified sequence opt3 from anti-HIV_Chain
ccccuggugcagcucgagccuagcggcgucgaaguuaagaaaagaggggccuccgugaagguaucuugcaaagugucaggauacagucuuaccgagcugagcaugcacugggucaggcaagcuccagguaagggcuuggaauggaugggguccuucgacccguuagauggagacacaaucuaugcacagaaauuucagggccgggugacuaugacgguugauaccucuacagacacugccuacauggaucugucgucacuacgcuucgaggacaccgcgguguauuacugugcuacacccagcaaggccuauuacuaugauaguccuaacuacgaaggugacuuuuacauggaugucugggggaagggaaccacugugauuguauccucugcaagcacaaaaggc

SEQ ID NO: 27489 - RNA, 408 nt, Artificial Sequence
  derived and/or modified sequence opt3 from anti-HIV_HeavyChain
cagauccaccuggugcaaagcggcaccgaggucaagaaacccggguccucuguuacagugucaugcaaggccuacggaguaaacacuuucggucucuaugcugugaauugggucagacaggcaccuggccagagucuugaauacauugggcagauauggagguggaaaagcuccgccucucaucacuuucggggacgcgugcugaucucggcgguugacuugacgggcucaagcccaccgauuaguuccuuagagaucaagcugaccucugaugacacagcuguguauuucuguacuaccacaagcaccuacgauaaaugguccggucuacaucacgacggggucauggccuuuucaagucgaggacaaggcacucucauuagcgugucugcagccuccacaaagggc

SEQ ID NO: 27490 - RNA, 408 nt, Artificial Sequence
  derived and/or modified sequence opt3 from anti-HIV_HeavyChain
cagauccaccuggugcaaagcggcaccgaggucaagaaacccggguccucuguuacagugucaugcaaggccuacggaguaaacacuuucggucucuaugcugugaauugggucagacaggcaccuggccaggggcuugaauacauuggacagauauggagguggaaaaguagcgccucccaucacuuucggggccgcgugcugaucucugcgguugacuugacggguucgucaccaccgauuagcaguuuagagaucaaggugaccuccgaugacacagcugucuauuucuguacuaccacaucuaccuacgaugaauggagcgaccugcaucacgauggggugauggccuuuuccucauggggacaaggcacucuaauuaguguaagcgcagccucuacaaaaggc

SEQ ID NO: 27491 - RNA, 408 nt, Artificial Sequence
  derived and/or modified sequence opt3 from anti-HIV_HeavyChain
cagauccaccuggugcaaagcggcaccgaggucaagaaacccggguccucuguuacagugucaugcaaggccuacggaguaaacacuuucggucucuaugcugugaauugggucagacaggcaccuggccagagucuugaauacauugggcagauauggagguggaaaagcuccgccucucaucacuuucggggacgcgugcugaucucggcgguugacuugacgggcucaagcccaccgauuaguuccuuagagaucaagcugaccucugaugacacagcuguguauuucuguacuaccacaagcaccuacgaucgaugguccggucuacaucacgacggggucauggccuuuucaaguuggggacaaggcacucucauuagcgugucugcagccuccacaaaaggc

SEQ ID NO: 27492 - RNA, 408 nt, Artificial Sequence
  derived and/or modified sequence opt3 from anti-HIV_Chain
ugcaaccccagagugcacagcgagguccagcugguugaauccggcgccgaggugaagaaaccuggggcuucuguaaagguggcauguaaagucucaggaaagaaacucagugaccuuagcauccauugggugaggcaagccccagguaagggccuggaauggaugggaggguucgaugaggaagacggcaagauuuccuacgagcggaaauuucagggucgcguuucuaugaccgaggauacagcgcgagacacugcuuucauggaaaugucgucauugcguagcgaugacacggccguguauuuuugcgcagccgcuccgagauuagaucugggggagcuaaguuccggauuccacuuuuggggccucggcacccuggucacagugucuagcgcauccacuaagggg

SEQ ID NO: 27493 - RNA, 408 nt, Artificial Sequence
  derived and/or modified sequence opt3 from anti-HIV_Chain
aucugggcuccccugauugccgugaccuuccucguccuucacugcgagagccugggcacauguugcuguugccaggcauccgggggaacuuuuaacacguucgccauaaauuggguuagacaagcgccuggucagggcuuggaauggguagggggaaucauuccaguguuuggcaccgcuucuuacgcccagaaguuccaggguagggugacagucacuaccgacgagucacgggggacagcauauauggaauuaaacagucugcgcagcgaggauaccgccguguacuauugugcucgaggacaaacugaccuaaaugaugaccucugguccgauuacucuacaccgggcuuugacuauuggggccaggggacccugguuacggugucgucagcaagcacuaaagga

SEQ ID NO: 27494 - RNA, 408 nt, Artificial Sequence
  derived and/or modified sequence opt3 from anti-HIV_Chain
cugcagcccagagugcacagcgagguccaacucguugaauccggcgccgaggugaagaaaccuggggcuucuguaaaggugucaugcaaagucaguggauacacccuuagcgaccuguccaugcauugggugaggcaggcaccagguaagggcuuggaauggaugggaggguucgaugaggaagacggcgagaucacauaugcccagaaauuucagggucggguuucuaugacugaggauacgucgcgcgacaccgcguacauggaauuaucaagccugcgaagugaggauacagcuguguauuacugugccacugcaccgcgucuagaacucggggagcuguccucuggauuccacuauuggggccuuggcacccuggucacagugagcuccgccucaaccaagggg

SEQ ID NO: 27495 - RNA, 408 nt, Artificial Sequence
  derived and/or modified sequence opt3 from anti-HIV_Chain
cagagccaagugcaccugguccaguccggcgccgagguuaagaaacccgggucuucagugaagguaaguugccaggcuagcggagguaccuucaacacauuugcaaucaauugggugagacaggccccuggccaagggcucgaaugggucggaggcauuauaccaguguucgguacugcguccuacgcucagaaauuucaggggaggguuacggugaccacagacgagucucggggaacugccuauauggaacuuaacucgcugcgcucagaggauaccgcagucuacuauugugcccgaggccagacagacuugaaugaugacuuauggagcgauuacaguaccccgggcuucgacuauugggggcaaggaacucuggugacaguauccucugcuagcaccaagggu

SEQ ID NO: 27496 - RNA, 408 nt, Artificial Sequence
  derived and/or modified sequence opt3 from anti-HIV_Chain
ggcagcgaggugcagcuggucgaauccggggccgagguuaagaaaagaggagcuucugugaagguaucaugcaaagugagugguuacagccucaccgaacuuuccaugcacugggucaggcaagcacccggcaaggggcuggaguggaugggaucuuucgacccuuuggauggcgacacaaucuaugcccagaaauuucagggucgggugacuaugacgguugauaccucgacagacacugcguacauggauuuaucaagccugcgcuucgaagacaccgcuguguauuacugugccacaccaaguaaggcauauuacuaugauuccccgaacuacgagggggacuuuuacauggaugucuggggaaagggcaccacugugauuguaucuagcgccuccacaaaaggc

SEQ ID NO: 27497 - RNA, 408 nt, Artificial Sequence
  derived and/or modified sequence opt3 from anti-HIV_Chain
caggugcaacugguccagagcggcggggagguuaagaaacccggagccuccgugaagguaucuugcaaagugucagguuacagucucaccgaacuuagcaugcacugggucagacaggcuccuggcaaggggcuggaguggaugggaguguucgacccauuggaaggcgaugguguuuaugugcagaaauuuagggggcgggucaucaugacagaggacacuuccacggauaccgcauacauggaauuaacaucucugcgcucggaggacacugccauuuauuacugugcgaccaaggcuaaggauuauuacuaugagucaagcgacuacaguccguacuauuacuauuacauggauguguggggaaaaggcacaaccguaacuguuuccucugccagcacaaagggc

SEQ ID NO: 27498 - RNA, 408 nt, Artificial Sequence
  derived and/or modified sequence opt3 from anti-HIV_Chain
gaggugcagcugguccaaagcggcgccgaaguuaagaaacccggggcuuccgugaagguaucuugcaaagugucaggauacacccucacagagcuuaguaugcacugggucagacaggcaccugguaagggccuggaauggauggggguguucgacccauuggagggagauggcguuuaugccgaaaaauuuaggggucgggugaucaugacugaggacacgagcaccgauacaggguacauggaguuaacuucccugcgcucugaagacaccgcgauuuauuacugugcuacaaaggccaaggauuauuacuaugagucgucagacuacagcccguacuauuacuauuacauggaugucuggggaaaaggcaccacugugacaguaaguuccgcaucuaccaagggc

SEQ ID NO: 27499 - RNA, 408 nt, Artificial Sequence
  derived and/or modified sequence opt3 from anti-HIV_Chain
caggugcaacugguccagagcggcgccgagguuaagaaacccggggcuuccgugaagguaucuugcaaagcaucaggauacaccuucacaagauaucacauccauugggugaggcacgccccuggucagggccucgaauggauggggaagauuaacccaagucgggcgagcacuaaauacgcuaagaaguuucaggaccgcgucacgaugacccgagauacauccacuucuaccguguauauggagcuuucgucacugcguggagacgauacagccguuuacuauuguggcagagaaauggguaccuucacuuuguuagggguggucauagaccauuacgauuuuuauccgauggacguguggggacaaggcacacccguaaccguuagcagugcauccacgaaaggc

SEQ ID NO: 27500 - RNA, 408 nt, Artificial Sequence
  derived and/or modified sequence opt3 from anti-HIV_Chain
agcagacccccuuccugccugcucggcuguuggugcuguucuggguuccuucugccagccgugaucuugccgaacuuacacucacccugccugagucuacucgagagccagccuccaucccuggcugaccuugucucugcauuugccguuauggauauucccauauacaucggaaccuauaggucgcaagcgucacugcauagcaguuccacaaaguucccuacugacuuuuuggguucucagacgggcagcguggcuguagggcagggacagauuucccaccuccggucaguggaauggcgccugcgaaugugggaguucaucaccgcccugaaaguccauauguuucucagucguagcgauagaggcccaagguggaagaaugugucuuccuuacugaacucacgg

SEQ ID NO: 27501 - RNA, 411 nt, Artificial Sequence
  derived and/or modified sequence opt3 from anti-HIV_HeavyChain
cagauccaccuggugcaaagcggcaccgaggucaagaaacccggguccucuguuacagugucaugcaaggccuacggaguaaacacuuucggucucuaugcugugaauugggucagacaggcaccuggccagagucuugaauacauugggcagauauggagguggaaaagcuccgccucucaucacuuucggggacgcgugaucauuucggcgguugaccugacgggcucaagcccaccgaucagucccuuggagauuaagaacuuaaccuccgaugacacagcuguguauuucuguacuaccacaucuaccagcgaucgaugguccggucugcaucacgacggggucauggccuuuucaaguuggggacaaggcacucuaaucagcgugucugcagccuccacaaaaggc

SEQ ID NO: 27502 - RNA, 411 nt, Artificial Sequence
  derived and/or modified sequence opt3 from anti-HIV_HeavyChain
cagauccaccuggugcaaagcggcaccgaggucaagaaacccggguccucuguuacagugucaugcaaggccuacggaguaaacacuuucggucucuaugcugugaauugggucagacaggcaccuggccagagucuugaauacauugggcagauauggagguggaaaagcuccgccucucaucacuuucggggacgcgugaucauuucggcgguugaccugacgggcucaagcccaccgaucaguuccuuggagauuaagaacuuaaccucugaugacacagcuguguauuucuguacuaccgccagcacauacgauaaaugguccggucugcaucacgacggggucauggcauuuucaaguuggggacaaggcacccuaaucagcgugucugccgcuuccacuaagggc

SEQ ID NO: 27503 - RNA, 411 nt, Artificial Sequence
  derived and/or modified sequence opt3 from anti-HIV_HeavyChain
cagauccaccuggugcaaagcggcaccgaggucaagaaacccggguccucuguuacagugucaugcaaggccuacggaguaaacacuuucggucucuaugcugugaauugggucagacaggcaccuggccagagucuugaauacauugggcagauauggagguggaaaagcuccgccucucaucacuuucggggacgcgugcugaucucggcgguugacuugacgggcccaucaccgcccauuagcaguuuagagaucaagaaccugaccuccgaugacacagcuguguauuucuguacuaccacaucuaccuacgauaaauggagcggucuacaucacgacggggucauggccuuuuccucauggggacaaggcacucucauuagugugagcgcagccucuacaaagggc

SEQ ID NO: 27504 - RNA, 411 nt, Artificial Sequence
  derived and/or modified sequence opt3 from anti-HIV_HeavyChain
cagauccaccuggugcaaagcggcaccgaggucaagaaacccggguccucuguugccgugucaugcaaggcuuacggaguaaacacauucggucucuaugcagugaauugggucagacaggccccuggccagagucuugaauacauugggcagauauggagguggaaaagcuccgcgucucaugacuuucggggacgcgugaucauuucggcuguugaucugacuggcucaagcccaccgaucaguuccuuggagauuaagaacuuaacgucugacgauaccgccguguauuucuguacagcaacuagcacccccgacuacugguccggucugcaccaugauggggucauggccuuuucaaguuggggacaaggcacacuaaucagcgugucugcugcauccaccaaaggc

SEQ ID NO: 27505 - RNA, 411 nt, Artificial Sequence
  derived and/or modified sequence opt3 from anti-HIV_HeavyChain
cagauccaccuggugcaaagcggcaccggggucaagaaacccggauccucuguuacagugucaugcaaggccuacgguguaaacacuuucggccucuaugcugugaauugggucagacaggcaccugggcagggacuugaguacauuggccagauauggagguggaaaaguagcgccucccaucacuuucggggucgcgugcugaucucugcgguugacuugacggggucgucaccaccgauuaccagcuuagaaaucaagaacgugacaagugaugacacugcugucuauuucuguaccacaaccuccacuuacgauaaauggucuggacuguaucaugacggcgugauggccuuuagcuccuggggccaagggacacuaauuucaguaagugcagccagcaccaaggga

SEQ ID NO: 27506 - RNA, 411 nt, Artificial Sequence
  derived and/or modified sequence opt3 from anti-HIV_HeavyChain
cagauccaccuggugcaaagcggcaccgaggucaagaaacccggguccucuguuacagugucaugcaaggccuacggaguaaacacuuucggucucuaugcugugaauugggucagacaggcaccuggccagagucuugaauacauugggcagauauggagguggaaaagcuccgccucucaucacuuucggggacgcgugaucauuucggcgguugaccugacgggcucaagcccaccgaucaguuccuuggagauuaagaacuuaaccucugaugacacagcuguguauuucuguacuaccacaagcaccuccgauuacuggucaggucugcaucacgacggggucauggccuuuaguagcuggggacaaggcacucuaaucucuguguccgcagccucaacaaaaggc

SEQ ID NO: 27507 - RNA, 411 nt, Artificial Sequence
  derived and/or modified sequence opt3 from anti-HIV_HeavyChain
cagauccaccuggugcaaagcggcaccgaggucaagaaacccggguccucuguuacagugucaugcaaggccuacggaguaaacacuuucggucucuaugcugugaauugggucagacaggcaccuggccagagucuugaauacauugggcagauauggagguggaaaagcuccgccucucaucacuuucggggacgcgugcugaucucggcgguugacuugacgggcucaagcccaccgauuaguuccuuagagaucaagaaccugaccucugaugacacagcuguguauuucuguacuaccacaagcaccuacgaucgaugguccggucuacaucacgacggggucauggccuuuucaaguuggggacaaggcacucucauuagcgugucugcagccuccacaaaaggc

SEQ ID NO: 27508 - RNA, 411 nt, Artificial Sequence
  derived and/or modified sequence opt3 from anti-HIV_HeavyChain
cagauccaccuggugcaaagcggcaccgaggucagaaagcccggguccucuguuacagugucaugcaaagccuacggaguaaacacuuucggucucuaugcugugaauugggucaggcaggcaccuggccagagucuugaauacauugggcagauauggcgguggaaaagcuccgccucucaucacuuucgcggacgagugcugaucucggcgguugacuugacgggcucaagcccaccgauuaguuccuuagagaucaagaaccugaccucugaugacacagcuguguauuucuguacuaccacaagcaccuacgauaagugguccggucuacaucacgacggggucauggccuuuucaaguuggggacaaggcacucucauuagcgugucugcagccuccacaaaaggc

SEQ ID NO: 27509 - RNA, 411 nt, Artificial Sequence
  derived and/or modified sequence opt3 from anti-HIV_HeavyChain
cagauccaccuggugcaaagcggcaccgaggucaagaaacccggguccucuguuacagugucaugcaaggccuacggaguaaacacuuucggucucuaugcugugaauugggucagacaggcaccuggccagagucuugaauacauugggcagauauggagguggaaaagcuccgccucucaucacuuucggggacgcgugcugaucucggcgguugacuugacgggcucaagcccaccgauuaguuccuuagagaucaagaaccugaccucugaugacacagcuguguauuucuguacuaccacaagcaccuacgaucaaugguccggucuacaucacgacggggucauggccuuuucaaguuggggacagggcacucucauuagcgugucugcagccuccacaaaaggc

SEQ ID NO: 27510 - RNA, 411 nt, Artificial Sequence
  derived and/or modified sequence opt3 from anti-HIV_HeavyChain
cagauccaccuggugcaaagcggcaccgaggucaagaaacccggguccucuguuacagugucaugcaaggccuacggaguaaacacuuucggucucuaugcugugaguugggucagacaggcaccuggccagaggcuugaauacauugggcagauacggcgcuggaaaagcuccgccucucaucacuuucgaggacgugugacgguuucggcgguggacccaaccggcucaagcccgcccaucaguucccuggagauuagagauuugacaacugacgauaccgcugucuauuucuguacaaccacuucuacaagcgacuacugguccgguuuacauaaugaaagggggaccgccuuuucaaguuggggacaaggcacgcugaucagcgugucugcagccuccacuaagggc

SEQ ID NO: 27511 - RNA, 411 nt, Artificial Sequence
  derived and/or modified sequence opt3 from anti-HIV_HeavyChain
cagauccaccuggugcaaagcggcaccgaggucaagaaacccggguccucuguuacagugucaugcaaggccuacggaguaaacacuuucggucucuaugcugugaauugggucagacaggcaccuggccaggggcuugaauacauuggacagauauggagguggaaaaguagcgccucccaucacuuucggggccgcgugcugaucucugcgauugacuugacggguucgucaccaccgaucagcaguuuagagauuaagaacguuaccuccgaugacacagcuguguauuucuguacuaccaugucuacauacgauaaauggagcgggcugcaucacgacggagucauggccuuuuccucauggggccaaggcacccuaaucagugugagcgcagccucuacuaagggg

SEQ ID NO: 27512 - RNA, 411 nt, Artificial Sequence
  derived and/or modified sequence opt3 from anti-HIV_HeavyChain
cagauccaccuggugcaaagcggcaccgaggucaagaaacccggguccucuguuacagugucaugcaaggccuacgaaguaaacacuuucggacucuaugcugugaauugggucagacaggcaccuggucagagucuugaguacauuggccagauauggagguggaaaagcuccgccucucaucacuuucgggggcgcgugcugaucucggcgguugacuugacgggaucaagcccaccgauuaguuccuuagaaaucaagaacgugaccucugaugacacagcugucuauuucuguacuaccacaagcacccaugauaaaugguccggccugcaccaugacggugugauggccuuuucaaguugggggcaaggaacucuaauuagcguaucugcagccuccacaaagggc

SEQ ID NO: 27513 - RNA, 411 nt, Artificial Sequence
  derived and/or modified sequence opt3 from anti-HIV_HeavyChain
cagauccaccuggugcaaagcggcaccgaggucaagaaacccggguccucuguuacagugucaugcaaggccuacggaguaaacacuuucggucucuaugcugugaauugggucagacaggcaccuggccaggggcuugaauacauuggacagauauggagguggaaaaguagcgccucccaucacuuucggggccgcgugcugaucucugcgguugacuugacggguucgucaccaccgauuagcaguuuagagaucaagaacgugaccuccgaugacacagcugucuauuucuguacuaccacaucuaccuacgauaaauggagcgggcugcaucacgacggagugguagccuuuuccucauggggccaaggcacucuaauuaguguuagcgcagccucuacaaagggg

SEQ ID NO: 27514 - RNA, 411 nt, Artificial Sequence
  derived and/or modified sequence opt3 from anti-HIV_Chain
caggugacccugguccaaagcggcgccgagguuaagaaacccggggcuuccgugagaaucucuugcagggcaucaggauucacauuugacgauuacagugacuauagcuucauuccuacuacguaccucauacacugguuucggcaggccccaggucagggccuugaauggauggcguggaucaacuccguaaaugggggacgcaacauugcucgacaguuccaaggccgugugaccgucgccagagauaggucuaauucgaucgcauuucuggaguucucagguuugcggcaugacgauacagccguguauuuuugugcucgcgacagaagggaugacgaucgggcaugguuacuggacccgugggggcagggaacucgcguuaccgugagcagugccuccacaaagggc

SEQ ID NO: 27515 - RNA, 411 nt, Artificial Sequence
  derived and/or modified sequence opt3 from anti-HIV_Chain
cagauccaccuggugcaaagcggcaccgaggucaagaaacccggguccucuguuacagugucaugcaaggccuacggaguaaacacuuucggucucuaugcugugaauugggucagacaggcaccuggccagagucuugaauacauugggcagauauggagguggaaaagcuccgccucucaucacuuucggggacgcgugcugaucucggcgguugacuugacgggcucaagcccaccgauuaguuccuuagagaucaagaaccugaccucugaugacacagcuguguauuucuguacuaccacaagcaccuacgauaaaugguccggucuacaucacgacggggucauggccuuuucaaguuggggacaaggcacucucauuagcgugucugcagccuccacaaagggc

SEQ ID NO: 27516 - RNA, 414 nt, Artificial Sequence
  derived and/or modified sequence opt3 from anti-HIV_Chain
gugguccagcugguucaaagcggcgccgaggugagaaagcccggguccucucucaaaguaucaugcaagaguagcggagguaccuucuccagguuuguggucaacugggugcggcaggcuccuggccaggggcuugaauggaugggaggcaugaucccaauuuucgguauagcaaaauacgcccagaaguuucaagaccgcguuacaaugacugcggaugagucuaaaaauacgguguaucuggacuucucgucauugcgaagcgaugacaccgcugucuacuauugugcccgugauagaggggacacaagguuacuggauuacggagacuaugaagaugagcgguacuauuacggcauggacguguggggccaggggacuaccguaaucguuaguuccgcaucuacaaaggga

SEQ ID NO: 27517 - RNA, 414 nt, Artificial Sequence
  derived and/or modified sequence opt3 from anti-HIV_Chain
caggugcaacugguccagagcggcgccgagguuagaaagcccggguccucucucaaagugucaugcaagaguagcggagguaccuucuccagguuuguagugaacuggguccggcaggcuccuggccaggggcuugaauggaugggaggcaugaucccaauuuucgguauagcaaaauacgcccaaaaguuucaggaccgcgugacaaugacugcggaugagucuaaaaauacgguuuaucuggacuucucgucauugcgaagcgaugacaccgcuguguacuauugugcccgugauagaggggacacaagguuacuggauuacggagacuaugaagaugagcgguacuauuacggcauggacgucuggggccaggggacuaccgugaucguaaguuccgcaucuacaaaggga

SEQ ID NO: 27518 - RNA, 414 nt, Artificial Sequence
  derived and/or modified sequence opt3 from anti-HIV_Chain
gaggugcagcuggucgaaagcggcgccgagguuagaaagcccggguccucucucaaagugucaugcaagaguagcggagguaccuucuccagguuuguagugaacuggguccggcaagcuccuggccaggggcuugaauggaugggaggcaugaucccaauuuucgguauagcaaaauacgcccagaaguuucaggaccgcgugacaaugacugcggaugagucuaaaaauacgguuuaucuggacuucucgucauugcgaagcgaugacaccgcuguguacuauugugcccgugauagaggggacacaagguuacuggauuacggagacuaugaagaugagcgguacuauuacggcauggacgucuggggccaagggacuaccgugaucguaaguuccgcaucuacaaaggga

SEQ ID NO: 27519 - RNA, 414 nt, Artificial Sequence
  derived and/or modified sequence opt3 from anti-HIV_Chain
caggugcaacuggucgagagcggcgccgaaguuagaaagcccggguccucucucaaagugucaugcaagaguagcggagguaccuucuccagguacguagugaacuggguccggcaggcuccuggccaggggcuugaguggaugggaggcaucauuccaauauuugguaucgcaaaauaugcccagaaguuccaagaccgcgugacaaugacugcggaugaaccgaaaaauacgguuuaccuggacuuuaacucuuugcgaucggaugacaccgcuguguauuacugugcccgugauagaggggacacaagguuacuggauuauggagacuacgaggaugaacgguauuacuacggcauggacgucuggggccaggggacuaccgugauuguaucaagcgcaaguacaaaggga

SEQ ID NO: 27520 - RNA, 414 nt, Artificial Sequence
  derived and/or modified sequence opt3 from anti-HIV_Chain
caggugcaacugguccagagcggcgccgagguuagaaagcccggguccucucucaaagugucaugcaagaguagcggagguaccuucuccagguacguagugaacuggguccggcaggcuccuggccaggggcuugaauggaugggaggcaugaucccaauuuuugguauagcaaaauaugcccaaaaguuccaggaccgcgugacaaugacugcggaugagucuaaaaauacgguuuaccuggacuuuucgucauugcgaagcgaugacaccgcuguguauuacugugcccgugauagaggggacacaagguuacuggauuauggagacuacgaagaugagcgguauuacuacggcauggacgucuggggccaggggacuaccgugaucguaaguuccgcaucuacaaaggga

SEQ ID NO: 27521 - RNA, 414 nt, Artificial Sequence
  derived and/or modified sequence opt3 from anti-HIV_Chain
caggugcaacugguccagagcggcgccgagguuagaaagcccggguccucucucaaagugucaugcaagaguagcggagguaccuucuccagguacguagugaacuggguccggcaggcuccuggccaggggcuugaauggaugggaggcaucauuccaauauuugguaucgcaaaauaugcccaaaaguuccaggaccgcgugacaaugacugcggaugagucuaaaaauacgguuuaccuggacuuuucgucauugcgaagcgaugacaccgcuguguauuacugugcccgugauagaggggacacaagguuacuggauuauggagacuacgaagaugagcgguauuacuacggcauggacgucuggggccaggggacuaccgugauuguaaguuccgcaucuacaaaggga

SEQ ID NO: 27522 - RNA, 414 nt, Artificial Sequence
  derived and/or modified sequence opt3 from anti-HIV_Chain
caggugcaacuggucgagagcggcgccgaaguuagaaagcccggguccucucucaaagugucaugcaagaguagcggagguaccuucuccagguacguagugaacuggguccggcaggcuccuggccaggggcuugaguggaugggaggcaucauuccaauauuugguaucgcaaaauaugcccagaaguuccaagaccgcgugacaaugacugcggaugaaucuaaaaauacgguuuaccuggacuuuucgucauugcgaagcgaugacaccgcuguguauuacugugcccgugauagaggggacacaagguuacuggauuauggagacuacgaggaugaacgguauuacuacggcauggacgucuggggccaggggacuaccgugauuguaaguuccgcaucuacaaaggga

SEQ ID NO: 27523 - RNA, 414 nt, Artificial Sequence
  derived and/or modified sequence opt3 from anti-HIV_Chain
caggugcaacugguccagagcggcgccgagguuagaaagcccggguccucucucaaagugucaugcaagaguagcggagguaccuucuccagguacguagugaacuggguccggcaggcuccuggccaggggcuugaauggaugggaggcaucauuccaauauuugguaucgcaaaauaugcccaaaaguuccaggaccgcgugacaaugacugcggaugagccgaaaaauacgguuuaccuggacuuuaacucuuugcgaucggaugacaccgcuguguauuacugugcccgugauagaggggacacaagguuacuggauuauggagacuacgaagaugagcgguauuacuacggcauggacgucuggggccaggggacuaccgugauuguaucaagcgcaaguacaaaggga

SEQ ID NO: 27524 - RNA, 414 nt, Artificial Sequence
  derived and/or modified sequence opt3 from anti-HIV_Chain
gugguccagcugguucaaagcggcgccgaggugagaaagcccggguccucucucaaaguaucaugcaagaguagcggagguaccuucuccagguacguggucaacugggugcggcaggcuccuggccaggggcuugaauggaugggaggcaugaucccaauuuuugguauagcaaaauaugcccagaaguuccaagaccgcguuacaaugacugcggaugagucuaaaaauacgguguaccuggacuuuucgucauugcgaagcgaugacaccgcugucuauuacugugcccgugauagaggggacacaagguuacuggauuauggagacuacgaagaugagcgguauuacuacggcauggacguguggggccaggggacuaccguaaucguuaguuccgcaucuacaaaggga

SEQ ID NO: 27525 - RNA, 414 nt, Artificial Sequence
  derived and/or modified sequence opt3 from anti-HIV_Chain
uucaucugcuuuagcguggucguuagacugcucgaguucggcgggaggcuugugcagcccggagguucccugcgguugucuuguucagccaguggcuuuaccuucagcaacuccgcuaugucuuggguacgccaagcaccugggaagggauuagaaugggugucgucaauucugagcaguggcgucgguacauuuuacgccgacuccgugaaagggcgauucacuguuucucgugauaauagcagaaacacgcuauaucuccagaugaagucccugagggcggaggacaccgcucuuuacuauugcgccaaagugcagauacagcaacugaauuuuggagucaucacagaugcaggcuuggacguguggggcaaggggacuacccucauuguaucaagugccagcacaaaagga

SEQ ID NO: 27526 - RNA, 414 nt, Artificial Sequence
  derived and/or modified sequence opt3 from anti-HIV_Chain
caggugcaacugguccagagcggcgccgagguuagaaagcccggguccucucucaaagugucaugcaagaguagcggagguaccuucuccagguacguagugaacuggguccggcaggcuccuggccaggggcuugaauggaugggaggcaucauuccaauauuugguaucgcaaaauaugcccaaaaguuccaggaccgcgugacaaugacugcggaugagucuaaaaauacgguuuaccuggacuuuucgucauugcgaagcggggauaccgcuguguauuacugugcccgugacagaggagauacaagguuacuggacuauggcgauuacgaagacgagcgguauuacuacggcauggaugucugggggcagggaacuaccgugacaguaaguuccgcaucuaccaagggu

SEQ ID NO: 27527 - RNA, 417 nt, Artificial Sequence
  derived and/or modified sequence opt3 from anti-HIV_Chain
caggugcaacuggucgagagcggcgccgaaguuaagaaacccggguccucugugaagguaucaugcaaagcuaguggagguaccuucaacaucuuugcauucagcugggugagacaggccccuggccaggggcucgaguggaugggaggcauuauaccaaucuuugcguccccgaauuacgcucagagguuccaaggucgggucacaauuacugccgacgaaucuacgucgaccgugcacauggagcuuucaagccugcgcagugaagauacagcaaucuauuacugugccaaggacgcucauaugcacauugaggagccccgagauuaugacuacaucugggggacuuccccuuauuacuuugauuauuggggacagggcaccuugguuacagugucuagcgcauccaccaaaggc

SEQ ID NO: 27528 - RNA, 417 nt, Artificial Sequence
  derived and/or modified sequence opt3 from anti-HIV_Chain
caggugcaacuggucgagagcggcgccgaaguuaagaaacccggggcuuccgugaagguaucuugcaaagcaucaggauacaccuucacaagucacgacaucaacugggugagacaggccacuggucagggccucgaguggaugggguggaugaauccuaacagcggagauacgggcuaugcgcauaaguuucaggguagggucaccaugacacggaauacuccaauuuccaccgcuuacauggaacuuucuucgcugcgcucagaggacacagccguguauuacugugcacgagggcgugccaccagcagaaacacuccgugggcucacuauuacgauaguuccggauauuacggcgcaggcgacuacugggggcaaggaacauugguuaccgugucuagcgccuccacgaaaggu

SEQ ID NO: 27529 - RNA, 417 nt, Artificial Sequence
  derived and/or modified sequence opt3 from anti-HIV_Chain
caggugcaaaucagacagagcggccccgggcuggucaagccucucgagacccuuucccugucuugcauuguuuucggagguucauuuauagccuaccacuggacauggaucaggcaggcuccauugaaaggcuuagaauggauuggggacaucgaucagggaggcgacauuacuuauaguccgagccugaagucccgggugacgaugucuguagaucgcucgaaaucacaauucagccuaaagcucaguuccgugaccgcagccgacgcggcugucuacuauugugugcgaggucccccuaaccguuacgccguuacaucuuuuacuagcgggacccauagagagagguccucauauuacuucgauuauuggggaccaggcacacuggugaccgucaguagcgcaucuacuaaaggc

SEQ ID NO: 27530 - RNA, 423 nt, Artificial Sequence
  derived and/or modified sequence opt3 from anti-HIV_Chain
aacggcgggagccugagacucuccugcagggugucuggauucgguuuucaccuuuacgagaugaauuggguccggcaggcccccggcaaggggcuggaauggaucucaaguauuagcggauccggcgagucuacccauuauucggacucaauaacaggucgcuucagcaugagucgagaugaagcuaaagacuccuuguacuuacaaaugaacaaucugcguguugaggauacugcaguguauuacuguacgagaggguuuucuaugggagacggcaccggcuucagcuuugauacaugggggaggggaacuaugguaaccguguccucaggucuagacacagucagucucgccagcaccaagggcccuucuguguucccacuggcgccgugcucccggucaacuagcgaugcucgccuuagu

SEQ ID NO: 27531 - RNA, 423 nt, Artificial Sequence
  derived and/or modified sequence opt3 from anti-HIV_Chain
caggugcaacugguccagagcggcgccgagguuaagaaacccggguccucugugaagguaucaugcaaagcuaguggagguaccuucagcacauacgcaaucuccugggugagacaggccccuggccaggggcucgaauggaugggaggcauuauaccaucuuuuucgaugucaaacuaugcgcaagacuuccaggguaggcuuacuaucacggcugaugagagcaccaguuccgucuacauggaacugaacucuuugcggagcgaggacacagccguguauuacugugcacgcgauuuuccgcgauuccaccguuuaguugggaauuaugacuuuuggagaggaacucuggauagguucuccuacauggaccuauggggccggggcaccgccgugacagucucaagugcuagcaccaagggg

SEQ ID NO: 27532 - RNA, 423 nt, Artificial Sequence
  derived and/or modified sequence opt3 from anti-HIV_Chain
cuggugcagcucgucgagagcggcgggggaguugugcaacccgguagaucccuuaggcugucuugcgccgcuucaggcuucaccuuuaguacauacgcaaugcacuggguacggcaggccccugggaagggauuggaauggguggcggucaucagcuaugacggcuccaacaaauucuacgcugauucugugaagggucgcuuuacuauuucgcgagacaauucaaagaacacguuauaucugcagaugaauagccuacgugccgaggauaccgcaguuuacuauugugccagaccaaaauuccucccgggggcugacauaguggucgugguagcagccacacccuuugauuacuggggacagggcaacccuggccauaggcugcuuaguuuccaccaagggccaaucggacugcccccuggu

SEQ ID NO: 27533 - RNA, 423 nt, Artificial Sequence
  derived and/or modified sequence opt3 from anti-HIV_HeavyChain
auggaguggagcggcguguucaucuuucugcucuccgucaccgccgggguucacucugaagugcagcuuguagagucaggagguggccuggugaagcccgggggaaguuugagauuaagcugcgcugcauccggcuacacauucucuaacuauuggauugguugggucaggcaagccccugggaaaggacuggaauggauaggcgacaucuacccaggcgggaauuauauucggaacaaugagaaguuuaaagauaagacuacgcuaucggcggacaccucaaagaacacagcuuaccuccagaugaauagccugaaaacugaagauaccgccguguauuacuguggaaguuccuucgguucuaacuauguuuuugcaugguucacauacuggggccaggggacccuugugacugucagcucc

SEQ ID NO: 27534 - RNA, 423 nt, Artificial Sequence
  derived and/or modified sequence opt3 from anti-HIV_HeavyChain
auggaguggagcggcguguucaucuuucugcucuccgucaccgccgggguucacucucaggugcaacuuguacagucaggaccggacgugaagaaaccugguacaaguaugaagaugagcugcaaaacuuccggcuacacguucucuaacuauuggauugggugggucagacaggcuccaggacagggccuggaauggauaggugauaucuaccccgggggaaauuauauuaggaacaaugagaaguuuaaagacaagaccacauugacugcagauaccucgacaucaaccgccuacaugcaauuaggcagccugcggagugaagacacugcgguguauuacuguggcuccucuuucgggagcaacuauguuuuugcuugguucacauacuggggacaggguacccuagugacggucuccuca

SEQ ID NO: 27535 - RNA, 429 nt, Artificial Sequence
  derived and/or modified sequence opt3 from anti-HIV_Chain
cagguguucguccaacugguucagagcggcgggggacucgugcagcccgguggcuccguaagacuuucuugcaccgccucaggguuucuguucaguacauacagcaugaacugggugaggcaggcuccuggaaagggcuuggagugggucuccucuaucucgacuacgucaaauuauauuuacuaugcagacagcgugaaaggucgguuuaccauaagucgcuccaacgggcaaggaucuuuauaccugcagcuaaauagccuccgaguugaagauacagccguguauuacugugcgcgugacacuaaggucggcgcuccaagacaggauugcuaugccauggaccuguggggccagagggaucacgggcaucggcuucuguccuuccaccaaggaccgaucgguuugcccccuggcgcacuccugcag

SEQ ID NO: 27536 - RNA, 432 nt, Artificial Sequence
  derived and/or modified sequence opt3 from anti-HIV_Chain
aucauucuguuccucguggccaccgcuacaggcguccacagcgacauacagaugacucaaucccccucuucacuuagugcaagcguuggggauagagugacgauuaccugcagggccucccagucuaucgaccgguaccugaacugguaucagcauaagccuggaaaagcgccaaaguuguuaaucuacgcugccucgaaucugcacacagauguaccgucacgcuuuagcgguaguggcgcagggacuuauuucacccuaacaauuaccucccuccagcccgaggacuuugccacuuacuauugucaacagucucauagcccuuccuucggacaggaaucauacaguaucgcuuuuggccaggguacacgacuggagauaaaacguaccguggcagccccaagcgucuucaucuuucccccuucugaugaa

SEQ ID NO: 27537 - RNA, 432 nt, Artificial Sequence
  derived and/or modified sequence opt3 from anti-HIV_Chain
cugcagcaacuccaggugcccagacuuagcauguggagggucuucaagguugccgcugcaaccggcgcccagacacugacuguggaggaaccuggguccucuguaaaagugucaugcaaggcgaguggagguagcuccacggcuuacggcuauucuuggguccggcaggccccagggcaaggauuugaguggaugggccgcaucauuccguucuacgguauaaucaccuaugcacccaaauuucaggggcgagugacaauuacugccgaccguucgaccucaacaguuuacauggaauugaccagcuuaacuuucgcugauacagcacuguuuuucugugccagagacuuuggagauccuaggaacggcuauuacuucgacaguugggaucagggccuauggcucaccguguccucugcuagcacgaagggg

SEQ ID NO: 27538 - RNA, 432 nt, Artificial Sequence
  derived and/or modified sequence opt3 from anti-HIV_Chain
caggugagacuggagcaaagcggcgucgccaugaggaagcccggggcuuccguuacccucucuugccaggcaucaggauacaacuucgugaaauauaucauucacuggguacggcagaagccuggucuuggcuuugaauggguggggaugauagacccauaccgcggacgaccguggagugcccauaaauuccagggccgucugagcuuguccagagauacaucuauggagaucuuauauaugacucugacgucgcuaaagucagacgauaccgcgacauacuuuugugcuagggccgaagcagccagcgacauucacagucggcccaucauucucacugguccuggggaguauggacuggaucuugaacauauggacuggaccuggcgcauccugugcuugcucgcugucgcaccaggcugucacucccaa

SEQ ID NO: 27539 - RNA, 435 nt, Artificial Sequence
  derived and/or modified sequence opt3 from anti-HIV_Chain
auguuccuguuucucguggccggcgcuaccgggguccagagccaaguuuaccuugugcccuucggaccugagguaaagaaaccagguuccucugugaaggucucaugcaaagcaaguggcgacagcuuuacauccucugugaucacuuggguuagacaggccccggggcagggacccgaauggaugggcagggugauuccuguccuggguguggcggcuuaugcccagaaguucuacgggcggguaacgauaaccgcagauacaucgucaaacacugccuauauggagguuaauagcuugcgcuuugaagacaccgcuguguacuauugugcacgagagacaggacguggcggcaacuuagcccugagacaauacuucuuugauaguugggggcagggaacccuagucacuguguccucuccaagcacaaaaggu

SEQ ID NO: 27540 - RNA, 438 nt, Artificial Sequence
  derived and/or modified sequence opt3 from anti-HIV_Chain
caggugcaacugcaggagagcggccccgggcucgucaagccuuccggaacccuuucucugacaugcgccguuucaggugcuaguaucagcuccagaaacugguggacuugggugaggcagccaccgggcaaaggguuggaauggauuggagagauauacgaaucuggcgcaacgaauuauaaccccucguuaaagucacggguaaccaucagcguggacaaaaguaagaaucaguucucccugcgccuaacaucugucacugccgcggauaccgcuguguacuuuugugcccgacucaugacauucggugggcugauuggaacccuugacuauuggggccaaggcacucugguuacaguguugcagccuccaccccgugcacacagauaccauccuaggaaccuccugcaggagcaccugugcgcccgggucaugcca

SEQ ID NO: 27541 - RNA, 444 nt, Artificial Sequence
  derived and/or modified sequence opt3 from anti-HIV_HeavyChain
auggaguggagcggcguguucaucuuucugcucuccgucaccgccgggguucacucugaagugcagcuuguagagucaggagguggccuggugaagcccgggggaaguuugagauuaagcugcgcugcauccggcuacacauucucuaacuauuggauugguugggucaggcaagccccugggaaaggacuggaauggauaggcgacaucuacccaggcgggaauuauauucggaacaaugagaaguuuaaagauaagacuacgcuaucggcggacaccucaaagaacacagcuuaccuccagaugaauagccugaaaacugaagauaccgccguguauuacuguggaaguuccuucgguucuaacuauguuuuugcaugguucacauacuggggccaggggacccuugugacugucagcuccggagagucacugaagccguug

SEQ ID NO: 27542 - RNA, 444 nt, Artificial Sequence
  derived and/or modified sequence opt3 from anti-HIV_HeavyChain
auggaguggagcggcguguucaucuuucugcucuccgucaccgccgggguucacucucaggugcaacuuguacagucaggacccgacgugaagaaaccugguacaaguaugaagaugagcugcaaaacuuccggcuacacguucucuaacuauuggauugggugggucagacaggcuccaggacagggccuggaauggauaggugauaucuaccccgggggaaauuauauuaggaacaaugagaaguuuaaagacaagaccacauugacugcagauaccucgacaucaaccgccuacaugcaauuaggcagccugcggagugaagacacugcgguguauuacuguggcuccucuuucgggagcaacuauguuuuugcuugguucacauacuggggacaggguacccuagugacggucuccucaggcgagagucucaagccgcug

SEQ ID NO: 27543 - RNA, 447 nt, Artificial Sequence
  derived and/or modified sequence opt3 from anti-HIV_Chain
caggccagacuggaccaauggggcaccgggcuccuuaagcccagcgagacacuguccuugaaaugcgcuguguucggagucuuauuuacugauuacaacuggacguggguuaggcagucuccugguaagggccuggaauggaucgggcaccuagaccaucggggaggcgguaauuauaacccaucacucgagagucgcgugaccauuagccuggauuacuccaaagcacaguucucucuucaccugaagucgguaacaguggccgacacugcguuguauuacugugcuggggccgucaaaggauuuugguucgaugaaguguauaauugguuuggcccgggcguucgagagcccuggcucccuucaccacagcccccuccacgugcacauagaagcagucccuggcacccuccaccgagggcuccccuggugaccgccacagucccu

SEQ ID NO: 27544 - RNA, 447 nt, Artificial Sequence
  derived and/or modified sequence opt3 from anti-HIV_Chain
caggccagacuggaccaauggggcaccgggcuccuuaagcccagcgagacacuguccuugaaaugcgcuguguucggagucuuauuuacugauuacaacuggacguggguuaggcagucuccugguaagggccuggaauggaucgggcaccuagaccaucggggaggcgguaauuauaacccaucacucgagagucgcgugaccauuagccuggauuacuccaaagcacaguucucucuucaccugaagucgguaacaguggccgacacugcguuguauuacugugcuggggccgucaaaggacucugguuugaugaaaccuauacaugguucggcccguggucacagggcacccgagugacuguugcaagcgccaguacaaaggggcccuccguguuuccucuggcuccaucuagcaaguccaccucaggaacgcgugaccugagu

SEQ ID NO: 27545 - RNA, 447 nt, Artificial Sequence
  derived and/or modified sequence opt3 from anti-HIV_Chain
gccgcuagacuggaccaguggggcaccgggcucgugaagcccagcgagacacuuucccugaaaugcgcagucuucggaguugauuuuccugacuacacuuggacgugggccaggcaagcgccagguaagggcuuggaauggaucgggcaccgggaucaucgcggagguucuucauauaacccgaguuuaagcggccgagcuaccauuucccuggacacaucuaaagcccaguucucgcuacacauaaagucagugacuguagcagauaccgccacauacuauugugcuggggcaguggccggacucugguuugaggacgcuuacaauugguucggccccuggagccagggcacccuggucacuguggccgcggcaaguacaaaagggccuuccguuuuuccacuugcccccucuagcaaguccaccucaggacaugcuagugugcug

SEQ ID NO: 27546 - RNA, 450 nt, Artificial Sequence
  derived and/or modified sequence opt3 from anti-HIV_Chain
cuggcccagcucgagcaaagcggcgggggaguggucaagcccgguggcucccuuagacugccuugcgcugcaucuggguucaccuuuaucgacuacuauauggccuggauuagguuggcgccaggaaaaggcuuagaauggcugucauacauaaguaagaacggugauuauacaaaauacagcgagucccuaaaggggcgguucacuaucucucgcgacaaugcuaaaaaccucguuauucugcagcuuaaucgacugcgugccgaugacacggcaaucuauuuuugugccagagcugauggauugaccuacuucggcgaacuccugcaguauauuuuugaccuguggggccagggggcaagggugaucguaucgucagccagcacaaagggaccgaguguguucccccucgcuccuuccucuaagagcacuuccggucacgccucaguc

SEQ ID NO: 27547 - RNA, 459 nt, Artificial Sequence
  derived and/or modified sequence opt3 from anti-HIV_Chain
caggugcaacugguccagagcggcgccgagguuaagaaacccggggcuuccgugaagguaucuugcaaagugucaggauacacccucacagaacuuaguauccacugggucagacaggcaccugguaagggccuggaguggaugggaggguucgacagcgaagauggcgaggccauuuauaaacagaacuuucaagguagggugacuaugacggaagacaccuccacagauacugcguacauggaguugucucgguuacgcucggaggacaccgcuguuuauuacugugccacagcagaucgauucaagguggcccaggacgaagggcuguuugucauauucgauuauuggggacagggcaauccaggccaucgucuacucucacugcaccaggggccgaucggacuucccccugguacccugccacccaaggcuacuagcggccaugcagccagaagg

SEQ ID NO: 27548 - RNA, 462 nt, Artificial Sequence
  derived and/or modified sequence opt3 from anti-HIV_Chain
cuggugcagcucguccaaagcggcgccgagguuaagaaacccggggcuuccgugaagguaucuugcaaagugucaggauacagucuuaccgaacugagcauccacugggucagacaggcaccugguaagggcuuggaguggaugggaggguucgacuccgaagauggcgaggccauuuauaaacagaacuuucaggguagggugacaaugacugaagacacgucuaccgauacagcguacauggaguuaucgcggcugcgcucagaggacacugcuguuuauuacugugccaccgcagauccauucaagguggcccaagacgaagggcuauuugucauauucgauuauuggggacagggcacaaccggccaucgacuccugagccuucaccaggggccgcaucgucuguacaguuugggaacucuccuguccagagcucccaucgugcagacacacauggca

SEQ ID NO: 27549 - RNA, 471 nt, Artificial Sequence
  derived and/or modified sequence opt3 from anti-HIV_Chain
cagauccaccuggugcaaagcggcaccgacgucaagaaacccggguccucuguuacagugucaugcaaggccuacggaguaaacacuuucggucucuaugcugugaauugggucagacaggcaccuggccagagucuugaguacauugggcagauauggagguggaaaagcuccgccucucaucacuuucggggacgcgugcugaucucggcgguugauuugacgggcucaagcccaccgauuaguuccuuagaaaucaagaaccugaccucugacgauacagcuguguauuucuguacuaccacaagcaccuacgaccaaugguccggucuacaucacgauggggucauggccuuuucaagucgaggacagggcacucucauuagcgugucugcagccuccacaaaaggccccucaguauucccucuggcuccaagcaguaagucuaccuaugggcuugcacauguucug

SEQ ID NO: 27550 - RNA, 477 nt, Artificial Sequence
  derived and/or modified sequence opt3 from anti-HIV_Chain
cagcaccaacuggugcccugcgucgccgagguuagaaagccuggcgcuagcgugaaaguauccuguaaggugucuggguacacccucacagaaaucucaaugcauugggucaggcaggcaccaggaaaaggucuugaguggaugggcggguucgaccgggaagauggagagacuauuuaugcccagaaguuucagggccgcgugacgaugaccgaagacacaaguacugauaccgcguacauggagcugagcuccuugcgaucugaggacacagcuguuuauuacugcgccaccacuuauuuagcaguggucccggaugguuucgacggguacucgucaagcugguauugguuugaucccuggggacaaggcacacuggugaccguaaguuccgccucuaugcagggcccuaugcuacucagcccaacggggacucugcuuccccgugcuccucugguucagaccagaccaggaccc

SEQ ID NO: 27551 - RNA, 642 nt, Artificial Sequence
  derived and/or modified sequence opt3 from anti-HIV_LightChain
gacaucgugauuacccagagcacaaaguucauguccacuucugucggcgauagaguuucaauaacgugcaaagccagucaagacgugagcaccgcuguagcaugguaccagcagaagcccgggcaguccccuaaacugcucaucuauugggccucuacaaggcacacuggagugccagaucgguuuaccgguucgggcucagggacagacuacacccuuacuauuagccgcguccaagcggaggaucuggcuuuguauuacugucagcagcauuauacaaccccguggacguucggaggcgguacuaaguuagaaaucaaacgaaccguggccgcacccaguuuuguuauuuucccuccauccgacgagcagcugaagucugggacagccagcguggucugccuacucaacaauuuuuacccccgugaagcuaaggugcaauggaaaguagauaacgcacugcaguccggaaauucacaggagaguguuacugaacaggacagcaaggauucuaccuauucccuuucaagcacacugaccuugaguaaagccgacuacgagaagcacaaaguguacgcuugugaggucacgcaucaaggccucucuuccccugugacuaagagcuucaacagaggcgaaugc

SEQ ID NO: 27552 - RNA, 651 nt, Artificial Sequence
  derived and/or modified sequence opt3 from anti-HIV_Chain
cagagcgugcugacccaacccccuuccgucucugccgcuccaggccagaagguuacaaucucaugcagugggagcuccucuaacauuggaaauaacuacgugcucugguaucagcaguucccggguacugcacccaaacuucugauauacggcaauaacaagagaccuucggggaucccagacagguuuucaggaagcaaaaguggcacguccgccaccuuggguauuacaggguuacaaacuggagaugaggcggacuauuucugugcuaccugggauucuggccugagcgccgacuggguauuuggcgggggaacaaagcuaaccgugcucucccagcccaaagcagccccuucagucacucuguucccacccaguagcgaggaacuucaggcuaauaaggcaacacuggugugcuugaucucugauuuuuacccuggugccguuaccguggcuuggaaggccgacuccucaccagucaaagcgggcguggaaacgacuaccccgagcaagcagaguaacaauaaauaugcagccucuuccuaccucagccugacacccgagcaauggaagucgcaccggucuuauuccugucagguaacucaugaagggucaaccguugagaaaacaguggcuccuaccgagugcagu

SEQ ID NO: 27553 - RNA, 657 nt, Artificial Sequence
  derived and/or modified sequence opt3 from anti-HIV_Chain
gacaucgugaugacccagagccccgauucccuggccgucucucucggcgagagaguuacaaugaacugcaagucaagucaaagccuucuguacuccacuaaucagaaaaacuauuuggcuugguaccagcagaagccugggcaaucuccaaaauuacugauuuauugggcaaauucgacggaaucaggagugccggacagguucagcgguaguggcuccgggaccgauuuuacacuaacuauaucuagcguacaggccgaggacguggcggucuacuauugucagcaguacuauuccuaccggaccuucggaggcgguacaaagcucgaaaucaaacgcaccguggcugcccccucaguuuuuauuuucccuccaagugaugagcaacuuaagagcgggacugcaucuguggucugccugcugaacaauuuuuacccccgagaagccaaggugcaguggaaaguagacaacgcuuugcaguccggaaauucacaggagagcguuacagagcaagauaguaaggacucuaccuauucccucagcucgacgcugacucugucuaaagcagauuacgaaaagcacaaaguguaugccugugaggucacccaucagggccucuccucaccugugacaaagaguuucaaccguggcgaaugc

SEQ ID NO: 27554 - RNA, 753 nt, Artificial Sequence
  derived and/or modified sequence opt3 from anti-HIV_SingleChain
augcaagugcagcuggagcagagcggcgccgaagucaagaaacccggggcuuccguuaaggugucuugccaggcaucaggauacagauucaguaacuuuaccguacacugggugaggcaggccccuggucaacgguucgaguggaugggcuggaucaauccauauaacgggaauaaagaauuuagcgcgaaguuccaggaccgcgucacauuuacugcugauacguccgccaacaccgcauacauggagcuccgaucucuucguucggccgacacagcuguguauuacugugcaagaguuggagaauggggcugggaugacucaccgcaggauaauuauuacauggacgugugggguaaagggacuaccgucauugugagcaguggaggcggcggguccggagguggcgggucuggaggcggugggagcgauauagagcugacacagucccccggaaccuugucauuaaguccuggcgagagggccacuuucagcugccggucuucccauucaauccgcagcagaaggguagcuugguaucaacacaagccaggccaggcgccccggcugguuauucauggggugaguaaccgcgccucuggaaucuccgaccgauuuagcgguucgggcucugggacagauuucacccuaacgauuacuagagucgaaccugaggacuuugcacucuacuacugucagguguauggagccuccucauacaccuucggccaggguacaaagcuggaaaggaaa

SEQ ID NO: 27555 - RNA, 1338 nt, Artificial Sequence
  derived and/or modified sequence opt3 from anti-HIV_LightChain
gaggugaagcuggaagagagcggcgggggacucguccagcccgguggcuccagaaaacuuucuugcgccgcuucaggguucaccuuuaguagcuucggaaugcacuggguuaggcaagcaccugaaaagggccuggaguggguggccuacaucuccucugguucgucaacauugcauuaugcggacacuguaaaagggcgguuuacgauuagccgcgauaacccaaagaauaccuuauuccugcagaugaaacuaccgagucucuguuacggacugcuuggcucccgaaaccugucucaccguuugcucagccagaaugacacacccauaugccugacuguguccucagcuaguaccaagggcccuagcgucuuuccacuggcccccucuuccaagucaacaagcgggggaaccgcagcccucgguuguuuagugaaagauuauuucccugaaccaguuacugugaguuggaacucuggcgcucugacauccgggguccauaccuuucccgcagugcuucagagcucgggauuguacucucuguccucaguaguuacggugccuaguagcucccuaggcacucaaaccuauaucugcaaugucaaccacaagccaucuaauacaaaaguggacaagaaaguggagcccaagagcugugauaagacucauaccugcccgccuuguccagcccccgagcuccugggugggccuucagucuuccuuuuuccacccaaaccgaaggacacacugaugauuaguagaaccccugaaguuacgugcgugguaguggaugucucccacgaggaccccgaagugaaauucaacugguacguugauggaguggagguccacaaugcuaagacuaaaccaagggaggaacaguauaacagcacauaccgggugguaucuguuuugaccgugcuccaucaggacuggcugaauggcaaggaguacaaauguaaggucucaaacaaggccuuaccugcgcccaucgagaaaacuauuaguaaggcaaaaggccagccacgcgaaccccaaguguauacacugccuccaagcagagaagagaugaccaagaaucaggucucccucacgugccuugugaaaggguuuuacccgucugauaucgccguugagugggaaucgaacggacagcccgagaauaacuauaagaccacaccuccagugcuggacagcgaugguuccuucuuuuuguacucaaagcuaacuguagacaaaaguagguggcagcaaggcaacgucuucucuuguagcgugaugcacgaagcucugcauaaucacuauacccagaagucccucucacugagccccgggaaa

SEQ ID NO: 27556 - RNA, 1380 nt, Artificial Sequence
  derived and/or modified sequence opt3 from anti-HIV_Chain
gaggugcagcuggucgaaagcggcgggggacucguuaagcccgguggcucccuuagacugaccugcguggccucuggguucacauuuucagacguaugguugaacugggugaggcaagcuccuggaaaaggcuuagagugggucggucggaucaagagucgcacugaugggggaacgaccgacuacgcagccagcgugaaaggccgauucacaauuucccgugaugacucuaagaauacucuguaucuacagaugaacucgcucaaaaccgaagauacagcgguuuacucauguaccacugacggcuuuauaaugaucagaggggugagcgaggauuauuacuauuacuauauggacgucuggggaaaggguacaaccgugacgguaaguuccgcuucuacuaagggcccaagcguuuucccgcuggcccccuccucaaaaaguaccagcgggggaacagcagcccuuggcugccuggugaaggauuacuuuccugaaccagucacugugucuuggaacuccggugcuuugaccucaggggugcacacauuccccgcaguccuccagagcaguggacuguacucucuguccagcguugugaccguaccuucgucuucccucggcacgcagacuuauauuuguaaugugaaucauaaaccaucaaacacaaaggucgacaaaaagguggagcccaagaguugcgauaaaacccacacuuguccuccaugcccggcccccgaguuacugggcgggccuagcguuuuucuuuucccacccaagccuaaagacacauugaugaucuccaggaccccagaagugacgugugucgugguagauguuucucaugaggaccccgaagugaaguuuaauugguacgucgacggaguggagguccacaacgcuaaaaccaagccgcgggaggaacaauauaauagcacauaccgcgugguuucagugcugacuguacuacaucaggauuggcucaacgguaaagaguauaagugcaaggucaguaauaaagcccugccugcgcccauugaaaagaccaucuccaaagcaaagggccagccaagagagccucagguguacacacuucccccaagcagggacgaacugacuaaaaaccaaguuucuuugaccugucucgugaagggguucuaucccucagauauagccgucgagugggagaguaauggacagccugaaaacaauuacaagacaaccccaccggugcuggacagcgauggcuccuuuuucuuauacucuaaacugacuguagacaagucgcgguggcagcaggguaacguguuuagcugcuccguuaugcacgaggcucuccacaaccauuauacgcaaaaaucacuuagucugucucccggg

SEQ ID NO: 27557 - RNA, 1413 nt, Artificial Sequence
  derived and/or modified sequence opt3 from anti-HIV_Chain
auggaguggagcggcguguucauguuucugcucuccgucaccgccgggguucacucucaggugcaacuucagcagucaggacccgaaguagugaagccuggugcuagugucaaaaugagcugcaaggcauccggcuacacauucacuucuuaugugauccauuggguuagacagaaaccagggcaaggacuggacuggauuggcuacauaaacccguauaaugaugguacggacuacgaugagaaguuuaaagggaaggccaccuugacaucggacacuucaaccagcacagcguauauggaauuaaguucccugaggucugaggauaccgcuguguacuauugugcccgggaaaaggacaacuacgcaacuggagccugguucgcuuacuggggccagggcacccuagucacagugagcuccgcaucaacgaaagggcccaguguauuuccucucgccccaagcucuaaguccacuucaggagguaccgcugcccugggcugccuuguuaaagauuauuuccccgagccugugacagucagcuggaauaguggggcgcugacuucuggagugcacaccuuuccagcaguguugcaguccagcggccucuacucgcugucuuccgucguuacagugcccucaaguagccuggguacccagacguauaucuguaacguaaaucauaagccuuccaacacuaaaguggacaagaaggucgagccaaaaucuugcgauaagacacacaccuguccgcccugcccugccccagaguucgaagggggacccagcguguuucucuucccuccaaaacccaaggacacuuuaaugauuucacgcacaccggaaguuaccuguguggucguggauguaagucaugaggacccugagguuaaauuuaauugguacguggauggcgucgaagugcacaacgcuaagacgaaaccccgagaggaacaauauaauuccaccuaccgugucgugagcguucugacagugcuucaccaggacugguugaacggcaaggaguauaagugcaaaguaucuaauaaggcccugccagcaucaaucgagaaaacuauuaguaaggcuaaagggcagccuagagaaccccaggucuacacccuaccacccagcagggacgagcucacaaagaaccaagugucccugacuugucuuguuaagggauucuacccuucugauaucgccguggaaugggagucgaauggucagccagaaaacaauuauaaaaccacaccgcccguccuggacagcgauggcuccuuuuucuuguacucaaagcucaccguggacaaaagucgguggcagcaagggaacguauucucuugcagcgugaugcaugaggcgcugcacaaccauuauacucagaaguccuuaucacugagcccuggaaaa

SEQ ID NO: 27558 - RNA, 645 nt, Artificial Sequence
  derived and/or modified sequence opt3 from anti-influenza_Fab
aucgugcugacccagagccccgccacacucuccgucucuccuggcgagcgggcuacucuuucaugcagggcaagucaaguuauuagccacaaccuggccugguaccagcagaagccagggcaggcgccgcgguuguuaauauauggagcuuccacgcgcgccucugguauccccgcacgauucucgggcucagggagcggaaccgacuacacacugacuauuaccagucuacaaccugaagauuuugccguguauuacugucagcauuauuccaauuggccaccccgucucacauucggcggugggaccaaaguagagaucaagagaacuguggcugcaccuucugucuuuauuuucccacccagcgacgaacagcugaaauccggaacagccucagugguuugccuucugaacaauuuuuacccuagggaggcuaaggugcaguggaaagucgauaacgccuugcaaaguggcaauagccaggaaucugugaccgagcaggacuccaaggauucaacguauagccucaguucuacucugacccuguccaaggcggacuacgagaaacacaagguauacgcaugugaaguuacacaucagggccucagcucgccagugacuaaaucuuucaacagaggggagugc

SEQ ID NO: 27559 - RNA, 681 nt, Artificial Sequence
  derived and/or modified sequence opt3 from anti-influenza_Fab
gugcagcuggucgagagcggcgggggaguugugcaacccgguaaguccccuagacucucuugcgccgcuucaggcccaaccuucaguagcuacgcaguacacugggugaggcaggccccggggaaaggacuugaaugggucacacugaucuccuaugacggcgcgaaccaguacuaugcugauucugugaagggucgguuuacuauuucgcgcgacaauucaaagaacacgguuuacuugcagaugaauagcuuacgacccgaggauaccgccguguauuacugugcagucccugggccaguguucggaauauuucccccuuggaguuauuucgacaacuggggccaaggcauccugguaacaguuuccucugccagcacuaaagggccauccguguuuccccuagcuccuucaaguaaaagcaccucuggagguacagcagcccucggcugccuggucaaggauuacuucccagaaccggugaccguguccuggaacucaggggcucuuacuagcggaguccauacauuucccgccguucugcagaguucuggcuuguacucccucagcucggugguaaccgugccuucuuccucacuggguacgcagacuuauauuuguaaugucaaucacaagccaaguaacaccaaaguggacaagaaaguugagcccaagagcugc

SEQ ID NO: 27560 - RNA, 1515 nt, Artificial Sequence
  derived and/or modified sequence opt3 from anti-influenza_Fab
gccggcagcaccgcuacacugugccucgggcaccaugcagugcccaacggaacuaucgucaagacgauuaccaaugaccagauagagguuacaaacgccacugaacuugugcaauccucuucaaccggugagaucugugauaguccucaccagauucuggacggcaaaaauugcacauugaucgaugcguuacugggggacccacagugugauggauuccagaacaagaaaugggaccuauuuguagaaagaagcaaggcuuacuccaauugcuauccguacgaugugcccgacuaugccucucucaggucgcuggucgcaucaagcggcacccuugaguucaacaaugaaaguuuuaacuggacuggugugacacaaaaugggaccuccucugccuguauucggcgcagcaaaaacuccuucuuuucacgacugaauugguugacgcaucucaacuucaaguacccugcucugaauguuacuaugccaaacaaugagcaguuugauaagcuguauaucuggggagugcaccaucccggcaccgacaaagaucagauauuccucuacgcacaggccaguggccguaucacagucagcacuaagagaucucaacagaccguguccccuaacauugggucaaggccacggguacgcaacauccccagcagaauuaguaucuauuggacaauaguuaaaccuggagacauuuuacugaucaauucuaccgguaaccuuauugcuccaaggggcuacuuuaagauccgguccgggaaaagcucgaucaugcgcucugaugccccgauuggaaagugcaauuccgaguguauaacgcccaacggcucaaucccuaaugacaagccauuccagaacgugaaucgaauuacuuacggugcgugccccagauaugucaaacagaacacauugaagcuggcaaccgggaugaggaaugugccugaaaaacaaacucggggaaucuuuggcgccauagcuggcuucauugagaacgggugggaaggaaugguggacgguugguacggcuuucgucaccagaauagugaggggcgcggacaggccgcagaucuaaagagcacacaagcugccaucgaccagaucaacggcaaacucaauagacugauugguaagaccaacgagaaauuccaccagaucgaaaaggaguucuccgaagucgaggggaggauucaggaucuugaaaaguauguugaggacacgaaaauagaucuguggucuuacaaugcggaguugcucguggcccuggaaaaccaacauaccaucgacuuaacagauagcgagaugaacaagcuguuugagaaaacuaagaaacagcuccgggaaaaugcagaagacaugggcaacggauguuucaagauuuaucacaagugcgauaaugcuuguaucggcucaauccgaaacgggaccuacgaccaugauguauaucgcgacgaggcccuuaauaacagauuucagauuaaaggaagugguaggcuggugccacgg

SEQ ID NO: 27561 - RNA, 657 nt, Artificial Sequence
  derived and/or modified sequence opt3 from anti-influenza_Fab
caggugcaacugguccagagcggcgggggaguugugcagcccgguagaucccucaggcuuucuugcgccgcuucagaguucaccuuucggauguacgcaacacacuggguacgccaggccccuggcaaggggcuggaauggguggcguugaucaguuaugacggaagcaacaaauacuaugcugauuccgucaagggccgauucacuauuucucgugacaauucgaugaacacgguguacuuacaaaugaauacccugagaccagaggauacagccguuuauuacugugcaagggaccuagguggguauuuuauacggggaaucauggauguguggggccagggcacucucgucaccgugucaagcgccaguacaaaagggccguccguauucccccuggcuccuucuagcggagguaccgcagcccuuggcugccugguuaaggacuacuuuccagaacccgugacugucuccuggaacucaggggcuuugacaaguggagugcauaccuucccugccgugcuccagagcucuggccuguacucccugucaagcgucguuacggugccaaguucuucccucgguacucagaccuauauuuguaauguaaaccacaaacccagcaauacaaagguggauaagcgcgucgagccuaaa

SEQ ID NO: 27562 - RNA, 642 nt, Artificial Sequence
  derived and/or modified sequence opt3 from anti-influenza_Fab
gagcugcagaugacccaaagccccuccucugugucagccagugucggcgacagaguuacaaucacuugcagggcuagccaggggauuuccucuuggcucgcaugguaccagcagaagccuggaaaagccccaaaacuucugauauaugcggcuucgucauugcaaagcggugugccgagucgguucuccggcucugggagcggaacggauuuuaccuuaacaaucuccucacugcagcccgaagacuucgccacuuacuauugucagcaggcaaacaguuuuccucuaaccuucggcggugggacaaagguagagauuaagcgcaccguggccgcuccaagcgucuuuaucuuucccccuucugaugaacaacucaaauccggaacugcaucagugguuugccugcuuaauaacuucuacccacgagaggccaaggugcaguggaaggucgacaaugcucugcagagcggcaacagucaggaaucugugacagagcaagauuccaaagacagcaccuauucguugucuuccacgcucacucugucaaaggccgauuacgagaaacacaagguauaugcgugugaaguuacccaucagggccugaguagccccgugacaaaauccuucaaucguggggagugc

SEQ ID NO: 27563 - RNA, 993 nt, Artificial Sequence
  derived and/or modified sequence opt3 from anti-influenza_Fab
gccgaccccggcgauaccaucugcauuggguaccacgcuaacaauagcacagacacuguggauacgguccuggagaagaacguuaccgugacacauuccguaaaucuccuugaagacucucacaacggaaaacuguguaaguugaaagguauagcaccuuuacagcugggcaagugcaauaucgccggguggcuacucggaaacccagagugugaucugcuucugacugcgucaaguuggagcuauauuguggaaaccuccaauucugagaacggcacaugcuacccgggugacuucaucgauuaugaagaguugagagagcaacucucgucagucagcaguuuugaaaaauucgagauuuuucccaagaccuccucuuggccuaaucaugaaacuacaaagggggugaccgcugccuguagcuacgcaggagccuccucauucuauaggaaccugcuguggcucacgaaaaagggcaguagcuacccaaaauuaucuaaguccuauguuaauaacaaaggcaaggaggugcugguccuuuggggagugcaccaucccccuacugggaccgaccagcagucauuguaccagaaugcugaugcauacguaagcguugguaguucuaaguauaaccggcgcuuuacaccagagaucgccgcucgacccaaagugcgugaccaagccggcagaaugaauuacuauuggacucugcuagaaccuggggauaccauaacauucgaggcgaccggaaaccucaucgcaccaugguacgccuuugcucugaacaggggcuccgguagcgggauuaucacgucggacgccccgguccacgauugcaauacuaagugucagacaccccacggagcaauuaacucuucccuuccuuuccagaauauccauccagugaccauaggcgaaugccccaaauaugugcggucaacuaagcugcgcauggcuacaggcuugagaaacauuccuaguauccagagcagg

SEQ ID NO: 27564 - RNA, 537 nt, Artificial Sequence
  derived and/or modified sequence opt3 from anti-influenza_Fab
ggccuguucggggccaucgcuggauuuauugaggguggcuggaccgggaugauagacggaugguacggcuaucaccaucagaacgaacaagguagcggguacgcagccgaucagaaguccacacagaaugcgaucgacggaauuacuaacaaagucaauucugugaucgagaagaugaacacgcaguucaccgcuguuggcaaagaauuuaauaaccucgagagaaggauugaaaaucuuaacaagaaaguggaugacggcuuccuggauaucuggacauauaaugccgaguuguuaguacugcuagagaacgaacggacucucgacuuucacgauucaaaugugcgcaaccuguacgagaaggucaagagucaacuuaaaaauaacgcaaaggaaauagggaauggaugcuucgaguuuuaucauaaaugugacgaugccugcauggagagcgugcgaaacgguaccuacgacuaucccaaguacuccgaagagucuaaacugaaccgugaagagaucgauggcguuucggggaga

SEQ ID NO: 27565 - RNA, 642 nt, Artificial Sequence
  derived and/or modified sequence opt3 from anti-influenza_Apo
cagagcgugcugacccaacccccuuccgucucuguugccccaggccagacagcuagaaucacuugcgggggaaacgacauugguaggaagucagugcacuggaaucagcagaaaccgggccaagcacccguacucguggucuguuacgauagugaccggccuagcgggauaccagagcgcuucuccggaucuaacucgggcaauacggccacccuuacaaucucacgaguggaagcgggugaugaggcugacuauuacugccagguuugggauagcaguuccgaccaugugauuuuugggggaggcacuaagcugaccgucuugggccagcccaaagccgcaccuucugugacauuauucccacccagcuccgaagaacugcaggccaacaaggcuacccuaguaugucucaucucagauuuuuauccuggggcaguuacuguggccuggaaagcugacaguagcccagucaaggccggaguggaaacaaccacgccgucuaagcaauccaauaacaaauacgcggcaucaagcuaucugagucuuacucccgagcaguggaagucucaccguuccuacagcugccaggugacccaugaggguucgacagucgagaaaacuguugccccuaccgaguguucu

SEQ ID NO: 27566 - RNA, 687 nt, Artificial Sequence
  derived and/or modified sequence opt3 from anti-influenza_Apo
gaggugcagcugguccaaagcggcgccgaaguuaagaaacccggggcuuccgugaagguaucuugcaaagcaucaggauacaccuucacagacuaucacaucaacugggugagacaggccccuggucagggccucgaguggaugggguggauucauccaaauaguggagauacuaacuacgcgcagaaguuucaaggcugggucacgaugaccagggacacagcuauaagcacugccuauauggaagugaauggucuuaaauccgaugacaccgcaguuuacuauugugcccgcgggggacuggagccgcggucuguggauuacuauuacuacggcauggacgucuggggccaggggacaaccgugacuguaucgucagcuagcacaaagggacccaguguuuucccuuuggcaccauccucuaagagcaccuccgguggcacggccgcuuuagggugccuggugaaagauuauuuucccgaaccugucacugugucauggaacaguggagcccuaaccagcggcgugcacacauucccagcgguccuccagucuuccggucuguacucacuuagcaguguugugacuguacccucuuccagccuggggacccagacauauaucuguaaugugaaccauaagccuucgaauaccaaagucgacaagcgaguggagccaaaaucuugc

SEQ ID NO: 27567 - RNA, 333 nt, Artificial Sequence
  derived and/or modified sequence opt3 from anti-influenza-A_kappa_LightChain_V-Region
gacaucgugaugacccagagccccgauucccuggccgucucucucggcgcuagagcaacaauuaacugcaagucaagucaaagcguuacuuucaauuacaaaaacuaucuugccugguaccagcagaagccugggcagccaccgaaagugcugauauauugggcguccgcuagggagucuggaguacccgaccgguuuucggguucaggcagcgggacggauuucaccuugacaaucaguuccuuacaagccgaagacguggcagucuacuauugucagcagcacuaccgcacuccuccaaccuuuggacagggcacaaagguggagauuaaa

SEQ ID NO: 27568 - RNA, 333 nt, Artificial Sequence
  derived and/or modified sequence opt3 from anti-influenza-A_kappa_LightChain_V-Region
gacaucgugaugacccagagccccgauucccuggccgucucucucggcgagagagcuacaauuaacugcaagucaagucaaagcguuuccucuaauaacaaaaauuaccuugcaugguaucagcagaagccugggcagccaccgaaagugcugauauacugggccucggcgagggaaucaggaguacccgaccgguucagcgguaguggcuccgggacugauuuuacguugaccaucucuagcuuacaagcugaggacguggccgucuauuacugucagcagcacuaucgcacaccuccaacuuucggacagggcaccaagguggaaauuaaa

SEQ ID NO: 27569 - RNA, 333 nt, Artificial Sequence
  derived and/or modified sequence opt3 from anti-influenza-A_kappa_LightChain_V-Region
gacaucgugaugacccagagccccgauucccuggccgucucucucggcgagagagcuacaauuaacugcaggucaagucaaagcguuuccucuaauaacaagaauuuccuugcaugguaccaggaaaaaccugggcagccaccgaaggugcugauauauugggccucggcgcgggagucaggaguacccgaccgcuuuagcgguaguggcuccgggacugauuucacguugaccaucucuggauuacaggcugaagacguggccgucuacuauugucaacagcacuaccgaacaccuccaacuuuuggccaggguaccaaaguggagauuaag

SEQ ID NO: 27570 - RNA, 333 nt, Artificial Sequence
  derived and/or modified sequence opt3 from anti-influenza-A_kappa_LightChain_V-Region
gacaucgugaugacccagagccccgauucccuggccgucucucucggcgagagagcuacaauuaacugcaagucaagucaaagcguuacuuucaauuacaaaaacuaucuugcaugguaccagcagaagccugggcagccaccgaaacuguugauauauugggccuccacgagggaaucuggagugcccgaccgguuuucggguucaggcagcgggaccgauuucacauuaacuaucaguucccugcaagcggaggacguagcuguguacuauugucagcagcacuaccgcaccccuccaacauuuggacagggcaccaaggucgaaauuaaa

SEQ ID NO: 27571 - RNA, 339 nt, Artificial Sequence
  derived and/or modified sequence opt3 from anti-influenza-A_kappa_LightChain_V-Region
gacaucgugaugacccagagccccgauucccuggccgucucucucggcgagagagcuacaauuaacugcaagucaagucaaagcguucuuuacuccucuaauaacaaaaauuaucuggcaugguaccagcagaagccugggcagccaccgaaauuguuaauauauugggccucgacuagggaaucaggagugcccgaccgguucagcgguaguggcuccgggacggauuuuacccugacaaucucuagccuacaagcggaggacguagcuguguacuauugucagcaguacuauuccacuccuccaaccuucggacagggcacaaaggucgaaauuaaa

SEQ ID NO: 27572 - RNA, 333 nt, Artificial Sequence
  derived and/or modified sequence opt3 from anti-influenza-A_kappa_LightChain_V-Region
gacauccagaugacccaaagccccgauucccuggccgugucucucggcgcuagagcaacaauuaacugcaagucaagucagagcgucacuuucaauuacaaaaacuaucuugccugguaccagcagaagccugggcaaccaccgaaaguucugauauauugggcguccgcuagggagucuggagugcccgaccgguuuucggguucaggcagcgggacggauuucaccuugacaaucaguuccuuacaggccgaagacguagcaguguacuauugucagcagcacuaccgcacuccuccaaccuuuggacaaggcacaaaggucgagauuaaa

SEQ ID NO: 27573 - RNA, 387 nt, Artificial Sequence
  derived and/or modified sequence opt3 from anti-influenza-A_HeavyChain_V-Region
caggugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguggccgucaucuccuaugacgguucuaacaaauacuaugcggauucggugaaggggcgcuucacaauuucacgagacaauagcaaaaacacuuuguacuuacagaugaauagucugcgugcugaggauacggccguuuauuacugugcaaaggacucccaacuaagaucucuccuguauuuugauuggcuuagccagggauacuucgacuacuggggccagggcacccuggugacagucuccuca

SEQ ID NO: 27574 - RNA, 387 nt, Artificial Sequence
  derived and/or modified sequence opt3 from anti-influenza-A_HeavyChain_V-Region
caggugcaacugguccagagcggcgggggaguugugcagcccgguagaucccucaggcuuucuugcguagccucaggcuucaccuuuaguacauacgcuaugcacugggugcggcaggcaccugggcgcggacuggagugggucgccgugaucagcuaugacggcaacuacaaguauuacgcggauuccguuaaaggucgauucucuauuucgcgugacaauucaaacaauacuuugcauuuagaaaugaacacgcugagaaccgaggauacagcucuauauuacugugccaaggacagccaacucaggagucugcuuuauuuugaauggcugucccagggguacuucgauccauggggacagggcacuuuggugaccgucucuagc

SEQ ID NO: 27575 - RNA, 387 nt, Artificial Sequence
  derived and/or modified sequence opt3 from anti-influenza-A_HeavyChain_V-Region
caggugcaacugguccagagcggcgggggaguugugcagcccgguagaucccucaggcuuucuugcgccgcuucaggcuucaccuuuaguacauacgggaugcacuggguacggcaggcaccuggaaagggccuggaguggguggccgucaucagcuaugacgguaauuacaaauauuacgcggauuccgugaaggggcgcuucacuauuucucgagacaauucgaaaaacacguuguauuuagaaaugaacucacugcguaccgaggauacagcucuauacuauugugccaaggacagccaacucagaagucugcuuuacuuugauuggcugucccagggauacuucgaccauuggggccagggcacuuugguuaccgugucuagc

SEQ ID NO: 27576 - RNA, 387 nt, Artificial Sequence
  derived and/or modified sequence opt3 from anti-influenza-A_HeavyChain_V-Region
caggugcaacugguccagagcggcgggggaguugugcccccugguagaucccucaggcuuucuugcgccgcuucaggcuucaccuuuaguacauacgggaugcacuggguacggcaggcaccaggaaagggccuggaguggguggccgucaucagcuaugacgguaacuacaaauauuacgcggauuccgugcgcgggcgauucacuauuucucgugacaauucgaagaacacguugaauuuagauaugaacucacugagaaccgaagacacagcucuauauuacugugccaaagauagccagcucaggagucugcuuuauuuugacuggcugucccaaggauacuucgaucauuggggccagggcacuuugguuaccgugucuagc

SEQ ID NO: 27577 - RNA, 387 nt, Artificial Sequence
  derived and/or modified sequence opt3 from anti-influenza-A_HeavyChain_V-Region
caggugcaacuggucgagagcggcgggggaguugugcagcccgguagaucccucaggcuuucuugcgccgcuucaggcuucaccuuuaguacauacgcaaugcacuggguacggcaggccccugggaagggacuggaauggguggcggucaucagcuaugacgcuaauuacaaauauuacgccgauuccgugaagggccgcuucacuauuucucgagacaauucgaaaaacacguuguauuuacagaugaacucacugcgugcagaggauaccgccguuuacuauugugcuaaggacagccaacuaagaagucuccuguacuuugaauggcuuucccaggguuacuucgauuauugggggcagggaacacuggugacugucucuagc

SEQ ID NO: 27578 - RNA, 387 nt, Artificial Sequence
  derived and/or modified sequence opt3 from anti-influenza-A_HeavyChain_V-Region
caggugcaacuggucgagagcggcgggggaguugugcagcccgguagaucccucaggcuuucuugcgccgcuucaggcuucaccuuuaguacauacgcaaugcacuggguacggcaggccccugggaagggacuggaauggguggcggucaucagcuaugacggcaauuacaaauauuacgcugauuccgugaagggucgcuucacuauuucucgagacaauucgaaaaacacguuguauuuacagaugaacucacugcgugccgaggauaccgcaguuuacuauugugccaaggacagccaacuaagaagucuccuguacuuugaauggcuuucccagggguacuucgauccauggggacagggcacacuggugacugucucuagc

SEQ ID NO: 27579 - RNA, 387 nt, Artificial Sequence
  derived and/or modified sequence opt3 from anti-influenza-A_HeavyChain_V-Region
caggugcaacugguccagagcggcgggggaguugugcagcccgguagaucccucaggcuuucuugcguagccucaggcuucaccuuuaguacauacgcuaugcacugggugcggcaggcaccugggcgcggacuggagugggucgccgugaucagcuaugacggcaacuacaaguauuacgcggauuccguuaaaggucgauucucuauuucgcgugacaauucaaacaauacuuugcauuuagaaaugaacacgcugagaaccgaggauacagcucuauauuacugugccaaggacagccaacucaggagucugcuuuauuuugaauggcugucccagggguacuucgauccauggggacagggcacuuuggugaccgucacaucu

SEQ ID NO: 27580 - RNA, 330 nt, Artificial Sequence
  derived and/or modified sequence opt3 from anti-influenza-A_LightChain_V-Region
aacuucaugcugacccagcccccuagcgccuccggcacaccagggcaaagagugacuaucucuugcucaggaaguagcuccaauauugguggcaacacgguccacugguuucagcagcucccggggaccgcucccaaacuucugauauacacaaauucuuugaggccuucgggaguuccagaccgguucucaggcagcaagagugguacuuccgcaucuuuagccaucagcgggcugcaguccgaggaugaagcggacuauuacugugcugccugggaugacucacuaaacggacaaguguuuggcggcgggaccaagcucacaguacug

SEQ ID NO: 27581 - RNA, 390 nt, Artificial Sequence
  derived and/or modified sequence opt3 from anti-influenza-A_HeavyChain_V-Region
caggugcaacugcucgagagcggcgggggagucguucagcccgguagaucccuuaggcugucuugcgccgcuucaggcuucaccuuuaguaacuacgggaugcacugggugcggcaggcaccuggaaagggcuuggaauggguagccaucauuagcuucgacgguuccaaaaaguauuacgcuaauucugugaaagggcgcucgacaauaucacgagauaacagcaagaauacuuuaagucugcagaugaacucccuaggaccagaggacacggcgcucuauuacugugccaaacugccgucucccuauuacuuugauagccguuucgucuggguggcagccuccgcuuuucauuucuggggccaaggcauccuuguuaccgugucaagu

SEQ ID NO: 27582 - RNA, 132 nt, Artificial Sequence
  derived and/or modified sequence opt3 from anti-influenza_Chain
aacgugcccgaguggagcuacaucgucgaaaaggccaauccugcuaacgaccugugcuauccaggcaauuucaacgauuacgaggaacucaaacaccuucuguccagaauuaaucauuuugagaagauacag

SEQ ID NO: 27583 - RNA, 162 nt, Artificial Sequence
  derived and/or modified sequence opt3 from anti-influenza_Chain
agcggcagacuggugcccaggggguccccuggaucugguuacaucccagaggccccgcgggacggccaggcuuauguccgcaaggauggggaauggguucuccuuucaaccuuccugggaaaacccauuccuaacccauuguuaggccuggacaguacaggu

SEQ ID NO: 27584 - RNA, 291 nt, Artificial Sequence
  derived and/or modified sequence opt3 from anti-influenza_Chain
augagccugcucaccgagguggaaacacccaucagaaacgaguggggcuguaggugcaauggguccucugacccucuugccauugcugcaaacauaaucgguauucugcacuugaucuuauggauucuggaucggcuauucuuuaagugcaucuaccgccgauucaaauauggacucaagggcgggccaucaacugaaggagucccgaaaaguaugcgugaggaauacagaaaggagcagcaaagcgccguugacgcggaugacggccauuuuguguccauagagcuggaa

SEQ ID NO: 27585 - RNA, 300 nt, Artificial Sequence
  derived and/or modified sequence opt3 from anti-influenza_Chain
augaacaaugccaccuucaacugcacaaauaucaaccccauuacucacauaagaggcagcaucauuaucacgauuugugugucccugaucgucauacucaucguuuuugggugcauugcuaagaucuucauuaauaaaaacaauuguaccaacaaugugaucaggguacauaagcggauaaaaugcccugacugugagccauuuugcaacaagcgcgaugacauuucuacaccgcgagcaggaguggauauccccucauucauucuuccuggucugaauuugagugaaggcacuccaaac

SEQ ID NO: 27586 - RNA, 300 nt, Artificial Sequence
  derived and/or modified sequence opt3 from anti-influenza_Chain
gagcugacccagagccccuccucucucucagccagugugggcgacagcgucacaaucacuugcagaacguccgaaaggauuucuaccuaccuuaacugguaucaacagaagccugggaaagcuccacggcuguugguuucgggagcaucaacauuacaggguggcgugccgagccgcuucaguggguccggaucuggcacugccuuuacccugacaauaaauagccuacagcccgaggauuucgcgaccuacuauugucaacaguccuacucaacuccucucacauuuggugggggaacc

SEQ ID NO: 27587 - RNA, 300 nt, Artificial Sequence
  derived and/or modified sequence opt3 from anti-influenza_Chain
augacccagagccccuccucuaugucagugagucugggcgacacagucagcaucacuugccacgccucccaagauauuucugggcauauaggauggcuccagcagaagccugguaaaucguucaagggccuuaucuaccacgggacgaaccuggaggacggaguuccaucaagauuuagcggcagugguuccggggcugauuucucuuugaccauuagcuccuuagaaucagaggacuuugcagauuauuacugugugcaguauguacaauucccguggacauuuggaggcggcacuaaa

SEQ ID NO: 27588 - RNA, 306 nt, Artificial Sequence
  derived and/or modified sequence opt3 from anti-influenza_Chain
gacauccaggugacccaaagccccuccucucugucagccagugucggcgauagaguuacaauuagcugcagggcucagucccucucuucguaccuucacugguaucagcagaagccugggcaaccaccgaaacuguugauauacgcagccacuacguuacagucaggagugcccagccgguucagugguuccggcucugggaccgacuuuacacugacuaucagcaccuuccaggcggaggauguagcuacauauuacugucagcaaucccgcaccuuuggacagggcacuaagguggaaauuaaa

SEQ ID NO: 27589 - RNA, 306 nt, Artificial Sequence
  derived and/or modified sequence opt3 from anti-influenza_Chain
gacauccagaugacccaaagccccuccucucugucagccagugugggcgauagagucacaauuagcugcagggcucagucccucucuucguaccuucacugguaucagcagaagccugggcaaccaccgaaacuguugauauacgcagccacuacguuacagucaggaguucccagccgguucagugguuccggcucugggaccgacuuuacacugacuaucagcaccuuccaggcggaggauguggcuacauauuacugucagcaaucccgcaccuuuggacagggcacuaagguagaaauuaaa

SEQ ID NO: 27590 - RNA, 309 nt, Artificial Sequence
  derived and/or modified sequence opt3 from anti-influenza_Chain
gacauccagauuacccaaagccccuccucucugucagccagugugggcgauagagucacaauaacuugcaggacgagccagucccucucuucguaccuucacugguaucagcagaagccugggaaagcuccaaagcuguugaucuacgcagccagcucauuacaaaguggaguuccgucccgguucucugguagcggcuccgggaccgacuuuacacugacuauuucaagucuacagcccgaggauuucgcgaccuauuacugucagcagagccgcacauuuggacaaggcaccaaaguggaaaucaag

SEQ ID NO: 27591 - RNA, 309 nt, Artificial Sequence
  derived and/or modified sequence opt3 from anti-influenza_Chain
gacauccagaugacccaaagccccuccucucugucagccagugugggcgauagagucacaauuacuugcaggacgagccagucccucucuucguaccuucacugguaucagcagaagccugggaaagcuccaaagcuguugauauacgcagccagcucauuacaaaguggaguuccgucccgguucucugguagcggcuccgggaccgacuuuacacugacuaucucaagucuacagcccgaggauuucgcgaccuauuacugucagcagagccgcacauuuggacaaggcaccaaaguggaaauuaag

SEQ ID NO: 27592 - RNA, 309 nt, Artificial Sequence
  derived and/or modified sequence opt3 from anti-influenza_Chain
gacauccaggugacccaaagccccuccucucugucagccagugucggcgauagaguuacaauuagcugcagggcuucccagcggcucaacucuuaccuucacugguaucagcagacuccugggcaagcaccaaagcuguugauauacgccacgucgaccuuacagucaggagugagcccgcgcuucagugguuccggcucugggacagacuuuacucugaccaucagcucccuacagcccgaggauguagcgacauauuacugucagcucucacgaaccuucggacauggcacuaaaguggaaauuaag

SEQ ID NO: 27593 - RNA, 309 nt, Artificial Sequence
  derived and/or modified sequence opt3 from anti-influenza_Chain
gacauccagaugacccaaagccccuccucucugucagccagugugggcgauagagucacaauuagcugcagggcuucccagcggcucaacucuuaccuucacugguaucagcagacuccugggcaagcaccaaagcuguugauauacgccacgucgaccuuacagucaggaguuagcccgcgcuucagugguuccggcucugggacagacuuuacucugaccaucagcucccuacagcccgaggauguggcgacauauuacugucagcucucacgaaccuucggacauggcacuaaaguagaaauuaag

SEQ ID NO: 27594 - RNA, 309 nt, Artificial Sequence
  derived and/or modified sequence opt3 from anti-influenza_Chain
gacauccaggugacccaaagccccuccucucugucagccagugucggcgauagaauuacaauaagcugcaggacuucccagucucuccggucguaccuucacugguaucagcagaagccugggaaagcuccaaagcuguugaucuacgcaucaagcacguuacaaaguggaguuccgucccgcuucucugguagcggcuccgggaccgacuuuacacugacuauuucaaaccuacagcccgaggauuucgccaccuauuacugucagcucagucgaacauuuggacagggcaccaaaguggaaaucaag

SEQ ID NO: 27595 - RNA, 309 nt, Artificial Sequence
  derived and/or modified sequence opt3 from anti-influenza_Chain
gacauccagaugacccaaagccccuccucucugucagccagugugggcgauagaauuacaauaagcugcaggacuucccagucucuccggucguaccuucacugguaucagcagaagccugggaaagcuccaaagcuguugaucuacgcaucaagcacguuacaaaguggagucccgucccgcuucucugguagcggcuccgggaccgacuuuacacugacuauuucaaaccuacagcccgaggauuucgccaccuauuacugucagcucagucgaacauuuggacagggcaccaaaguugaaaucaag

SEQ ID NO: 27596 - RNA, 309 nt, Artificial Sequence
  derived and/or modified sequence opt3 from anti-influenza_Chain
gacauccagaugacccaaagccccuccucucugucagccagugugggcgauagagucacaauuacuugcaggacgagccagucccucucuucguacacccacugguaucagcagaagccugggaaagcuccaaaacuucugauauacgcagccucaagccgguugaguggaguuccgucccgcuucucugguagcggcuccgggacagacuuuacuuuaaccaucucaagucugcaacccgaggauuucgcgacauauuacugucagcagagccgaaccuuuggacagggcacuaagguggaaauuaag

SEQ ID NO: 27597 - RNA, 309 nt, Artificial Sequence
  derived and/or modified sequence opt3 from anti-influenza_Chain
gacauccagaugacccaaagccccuccucucugucagccagugugggcgauagagucacaauuacuugcaggacgagccagucccucucuucguacacccacugguaucagcagaagccugggaaagcuccaaaacuucugauauacgcagccucaagccggggaagugguguuccgucccgcuucucuggcagcggguccggaacagacuuuacuuugaccaucucaaguuuacaacccgaggauuucgcgacauauuacugucagcagagccgaaccuuuggccaggguacuaagguggaaauuaag

SEQ ID NO: 27598 - RNA, 309 nt, Artificial Sequence
  derived and/or modified sequence opt3 from anti-influenza_Chain
gacauccagaugacccaaagccccuccucucugucagccagugugggcgauagagucacaauuacuugcaggacgagccagucccucucuucguacgaccacugguaucagcagaagccugggaaagcuccaaaacuucugauauacgcagccucaagccgguugaguggaguuccgucccgcuucucugguagcggcuccgggaccgauuuuacauuaacuaucucaagucugcaacccgaggacuucgcgaccuauuacugucagcagagccgaacauuuggacagggcaccaagguggaaauuaag

SEQ ID NO: 27599 - RNA, 318 nt, Artificial Sequence
  derived and/or modified sequence opt3 from anti-influenza_Chain
gagaucgugaugacccagagccccgacacacuguccgucucuccuggcgaaagagccacucucucaugcagggcuagucaaagcguuaaccggcgccuugcaugguaccagcagaagccagggcaggccccgcgacuguugauucacgaugcguccacgcgugcuaccggaauacccgccagauucucugguucgggcucagggacagaguuuacuuuaaccaucagcagucugcaauccgaagacuucgcaguguauuacugucagcaguaugauaauuggcuaucuuuuggacagggcacaaggcucgagauuaaa

SEQ ID NO: 27600 - RNA, 318 nt, Artificial Sequence
  derived and/or modified sequence opt3 from anti-influenza_Chain
gacauccagcugacccaaagccccuccucucucucagccagugugggcgauagagucacaauuacuugcagggcuagccaggggauacuuaacugucuggcaugguaccagcagaagccuggaaaaguuccaaauuuguuaauguaugccgcguccacgcugcaaucuggugugccgucgcgguucucaggcagcggguuuggaaccgacuucacacuaacuaucaguucccuccagcccgaggauguagcuaccuacuauugccagacauacggcggugugucuaccuuugggggaggcacuaaggucgaaauucgc

SEQ ID NO: 27601 - RNA, 318 nt, Artificial Sequence
  derived and/or modified sequence opt3 from anti-influenza_Chain
agcuacgugcugacccagcccccuuccgucucuguugccccaggccaaacagcuagaaucucaugcgggggaaguaacauugguggcaagagcgugcacugguaucagcagaaaccggggcaggcacccguacucguggucuacgacgauuccggaaggccuucuggcauaccagagcgguucucggguucaaauagcggggacacugccacgcuuaccaucagucgcguggaagcgggagaugaggcugacuauuuuugucaaguuugggauaacuucggcggcguguuugggacaggaacuaaggucaccgugcug

SEQ ID NO: 27602 - RNA, 318 nt, Artificial Sequence
  derived and/or modified sequence opt3 from anti-influenza_Chain
gacauccagaugacccaaagccccuccucucugucagccagugugggcgauagagucacaauuacuugcaggacgagccaguccauaucuucguaccucaacugguaucagcagaagccugggaaagcuccaaaguugcugaucuacgcagccucaagccuucaaaguggaguuccgucccgguucucugguagcggcuccgggaccgacuuuacauuaacuauuucaggacugcagcccgaggauuucgcgaccuauuacugucagcagaguuauagcaugccugcuuuuggccaagguacaaaacuagaaaucaag

SEQ ID NO: 27603 - RNA, 318 nt, Artificial Sequence
  derived and/or modified sequence opt3 from anti-influenza_Chain
gacauccagaugacccaaagcccccuguccgugucugucucaguuggcgauagagugacaauugccugcagggcuagucagagcauagacaaguuccucaacugguaccagcagaaaccugggaaggcaccaaaacuucugaucuauggagccuccaauuugcacucuggugcgccgucgcgguuuucagcuagcggcagugggacugauuucacguuaaccauuacaaacauccaaacugaggacuuugccaccuaccugugucagcaguccuucucuguacccgcauuuggaggcgguacaaagguggaaauuaaa

SEQ ID NO: 27604 - RNA, 318 nt, Artificial Sequence
  derived and/or modified sequence opt3 from anti-influenza_Chain
gacauccagaugacccaaagccccuccucucugucagccagugugggcgauagagucacaauuacuugcagggcuagccaguccauaucuacguaccucaacugguaucagaagcggccugggaaagcaccaaaacuucugguuuacggagccucgaccuugcagucaggugugccgagccgcuucaguggcuccgggucuggaacagacuuuacuuuaaccaucgcgagccugcaacccgaggauuccgcuacauauuacugucagcagaccuauucaauuccucuauucggccaggguacucgacucgaaaucaag

SEQ ID NO: 27605 - RNA, 318 nt, Artificial Sequence
  derived and/or modified sequence opt3 from anti-influenza_Chain
gacauccagaugacccaaagccccuccucucugucagccagugugggcgauagagucacaauuacuugcagggcuagccaguccauaucuacguaccucaacugguaucagaagcggccugggaaagcaccaaaacuucugguuuacggagccucgucauugcagagcggugugccgagucgcuucuccggcucugggagcggaaccgacuuuacauuaacuaucgcgucccugcaacccgaggauucagcuguauauuacugucagcagaccuauaguauuccucuauucggccaggguacacgacucgaaaucaag

SEQ ID NO: 27606 - RNA, 318 nt, Artificial Sequence
  derived and/or modified sequence opt3 from anti-influenza_Chain
gacauccagaugacccaaagccccuccucucugucagccagugugggcgauagagucacaauuacuugcagggcuagccaguccauaucucgguaccucaacugguaucagcagaagccugggaaagcaccaaaacuucugaucuacggagccucgacguugcaaaauggugcgccgucacgcuucagcggcaguggguccggaaccgacuuuacauuaacuauuucuagccugcagcccgaggauuccgcuaccuaucuaugucagcagucauacaguguuccugccuucggcggugggacaaagguggaaguaaag

SEQ ID NO: 27607 - RNA, 318 nt, Artificial Sequence
  derived and/or modified sequence opt3 from anti-influenza_Chain
ggcauccagaugacccaaagccccuccucucugucagccagugugggggacagagucacaauuacuugcagggcuagccaguccauaucucgguaccucaacugguaucuucagaagccuggaaaagcaccaaagcuguugaucucgggugccagcucauuacagaguggcguuccgucccgcuucucugggacgggaagcggcaccgaguuuacacugacuauuuccucacuacaacccgaagauuucgcgaccuacuauugucagcagacauuuaguaucccucucuucggucaggggaccaaaguggagauuaag

SEQ ID NO: 27608 - RNA, 321 nt, Artificial Sequence
  derived and/or modified sequence opt3 from anti-influenza_Chain
gacauccagaugacccaaagccccuccucucugucagccagugugggcgauagagucagcauuacaugccaggcuucccaggacauaucuagguaccucaacugguaucagcaaaagccuggggaggcaccaaaacuucugaucuacgaugccucgaauuuggaaacuggaguuccgucacgguucagcgguaguggcuccgggacggacuuuaccuucacaauuucuagcuuacagcccgaggauaucgcgacuuauuuuugucagcaguacggauaucugccucuaaccuucggcccagguacaaagguggacuccaaa

SEQ ID NO: 27609 - RNA, 321 nt, Artificial Sequence
  derived and/or modified sequence opt3 from anti-influenza_Chain
gacauccagaugacccaaagccccuccucuuucucagugagucugggcgauagagucacaauuacuugcaaggccagcgaggacauauacaacaggcucgcuugguaucagcagaaaccugggaaugcaccacggcuucugaucuccgauacgaccaacuuguggauuggaguuccgucucgcuuuucggguucaggcagcgggaaggacuacacauuaaguaucacuucccugcagucugaagauguggccaccuauuacugucaacaguauuggagcucccgaacauucggaggcgguaccaaacuagagauuaagcgu

SEQ ID NO: 27610 - RNA, 321 nt, Artificial Sequence
  derived and/or modified sequence opt3 from anti-influenza_Chain
gacauccagaugacccaaagccccuccucuuucucagugagucugggcgauagagucacaauuacuugcaaggccagcgaggacauauacaacaggguugcuugguaucagcagaaaccugggaaugcaccacggcuccuuauguccgaugccacgucucugggagcgggugugccgucgcgcuuuucaggcagcgggaguggaaaggaccacaccuuguccaucacaucuuuacagacugaagauguagcuaccuacuauugucaacaguacuggaacacacgaaccuucggcggugggacuaaacuggagauuaagcgu

SEQ ID NO: 27611 - RNA, 321 nt, Artificial Sequence
  derived and/or modified sequence opt3 from anti-influenza_Chain
gacauccagaugacccaaagccccuccucucugucagccagugugggcgauagagucacaauuacuugcagggcuagccaguccauaucuacguaccucaacugguaucagcagaagccugggaucccaccgaaacuucugauuaauguugcaucgucauugcaaagcggagugcccagucgguucuccgguucuggcagcgggaccgacuuuacauuaacuaucuccucacugcagccugaggauuucgccaguuacuauugucagcagaccuacagcucuccacccacauuuggacaaggcaccaagguagaaauuaaa

SEQ ID NO: 27612 - RNA, 321 nt, Artificial Sequence
  derived and/or modified sequence opt3 from anti-influenza_Chain
gacauccagaugacccaaagccccuccacacugucuggcucagugggggauagagucacuauuacgugcagggccagucagaacauaggaccuuggcucgcuugguaccagcaggagagcgguaaggcaccaaaacuucugaucucccgggccucuauuuuggaaucgggcguuccgucacgcuucagcgggaccggaacaggcacugaguuuaccuuaacaaucaguucccugcaacccgacgauuucgcgaccuauuacugucagcacuauaaugcuuacugggguacuuuugggcagggaacaaagguggaaauuaac

SEQ ID NO: 27613 - RNA, 321 nt, Artificial Sequence
  derived and/or modified sequence opt3 from anti-influenza_Chain
gugaucuggaugacccagagccccucccugcucucugccucaacaggcgacagagucacuauuaguugcaggaugagccaagggauauccucuuaccuugcuugguaucagcagaagccuggaaaagcaccagagcuguugauccacacggccuacaccuuaaagucggguguuccgucacgguucagcggcaguggguccggaaaagauuuuacacugacuauuucuggccuacagagcgaagacuucgcgaccuauuacugucaacaguauuacuccuuucccuauacauucggucaggggaccaagguggagaucaaa

SEQ ID NO: 27614 - RNA, 321 nt, Artificial Sequence
  derived and/or modified sequence opt3 from anti-influenza_Chain
gacauccagaugacccaaagccccuccucugugucagccagugucggcgauagaguuacaauuacuugcagggcuagccaggacguguccacguggcuggcaugguaccagcucaagccugggaaagccccaaaacuucugauauaugcggcuucuucguugcagucaggaguaccgagccgguucagugguuccggcucugggaccgauuuuacauuaacugugagcucccugcaacccgaggacuucgccaccuacuauugucagcaggcaaacucauuuccuuucacauuuggaccaggcaccaaggucgauaucaag

SEQ ID NO: 27615 - RNA, 321 nt, Artificial Sequence
  derived and/or modified sequence opt3 from anti-influenza_Chain
gacauccagcugacccaaagccccuccuuccucucugccucagugggcgauggggucacaauuacuugcagagcuagucaggacauauacaucuaucuugcaugguaccagcagaagccuggaaaagccccaaagcuguugauuuaugcggcuagcacguuacaagguggcguuccguccagguuuucugggucgggaucaggcaccgaguucacacugacuaucaacaaucuacagcccgaagauuuugccaccuacuucugucagcagcucaacgguuauccucugacauuugggggaggcaccaaaguggagauuaag

SEQ ID NO: 27616 - RNA, 321 nt, Artificial Sequence
  derived and/or modified sequence opt3 from anti-influenza_Chain
gacauccagcugacccaaagccccuccucucucucagccagugugggcgauagagucacacuuacuugccaggcuagccaggacauuaggaaguuccugaacugguaccagcaaaaaccugggaagggaccaaaauuguuaauauaugaugcauccaaucugcagcgggguguuccgucucgcuuuucgggcgggggaucaggcacggacuucacccuaaucauuagcagucuccagcccgaggauguggguacauacuauugucagcaauacgacgggcugccuuuuacuuucggaggcggcaccaaacuugaaaucaag

SEQ ID NO: 27617 - RNA, 321 nt, Artificial Sequence
  derived and/or modified sequence opt3 from anti-influenza_Chain
gacauccagcugacccaaagccccuccucucucucagccaguauuggcgauagagugacaauaacuugccaggcuagccaggacaucaggaacucccuuaauugguacgagcacaagccugggaaagcaccaaagcuguugauucaugaugccucuaacuuagaaacgggagucccgucgcgguucucagguggcgggagcggaaccgacuuuacacugacuaucaguucccuacagcccgaggauuucgcgaccuauuacugucaacaggcuaauucuuuuccucucacauucggcggugggaccaaaguugaaauuaag

SEQ ID NO: 27618 - RNA, 321 nt, Artificial Sequence
  derived and/or modified sequence opt3 from anti-influenza_Chain
gacauccagcugacccaaagccccuccucucucucagccagugugggcgauagagucacaauuacuugcagggcuagccaggggauacggaacgaccuuggaugguaccagcagaagccugguaaugcaccaaaacgccugaucuucggcgccuccucuuugcaaucggggguuccgucacgauuuagcggaaguggcuccgguacggaguucaccuuaacaauuucuagccugcagcccgaagauuuugcgacuuauuacugucuacagcacaacuccuauccuuacaccuucgggcagggaacaaagcucgagaucaaa

SEQ ID NO: 27619 - RNA, 321 nt, Artificial Sequence
  derived and/or modified sequence opt3 from anti-influenza_Chain
gacauccagcugacccaaagccccuccucucucucagccagugugggcgauagagucacaauuacuugcagggcuagccaguccauaucucgguaccuuaacugguaucagcagaagccugggaaagcaccaaagcuguuguuauucgccgcgucgacgcugcuagacggaguuccgucacgcuuuagcgguaguggcuccgggaccgauuucacacucacuaucucuagccugcaacccgaggacuuugcuaccuacuauugucagcgaaaucacuccccuucauggacauucggacagggcacccguguggaaauuaaa

SEQ ID NO: 27620 - RNA, 321 nt, Artificial Sequence
  derived and/or modified sequence opt3 from anti-influenza_Chain
gacauccagaugacccaaagccccuccucucugucagccagugugggcgauagagucacaaugacuugcagggcuagccagaacauucgguccuaccucaauugguaucagcagcgcccugggacggcaccaaaacuucugauauacgccgcgucuaccuugcacucgggaguuccgucacgauucagcgguggcgggaguggaacagacuuuacuuuaaccaucaacaaucugcaacccgaggauuucgcuuccuauuacugucagcagucuuaugacaacccucagacauuuggccaagguaccaagguggaaauuaag

SEQ ID NO: 27621 - RNA, 321 nt, Artificial Sequence
  derived and/or modified sequence opt3 from anti-influenza_Chain
gacauccagaugacccaaagccccuccucucugucagccagugugggcgauagagucacaauuacuugcagggcuaaccaggacauagggaucuaccucaauugguaucagcagaacccuggaaagguuccaaaacuucuguugcacggugcaagcuccuuacaaggcggggugccgucucgguucucggccucaggaagcggcacggauuuuacccugacaauucauagucuacagcccgaggaccucgcgacuuacuauugucagcagucccgccgacugccuuacaccuucggucaagggacacguguagaacuuaag

SEQ ID NO: 27622 - RNA, 321 nt, Artificial Sequence
  derived and/or modified sequence opt3 from anti-influenza_Chain
gacauccagaugacccaaagccccuccacacugucugccucaauuggcgauagagugacuauaacgugcagggcuagucagagcaucgcauccuggcucgccugguaccagcagaagccugggaaagcgccaaaacuucugauuuaugaggcugucaacuuggaaucuggaguuccgucgcgguucucagguagcggcagugggaccgacuuuacauuaacuaucuccucucugcaacccgaugacuucgccaccuacuuuugucagcacuauggaacaauuagccagaccuucggcggugggacuaagguggagaucaag

SEQ ID NO: 27623 - RNA, 321 nt, Artificial Sequence
  derived and/or modified sequence opt3 from anti-influenza_Chain
gacauccagaugacccaaagccccuccucucugucagccagugugggcgauagagucacaauuacuugcagggcuagccaguccauaucuucguaccucaacugguaucagcacaagccugggaaagcaccaaagguucuuauguacgccgugucaauccugcagagcggaguaccgagucgguucuccgguucuggcagcggggcggacuuuacguugaccauuuccucauuacaacccgaggauuucgcuacauauuacugucagcagaguuauagcucuccucugacuuuuggaggcgguaccaaaguggaaaucaag

SEQ ID NO: 27624 - RNA, 321 nt, Artificial Sequence
  derived and/or modified sequence opt3 from anti-influenza_Chain
gacauccagaugacccaaagccccuccucucugucagccagugugggcgauagagucacaauuacuugcagggcuagccagaacauaaagcgguacuucaauugguaucagcagaaaccugggaaggcaccaaaacuccuuaucuacgccgcguccaaccuggagaauggaguuccgucucgcuuuucggguucaggcagcgggacggacuucaccuugacaauuaguuccuuacaacccgaagauuuugcuacuuauuacugucagcagucuuucagcaaguccuggaccuuuggacagggcacaaacguggacaucaaa

SEQ ID NO: 27625 - RNA, 321 nt, Artificial Sequence
  derived and/or modified sequence opt3 from anti-influenza_Chain
gacauccagaugacccaaagccccuccucucugucagccagugugggcgauagagucacaauuacuugcagggcuagccagaacauauacaaguaucucaauugguaccagcagcggccugggaaagcaccaaagggacuuaucuccgccgcgucuggucugcaaucgggcguuccgucacgcuucagcgggaguggauccggcacggacuuuaccuugacaauuacuucuuuacagcccgaggauuucgcuaccuauuacugucagcagagcuauuccccuccacugacauuuggugggggaacccgaguggaaaucaaa

SEQ ID NO: 27626 - RNA, 321 nt, Artificial Sequence
  derived and/or modified sequence opt3 from anti-influenza_Chain
gacauccagaugacccaaagccccuccucucugucaaguagcgugggcgauagagucacaauuacuugcagggccucccagucuauaggggcuuacguuaacugguaucagcagaaggcaggaaaagccccucaagugcucaucuucggugcgucgaaucuucagucaggcguaccaagccgguuuaguggguccggaucuggcacggacuucacccugacaauuagcuccuugcagccggaggauuuugcuacuuacuucugucagcaaaccuauucaacacccaucaccuuuggucaggggacucgcuuagaaauuaag

SEQ ID NO: 27627 - RNA, 321 nt, Artificial Sequence
  derived and/or modified sequence opt3 from anti-influenza_Chain
gacauccagaugacccaaagccccuccucucugucagccagugugggcgauagagucacaauuagcugcagggcuucccagucuauaucgacuuaccucaacugguaucagcagcaaccugggaaggcaccaaaaguucuuaucuucggagccacgaaucugcagucaggugugccgagccgguuuaguggcuccgggucuggaaccgacuucacauugacuauuagcuccuuacagcccgaggauuuugcgaccuacuauugucagcaaucauacaacacaccucugaucuucggccaggguaccaagcuagaaauuaaa

SEQ ID NO: 27628 - RNA, 321 nt, Artificial Sequence
  derived and/or modified sequence opt3 from anti-influenza_Chain
gacauccagaugacccaaagccccuccucucugucagccagugugggcgauagagucacaauuagcugcagggcuucccagucuauaucgacuuaccucaacugguaucagcagcaaccugggaaggcaccaaaaguucuuaucucaggagccacgaaucugcagagcggugugccgagucgguucuccggcucugggagcggaaccgacuuuacauugacuauuuccucauuacagcccgaggauuucgcgaccuacuauugucagcaaaguuacaacacaccucugaucuuuggccaggguaccaagcuagaaauuaaa

SEQ ID NO: 27629 - RNA, 321 nt, Artificial Sequence
  derived and/or modified sequence opt3 from anti-influenza_Chain
gacauccagaugacccaaagccccuccucucugucagccagugugggcgauagacucacaauuacuugcagggcuagccaguccauaucuacguaccuucacugguaucagcagaagccugggaaagcaccaaagcuguugaucuacgccgcgucgucauuacaaagcggagucccgagucgguucuccgguucucgcagcggcaccgacuuuacacugacuauuuccucacuacagcccgaugacuucgcuaccuauuacugucagcagaguuauagcccuccacucacauuugggcccggaaccaaaguugauaugaag

SEQ ID NO: 27630 - RNA, 321 nt, Artificial Sequence
  derived and/or modified sequence opt3 from anti-influenza_Chain
gacauccagaugacccaaagccccuccucucugucagccagugugggcgauagagucacaauuacuugcagggcuagccaguccauaucuaacuaccucaauugguaucagcacaagccuggggaggcaccaaaacuucugaacuacgccgcgucgucauugcagagcggaguuccgagucgguucuccgcuucugguagcggcacggacuuuaccuuaacaaucuccucacugcaacccgaagauuucgccacuuauuacugucagcagaguuauaauaccccuauuacauuugggcagggaacccgccuagagaucaag

SEQ ID NO: 27631 - RNA, 321 nt, Artificial Sequence
  derived and/or modified sequence opt3 from anti-influenza_Chain
gacauccagaugacccaaagccccuccucucugucagccagugugggcgauagagucacaauuacuugcagggcuagccaguccauaucuaacuaccucaauugguaucagcacaagccuggggaggcaccaaaacuucugaacuacgccgcgucgucauugcagagcggaguuccgagucgguucuccgcuucugguagcggcacggacuuuaccuuauccaucucagggcugcaacccgaagauuucgccacauauuacugucagcagaguuauaauacuccuauuaccuuuggaccaggcacacgccuagagaucaag

SEQ ID NO: 27632 - RNA, 321 nt, Artificial Sequence
  derived and/or modified sequence opt3 from anti-influenza_Chain
gacauccagaugacccaaagccccuccucucugucagccagugugggcgauagagucacaauuacuugcagggcuagccaguccauaucuacguaccucaacugguaucagcagaagccugggaaagcaccaaaacuucugaucuacgccgcgucgucauugcacagcggaguuccgagucgguucuccgguucuggcagcgggaccgacuuugcuuuaacaauuuccucacugcaacccgaggauuucgccacuuauuacugucagcagaguuauagcccuccaaucaccuuuggacagggcacacgccuagaaauuaag

SEQ ID NO: 27633 - RNA, 321 nt, Artificial Sequence
  derived and/or modified sequence opt3 from anti-influenza_Chain
gacauccagaugacccaaagccccuccucucugucagccagugugggcgauagagucacaauuacuugcagggcuagccagacgauauccaccuaccucaacugguaucagcagaagucugggaaagcaccuaaacuucugaucuacgccgcgucgggauugcaaucagguguuccaagccgguucaguggcuccgggucuggaacagacuuuacuuuaaccauuagcucccugcagccggaggauuucgcuacauauuuuugucagcagucauacaauacuccccuaaccuucggccaagguacaaagguggaaaucaag

SEQ ID NO: 27634 - RNA, 321 nt, Artificial Sequence
  derived and/or modified sequence opt3 from anti-influenza_Chain
gacauccagaugacccaaagccccuccucucugucagccagugugggcgauagagucacaauuagcugcagggcuucccagucuauaucgacuuaccucaacugguaucagcagcaaccugggaaggcaccaaaaguucuuaucucaggagccacggaccugcagagcggugugccgagucgguucuccggcucugggagcggaaccgauuuuacauugacuauuuccucauuacagcccgaggacuucgcgaccuacuauugucagcaaaguuacaauacaccucugaucuuuggccaggguaccaagcuagaaauuaaa

SEQ ID NO: 27635 - RNA, 321 nt, Artificial Sequence
  derived and/or modified sequence opt3 from anti-influenza_Chain
gacauccaggugacccaaagccccuccucucugucagccagugucggcgauagaguuacaauuacuugcagggcuagccagaacauauacaaguaucucaauugguaccagcagcggccugggaaagcaccaaagggacuuaucuccgccgcgucuggucugcaaucgggcgugccgucacgcuucagcgggaguggauccggcacggacuuuaccuugacaauuacuucuuuacagcccgaggauuucgcuaccuauuacugucagcagagcuauuccccuccacugacauuuggugggggaacccgaguagacaucaaa

SEQ ID NO: 27636 - RNA, 321 nt, Artificial Sequence
  derived and/or modified sequence opt3 from anti-influenza_Chain
cagagcgugcugacccaacccccuuccgagucugucucaccaggccagacagccaguguuacuugcagcgggcacaagcucggagacaaauacguguccugguaucagcagaagccgggucaaucucccguacuucugaucuaccaggauaacagaaggccuucgggcauuccagaacgguucauagggucaaauagcggaaacacggcuaccuugacaaucaguggcacucaggcauuagacgaggccgauuauuacugucaggcgugggacuccucuaccgcuguguuuggugggggaacaaaacugaccguccuaggc

SEQ ID NO: 27637 - RNA, 321 nt, Artificial Sequence
  derived and/or modified sequence opt3 from anti-influenza_Chain
gacauccagcugacccaaagccccuccucucucucagccagugugggcgauagagucacaauuacuugcagggcuagccaggggauauccacguaccuugcaugguaucagcagaagccuggaaaaguuccaaagcuguugaucuacgccgcgucuaccuuacaaucgggugugccgucacgguucagcggcaguggguccggaacagacuuuacucugaccauuucuagccuacagcccgaggauguagcuacauauuacugucagaaauauaacuccgccccuucauucggcccagguaccaagguggacaucaaacgc

SEQ ID NO: 27638 - RNA, 321 nt, Artificial Sequence
  derived and/or modified sequence opt3 from anti-influenza_Chain
agcgugcugacccagcccccuuccgccucuggcucaagagggcaaaguaucacaauuagcugcacuggauccacgucugacauagguucguacaacuaugucucaugguaccagcagcacccaggcaccgcuccgaagguuauccucuaugaggugagccagaggcccagugggguaccugaucgguucuccggaucuaaaagcggcaauacagcauuucuuacuguguccggucugcaagccgaagacgaggcggauuacuauugugcuucauacgccgggaacaauauuuaugucuucggaaguggcaccaaggugaca

SEQ ID NO: 27639 - RNA, 321 nt, Artificial Sequence
  derived and/or modified sequence opt3 from anti-influenza_Chain
agcgcccugacccagcccccuuccgcuucuggcucaagagggcaaaguaucacaauuagcugcacuggauccacgucugacauagguucguacaacuaugugucaugguaccagcagcacccaggcaccgcaccgaaggucauccucuaugagguuagccagaggcccaguggggugccugaucgguucuccggaucuaaaagcggcaauacagccuuucuuacuguauccggucugcaagcggaagacgaggcugauuacuauugugccucauacgcagggaacaauauuuauguguucggaaguggcaccaaggucaca

SEQ ID NO: 27640 - RNA, 321 nt, Artificial Sequence
  derived and/or modified sequence opt3 from anti-influenza_Chain
gagaucgugcugacccagagccccgccacacucucccuuucuccuggcgaaagagcuacucugucaugcagggcaagucaaagcgucuccacguucuuggccugguaccagcagaagccagggcaggcgccgcgguuacugauguaugacgcuucuaaccgcgccaccgguauucccgcacgauuuucgggaucaggcagcgggacagauuucacucuaaccauaaguucccucgagccugaagacuuugccaucuacuauugucaacagcguucucacuggccacccauuuucggacagggcacaagacuggagaucaaa

SEQ ID NO: 27641 - RNA, 321 nt, Artificial Sequence
  derived and/or modified sequence opt3 from anti-influenza_Chain
gacauccagaugacccaaagccccgccucccugucugugucagucggcgagacaguuacuauuacgugcagagcuagugaaaagauauacagcaaccucgcaugguaucagcagaaagaggggaaguccccucagcuucugguguacgccgcgaucagguuggcugauggaguaccaucucgguucucggguucaggcagcgggacccaauuuaguuuaaaaauuaauucccugcagucugaagacuucggaacauauuacugucagcacuuuuggggcacuccgcuaaccuucggugccgggacaaagcucgagcugaaa

SEQ ID NO: 27642 - RNA, 321 nt, Artificial Sequence
  derived and/or modified sequence opt3 from anti-influenza_Chain
gacauccagaugacccaaagccccuccucugugucagccagugucggcgauagaguuacaauuacuugcagggcuagccaggacauauccacguggcuggcaugguaccagcagaagccugggaaagccccaaagcuccuuaucuaugcggcuucuucgcugcaaucaggagugccgagccgguucagugguuccggcucugggaccgauuuuacauugacuauuagcuccuuacagcccgaggacuucgccaccuacuuuugucagcaggcaaacucauucccuccaacauuuggacaaggcaccaaacuggaaaucaag

SEQ ID NO: 27643 - RNA, 321 nt, Artificial Sequence
  derived and/or modified sequence opt3 from anti-influenza_Chain
gacauccagaugacccaaagccccuccucugugucagccagugucggcgauagaguuacaauuacuugcagggcuagccaggacauauccacguggcuggcaugguaccagcagaagccugggaaagccccaaagcuccuuaucuaugcggcuucuucgcugcaaucaggagugccgagccgguucagugguuccggcucugggaccgauuuuacauugacuauuagcuccuuacagcccgaggacuucgccaccuacuuuugucagcaggcaaacucauucccuccaacauuuggaugcggcaccaaacuggaaaucaag

SEQ ID NO: 27644 - RNA, 321 nt, Artificial Sequence
  derived and/or modified sequence opt3 from anti-influenza_Chain
gacauccagaugacccaaagccccuccucugugucagccagugucggcgauagaguuacaauuacuugcagggcuagccaggacauauccacguggcuggcaugguaccagcagaagccugggaaauguccaaagcuccuuaucuaugccgcgucuucgcugcaaucaggagugccgagccgguucagugguuccggcucugggaccgauuuuacauugacuauuagcuccuuacagcccgaggacuucgcuaccuacuuuugccagcaggccaacucauucccuccaacauuuggacaaggcaccaaacuggaaaucaag

SEQ ID NO: 27645 - RNA, 321 nt, Artificial Sequence
  derived and/or modified sequence opt3 from anti-influenza_Chain
gacauccagaugacccaaagccccuccucugugucagccagugucggcgauagaguuacaauuacuugcagggcuagccaggacauauccacguggcuggcaugguaccagcagaagccugggaaagccccaaagcuccuuaucuaugcggcuucuucgcugcaaucaggagugccgagccgguucagugguuccggcucugggaccgauuuuacauugacuauuagcuccuuacagcccgaggacuucgccaccuacuauugucagcaggcaaacucauuuccuccaacauucggacaaggcaccaaacuggaaaucaag

SEQ ID NO: 27646 - RNA, 321 nt, Artificial Sequence
  derived and/or modified sequence opt3 from anti-influenza_Chain
gacauccagaugacccaaagccccuccucugugucagccagugucggcgauagaguuacaauuacuugcagggcuagccaggacauauccacguggcuggcaugguaccagcagaagccugggaaagccccaaagcuccuuaucuaugcggcuucuucgcugcaaucaggagugccgagccgguucagugguuccggcucugggaccgauuuuacauugacuauuagcuccuuacagcccgaggacuucgccaccuacuauugucagcaggcaaacucauuuccuccaacauucggaugcggcaccaaacuggaaaucaag

SEQ ID NO: 27647 - RNA, 321 nt, Artificial Sequence
  derived and/or modified sequence opt3 from anti-influenza_Chain
gacauccagaugacccaaagccccuccucugugucagccagugucggcgauagaguuacaauuacuugcagggcuagccaggacauauccacguggcuggcaugguaccagcagaagccugggaaauguccaaagcuccuuaucuaugccgcgucuucgcugcaaucaggagugccgagccgguucagugguuccggcucugggaccgauuuuacauugacuauuagcuccuuacagcccgaggacuucgcuaccuacuauugccagcaggccaacucauuuccuccaacauucggacaaggcaccaaacuggaaaucaag

SEQ ID NO: 27648 - RNA, 321 nt, Artificial Sequence
  derived and/or modified sequence opt3 from anti-influenza_Chain
gagaucgugcugacccagagccccgccacacucucccuuucuccuggcgaaagagcuacucugucaugcagggcaagucggagcauuacgaccuucuuggccugguaccaacagaagccagggcaggcgccgcgcuuacugauauaugacgcuuccaaccgagccacaggaguccccgcacguuuuucugguucgggcucagggacugauuucacccuaacaaucaauagccucgagccugacgauuuugccauuuacuauugucagcaaagagaccacuggccacccaucuucggacagggcaccaggcuggaaauuaaa

SEQ ID NO: 27649 - RNA, 321 nt, Artificial Sequence
  derived and/or modified sequence opt3 from anti-influenza_Chain
gagaucgugcugacccagagccccgccacacucucccuuucuccuggcgaaagagcuacucugucaugcagggcaagucggagcauuacgaccuucuuggccugguaccaacagaagccagggcaggcgccgcgcuuacugauauaugacgcuuccaaccgagccacaggaguccccgcacguuuuucugguucgggcucagggacugauuucacccuaacaaucaauagccucgagccugacgauuuugccauuuacuauugucagcaaagagaccacuggccacccaucuucggaugcggcaccaggcuggaaauuaaa

SEQ ID NO: 27650 - RNA, 324 nt, Artificial Sequence
  derived and/or modified sequence opt3 from anti-influenza_Chain
gagaucgugcugacccagagccccggcacacucucccuuucuccuggggaaagagccacucugucaugcagggcuagucaaacggucagcuccucuuacuuggcaugguaucagcagaagccaggacaggccccgcgguuacugauuuacggugcgucgucacgcgcuaccggcauacccgaccgauucagcgggaguggauccggcacagauuuuacucuaaccaucucucgucucgagccugaagacuucgccguuuauuacugucaacaguaugguaacagcccauacacauuugggcagggaaccaaacuggagauuaag

SEQ ID NO: 27651 - RNA, 324 nt, Artificial Sequence
  derived and/or modified sequence opt3 from anti-influenza_Chain
gagaucgugcugacccagagccccggcacacucuccgucucuccuggggaaagagccacucuuucaugcagggcuagucaaagcauuuccucuggauaccuggcaugguaucagcagaagccaggucaggccccgcgguuguuaauauacggcgcgucgucacgcgcuacggggauccccgaccgauucagcggaaguggcuccgguaccgauuuuacacugacuauuucucgucuagagccugaagacuucgccguuuauuacugucaacaguaugggaccagcccacagacauuuggacagggcaccaaaguggagaucaag

SEQ ID NO: 27652 - RNA, 324 nt, Artificial Sequence
  derived and/or modified sequence opt3 from anti-influenza_Chain
gaggugguccugacccagagccccggcacacucucccuuucuccugggcaaagagccacucugucaugcagggcuagucagagcguuuccucuucguacuuggcaugguaucagcagaagccaggacaagccccgcgguuacugaucuacgacgcgucaaaccgcgcuacggguauucccgaucgauucagcggcaguggguccggaaccgacuuuacacuaacuauaucucgucucgaaccugaggauuucgccguguauuacugucagcaguauggcagcuccccauacaccuuuggucaggggacaaaacuggaaaucaag

SEQ ID NO: 27653 - RNA, 324 nt, Artificial Sequence
  derived and/or modified sequence opt3 from anti-influenza_Chain
gacauccagcugacccaaagccccuccucucucucagccagugugggcgauagagucacaauuacuugcagggcuagccaggggauaaucacguaccuuaacugguaucagcagaagccuggaaaagcaccaaagcuguugauuuacgccaccuauuccuuacaaaaugguguuccgucucgguucucgggcucagggagcggaacagacuuuacucugaccaucaguucccuacagcccgaggauuucgcgacauacuauugucagcagucuuacagcucccucauguuuaccuucggccaagguacuaaacuggacauuaag

SEQ ID NO: 27654 - RNA, 324 nt, Artificial Sequence
  derived and/or modified sequence opt3 from anti-influenza_Chain
gagaccgugcugacacagagccccggcacucucucccuuacgccuggggaaagagccacccugucuugcagggucggacaaucaguuagugguagccacuuggcuugguaccagcagaagccaggccaggcaccgcgguuacugaucuauggggccuccucucgcgcgacaggcauucccgaccgauucggagguucggugucagggacugauuuuacccuaacaauaagccgucucgagccugaagacagugcuguauacuauugucaacaguacggagauuccagauauaccuucggccagggcacuaaacuggagaucaag

SEQ ID NO: 27655 - RNA, 324 nt, Artificial Sequence
  derived and/or modified sequence opt3 from anti-influenza_Chain
gagaucgugcugacccagagccccggcacacucucccuuucuccuggggaaagagccacucugucaugcagggcuagucaaagcgucuccucuucgcaguuggcaugguaccagcagaagccaggacaagccccgcgguuaauuauauauggugcgucaacgcgcgcuaccggcauccccgaccgauucagcgggaguggauccggcacagauuuuacucugaccauuggucgucuagagccugaagacuucgccguguuuuucugucagcaguacucuacaagcccacccaccuuugggcagggaacuaaaguugauuucaag

SEQ ID NO: 27656 - RNA, 324 nt, Artificial Sequence
  derived and/or modified sequence opt3 from anti-influenza_Chain
gacaucgugcugacccagagccccggcacacucucccuuucuccuggggagagagccacucugucaugcagggcuagucaaagcgucuccucuucguacuuggcaugguaucagcagaagccaggacaggccccgcgguuaguuauguacggugcggcuacgcgcgccaccggcauucccgaucgauucucagggagcggaaguggcccugacuuuacacugacuauaucccgucuagaaccagaggauuucgcaauguauuacugucaacaguaugguaacucucccaucaccuuugggcagggaacaagacucgaaauuaaa

SEQ ID NO: 27657 - RNA, 324 nt, Artificial Sequence
  derived and/or modified sequence opt3 from anti-influenza_Chain
gagaucgugcugacccagagccccgccacacucucccuuucuccuggcgaaagagcuacucugucaugcagggcaagucaaagcgucuccucuuacuuggccugguaucagcagaagccagggcaggcgccgcgguuacugauuuacgacgcuucgaaccgcgccacgggaauacccgcacgauucucagguagcggcagugggaccgauuuuacacuaacuaucuccucucucgagccugaagacuucgccguuuauuacugucaacagcguagccacuggccacccauuaccuuuggacagggcacaagacuggagaucaaa

SEQ ID NO: 27658 - RNA, 324 nt, Artificial Sequence
  derived and/or modified sequence opt3 from anti-influenza_Chain
agcuacgagcugacccagcccccuuccgugucugucucaccaggccaaacagccagaaucacuugcaguggggacgcucucccgaagcagaacgcauauugguaccagcagaaacccggacaagccccuguucuucugauuuauaaggauagcgaaaggccauccgguauacccgagcgguucucuggcucgucaagcgggacgaccgugacauugacuaucaguggaguacaggcggaagacgaggcugauuacuauugucaguccgccgacucuagcggcaccuccuggguguuuggugggggaacaaaauuaaccguccug

SEQ ID NO: 27659 - RNA, 324 nt, Artificial Sequence
  derived and/or modified sequence opt3 from anti-influenza_Chain
agcuacgugcugacccaggcccccuccgucucuguugcuccuggccaaacagcaagaaucacuugcgggggaaacgccauugguucaaagaaagugcacugguaucagcauaaggcgggccaggcuccaguacucguggucuacgacgauacggacaggccgagugggauacccgagcgguucagcggauccaauucuuggucgaccgccacacuuacuaucaaccgcguggaagcaggcgaugaggccgacuauuacugucagguuugggauuuuaccauugaccacguggucuucggugggggaacaaaacugaccguguug

SEQ ID NO: 27660 - RNA, 324 nt, Artificial Sequence
  derived and/or modified sequence opt3 from anti-influenza_Chain
gagaucgugcugacccagagccccggcacacucucccuuucuccuggggaaagagccacucugucaugcagggcuagucaaagcgucuccucuucguacuuggcaugguaucagaagaaaccaggacaggccccgcgguuacugauuuacggugcgucaacgcgcgcuaccggcauacccgaccgauucacagggagcggaaguggcacugauuuuacccuauccaucucucgucucgagccugaagacuucgccguuuauuacugucagcacuuugguacaagcguguucaccuuugggggaggcacuaagguagagauuaaa

SEQ ID NO: 27661 - RNA, 324 nt, Artificial Sequence
  derived and/or modified sequence opt3 from anti-influenza_Chain
gagaucgugaugacccagagccccgccacacuguccgucucuccuggcgaaagagcuacucucucaugcagggcaagucaaagcguugggaacucccuugccugguaccagcagcggccaggacaggcgccgcgccuguugauuuauggugcuucuacgcgagccaccggcauacccccucguuucucggggucaggaagcggcacagaguuuacuuuaaccaucaguucccugcaaacagaagacuucgcaguguacuauugucagcaguacauuaauuggagaccacuaucuuuuggugggggaaccaagguagagaucaaa

SEQ ID NO: 27662 - RNA, 324 nt, Artificial Sequence
  derived and/or modified sequence opt3 from anti-influenza_Chain
caggagagcggcgccgaacuggugagacccggggcuuccgucaagcucucuugcaaagacucaggauacaccuucacaacuuauuggaugaacuggguuaagcaaaggccugagcagggucuugaauggaucggccggauugauccauacgacagugagacgcacuauaaucagaaauuuaaggauaaagcaauacugaccguggacaagagcuccaacacagccuacaugcaguugucuucguuaacuucagaagauagcgcgguauauuacugugugcgcgggggaaguaccgucgcuuauuucggcguguggggucaaggg

SEQ ID NO: 27663 - RNA, 324 nt, Artificial Sequence
  derived and/or modified sequence opt3 from anti-influenza_Chain
gagaucgugcugacccagagccccggcacacucucccuuucuccuggggaaagagccacucugucaugcagggcuagucaacgggucagcuccuacuuggcaugguaucagcagaagccaggacaggccccgcgcuuacugauuuacggugcgucuacgcgagcugccggcauacccgaccguuucucggggucaggaagcggcaccgauuuuacacuaacuaucaguagacucgagccugaagacuccgcaguuuauuacugucaacaguaugguaggaccccacugacauucgggggaggcaccaaaguggagauuaagcgg

SEQ ID NO: 27664 - RNA, 324 nt, Artificial Sequence
  derived and/or modified sequence opt3 from anti-influenza_Chain
gagaucgugaugacccagagccccggcacacugucccucucuccuggggaaagagccacucuuucaugcagggcuagucaaagcgucuccucuucguaccuggcaugguaucagcagaagccaggacaggccccgcgguuguuaauuuucggugcgucaagccgcgcuacgggcauacccgaccgauuuaguggguccggaucuggcaccgauuucacacugacuaucagccgucuagagccugaagacuuugccguuuacuauugucaacaguacgguuccucacucaccuucgggggaggcacaaaacuggagauuaagaga

SEQ ID NO: 27665 - RNA, 324 nt, Artificial Sequence
  derived and/or modified sequence opt3 from anti-influenza_Chain
gagaucgugcuguaccagagccccggcacccucucccuuucuccuggggaaagagccacacugucaugcagggcuagucaacgggucagcuccuauuuggcaugguaccagcagaagccaggacaggccccgcgcuuacugauuuauggugcgucuacucgagcugccggcauacccgaccguuucucggggucaggaagcggcacggauuuuacccuaacaaucaguagacucgagccugaagacuccgcaguuuacuauugucaacaguacgguaggacuccacugaccuucgggggaggcacaaaaguggagauuaagcgg

SEQ ID NO: 27666 - RNA, 324 nt, Artificial Sequence
  derived and/or modified sequence opt3 from anti-influenza_Chain
gacaucgugcugacccaggcccccagcgucuccguuucuccuggccaaacagcuucaauuacuugcaguggggauagacucggagagaaguucgcaagcugguaccagcagaaaccaggucaguccccggugcuuguaauauaugaagacucuaagaggcccucgggcaucccugaucgguuuucagggagcaacaguggaaauacggccacccugacaauuuccggcacucaaaucauggacgagggugauuucuuuugucaggcgugggacucuagcaccguggucuucgggggaggcacaaaauugaccguguuaggccag

SEQ ID NO: 27667 - RNA, 324 nt, Artificial Sequence
  derived and/or modified sequence opt3 from anti-influenza_Chain
gacaucgagcugacccagagccccuccgugucugucucaccuggccaaacagccaguauuacuugcagcggggauaagcucggagacaaauucguuuguugguaccagcagaaggcuggucaguccccaauagugguaaucuaucaagaugacaaaagaccgucuggcauucccgaaagguuuucggggucaaacagcggaaauacggcaacccuuacaaucaguggcacucaggccauggaugaggcggacuacuucugccaggcuugggauuccaccacaguggucuuuggugggggaaccaagcugacuguguugggccag

SEQ ID NO: 27668 - RNA, 324 nt, Artificial Sequence
  derived and/or modified sequence opt3 from anti-influenza_Chain
cagagcgugcugacccaacccccuuccgccucuggcucaagagggcagaguaucacaauuagcugcacuggauccacgucugacauagguucguacaacuaugucucaugguaccagcagcacccaggcaccgcuccgaagguuauccucuaugaggugagccaaaggcccagugggguaccugaucgguucuccggaucuaaaagcggcaauacagcauuucuuacuguguccggucugcagaccgacgaugaagccgacuacuauugugcgucauacgcugggaacaauauuuaugucuucggaaguggcacaaaggugacc

SEQ ID NO: 27669 - RNA, 327 nt, Artificial Sequence
  derived and/or modified sequence opt3 from anti-influenza_Chain
aacuucaugcugacccagccccacagcguguccgagucuccuggcaagacagucacuaucucaugcacggggaguggagguaauauugccagaaacuacguucaaugguaucagcagaggccaggcagcgcuccggugaccguaauacucgaagacgauaaacggcccuccgggaucccugaccgcuuuucuggaucgauugaucgaucaagcaauagugcaucccuuacaaucucuggccugcguacugaggacgaagccuuguacuauugucagagcuacgaugacuccgauuuaguggucuucggugggggaaccaagcugaca

SEQ ID NO: 27670 - RNA, 327 nt, Artificial Sequence
  derived and/or modified sequence opt3 from anti-influenza_Chain
augcuggagccccuccagauccuuagcauuugcuccuucauacugucugccuugcacuuuauggcuuggaccaucggccauuuaaaccaaauuaagagaggggugaaucugaaaauccagauuaggaacccuaauaaggaagcaaucaaccgggaggucucaauacuacgccacaauuaccagaaagaaauccaggccaaggagacaaugaaaaagauucucagugacaacauggaaguucugggagaucauaucgugguagagggucuuagcacugacgagauuaucaagaugggcgaaacggugcuggaggucgaagaguugcaa

SEQ ID NO: 27671 - RNA, 327 nt, Artificial Sequence
  derived and/or modified sequence opt3 from anti-influenza_Chain
gacaucagacugacccagagccccgccacacucuccgugucuccuggcgagagggcuacucuuucaugccgggcaagucacagcgucucccgcaaccuggccugguaccaacagaagccagggcgagcgccgcguuuguuaguuuaugauacgucuucgagagcuaccgguauucccgccagguucucaggaagcggcagugggacagaauuuacucugaccauauccucucuacagagcgaggacuucgcaguguacuauugucagcaauacaauaacuggccucggacauuuggacagggcaccaaaguagauaucaagcgcacu

SEQ ID NO: 27672 - RNA, 327 nt, Artificial Sequence
  derived and/or modified sequence opt3 from anti-influenza_Chain
gagaucgugaugacccagagccccggcacacugucccucucuccuggggaaagagccacucuuucaugcagggcuagucaaagcgucuccucuucguaccuggcaugguaucagcagaagccaggacaggccccgcgguuguuaauuuacggugcgucaacgcgcgcuaccggcguucccgaccgauuccacgggggaggcagcgguacagauuuuacucugaccauaagucgucuagagccugaagacuucgccguguauuacugucaacaguaugauacauccucugggcucaccuuuggaggcggcacuaaaguagagaucaag

SEQ ID NO: 27673 - RNA, 327 nt, Artificial Sequence
  derived and/or modified sequence opt3 from anti-influenza_Chain
gagaucgugaugacccaguuccccgccacacugagcgucuccccuggcgaaagaguuacucucucuugcagggcuucacaaagugugagcaacaaucuugcaugguaccagcagaagccagggcagccgccccggcuguugauuuaugacgccuccacgcgcgcgaccggaguaccugcuaaauuuucugguacaggcucggggacugaguucaccuuaucaauaagcagucugcaauccgaagauuuugccguguacuauugucagcaguaccacaacuggccacccucuuauagcuucggacuaggcacaaagcucgagaucaaa

SEQ ID NO: 27674 - RNA, 327 nt, Artificial Sequence
  derived and/or modified sequence opt3 from anti-influenza_Chain
gagaucauucuggcccagagccccggcacccucucccuuucuccuggggaaagagcuacacugucaugcagggcaagucaauucgugagcacucgguccuuggccugguaccagcagcgcccaggacaggcgccgcgauuacugauauauggugcuucuucgcgugccacgggcauccccgacagauuuucagggagcggaaguggcaccgauuucacacuaacuauuuccaggcucgagccugaagacuuugcagucuacuauugucaacacuacgguuauucuccacgguacgccuucgggcagggaagcaagguugagaucaaa

SEQ ID NO: 27675 - RNA, 327 nt, Artificial Sequence
  derived and/or modified sequence opt3 from anti-influenza_Chain
gagaucgugcugacccagagccccggcacacucucccuuucuccuggggaaagagccacucugucaugcagggcuagucacuucgucaacuaccggagcuuggcaugguaucaacagacgccaggacagguuccgcgcuuacugauuuacggugccuccacccgagcgacaggcauacccgaccguuuuucugggucgggaucaggcacugauuucacccuaacaaucagcagacucgagccugaagacuuugcuguguauuucugucagcaauacggugggaguccaagguauaccuuuggacagggcacucggcuggagauuaag

SEQ ID NO: 27676 - RNA, 327 nt, Artificial Sequence
  derived and/or modified sequence opt3 from anti-influenza_Chain
gagaucgugcugacccagagccccggcacacucucccuuucuccuggggaaagagccacucugucaugcagggcuagucacuucgucauuggacgggcaguugccugguaccaacagaagccaggucaggcgccgcgcuuguuaauauauggcgcuagcucccgagccacggggauccccgaccguuuuucuggaucgggcucagguaccgauuucacacugacuauuagcagacuagagaccgaagacuuugcaguguucuacugucagcauuaugggaguuccccuagguacgccuuuggacaaggcacaaaacucgagaucaag

SEQ ID NO: 27677 - RNA, 327 nt, Artificial Sequence
  derived and/or modified sequence opt3 from anti-influenza_Chain
gagaucgugcugacccagagccccgccacacucucccuuucuccuggcgaaagagcuacucugucaugcagggcaagucaaagcgucgggaacuacuuggccugguaucagcagaagccaggacaggcgccgcgguuacugauuuacgacuccucuaaucgcgcucccgguauaccugcccgauucucgggcucagggagcggaacggauuuuacccuaacaaucaguucccucgcaccagaggacuucgccguuuauuacugucaacagcguucuaaauggcccccuauguauagcuuuggccacgguacuaagcuggaaauuaaa

SEQ ID NO: 27678 - RNA, 327 nt, Artificial Sequence
  derived and/or modified sequence opt3 from anti-influenza_Chain
caggccguggucacccaagagcccagccugacaguuuccccuggcgggacugugacgcucacuugcggaucuucaacagguccaguaaccaguggccacuacccguauugguuccagcagaagcccgggcaggcuccuagaacccuuaucagcgcaacauccaacacccauucuuggacuccagccagguuuucgggaucacuguugggcggucgggcggcuuuaacacugagcggggcccaacccgaagacgaggcagauuacuauuguuuccuaaguuacuccggagccuggguguuuggcggcgggaccacgcucacuguccug

SEQ ID NO: 27679 - RNA, 327 nt, Artificial Sequence
  derived and/or modified sequence opt3 from anti-influenza_Chain
gccauccagaugacccaaagccccuccucucugucagcuagugugggcgacagagucacaauuacuugcagggcaagccagaacauacgguccuaccucaauugguaucagcagaagccugggaaagccccaaaccuucugaucuacggaacgaccucuuuggagucggguguuccgucacgcuucagcggcaguggguccggaacagauuuuacuuuaaccauuucuagccugcaacccgaagacuucgcgacauauuacugucagcaguccuaucacaccccucagacuuuuggccaagguacaaagguggagaucaaacgaacc

SEQ ID NO: 27680 - RNA, 327 nt, Artificial Sequence
  derived and/or modified sequence opt3 from anti-influenza_Chain
gacauccagaugacccaaagccccuccucucugucagccagugugggcgauagaauuacaauaacuugcagggcuagccaggggaucgacaacuaccucgcaugguuccagcagaagccuggaaaagucccagagcuucugauuuaugccgcguccacguugcaaucugguguuccgucgcgguuuucaggcagcgggaguggaaccggcuucacauuaacuaucuccucucugcagcccgaagauguggcuaccuacuauugucagaaguacgacagcgccccucuaacauuuggugggggaaccaaaguagauauuaagcgcacu

SEQ ID NO: 27681 - RNA, 327 nt, Artificial Sequence
  derived and/or modified sequence opt3 from anti-influenza_Chain
gacauccagcugacccaaagccccuccucucucucagccagugugggcgauagagucacaauuacuugcagggcuagccaggggauaacggacuaccuugcaugguaucagcagaagccuggaaccaucccaaaacuguugauuuacgccgcguccacauuacaaucugguguuccgucgcgguucucaggcgggggauauggcacugauuuuacccugacaaucagcagucuacagcccgaggacguggcuaccuacuauugucagaaguacaacuccgccccucucacuuucggugggggaacaaaaguagaaauuaagcgcacc

SEQ ID NO: 27682 - RNA, 327 nt, Artificial Sequence
  derived and/or modified sequence opt3 from anti-influenza_Chain
gacaucgugaugacccagagccccuucucccugucucucucaccuggcgagagagccacacuuaguugcagggcuagccaauccauuucuaacuaccuggcaugguaucagcagaagccagggcaggccccgcgguuguuaauauacgauucgucaaaucgcgcgacuggaguccccgcucgauuuagcgguaguggcuccgggacggacuucacccugacaaucucuagccuagaaccugaggauuuugccguuuauuacugucaacagcguuccaacuggauguauacuuucggacagggcaccaaaguggaaauuaagagaaca

SEQ ID NO: 27683 - RNA, 327 nt, Artificial Sequence
  derived and/or modified sequence opt3 from anti-influenza_Chain
gacauccagaugacccaaagccccuccucucugucagccagugugggcgauagagucacaauuacuugcagggcuagccaggggauauccucuuaccucgcaugguaucagcagaagccuggaaaaguuccaacgcuucugaucuacgacgccucgaccuugcggucaggugugccgagccgcuucaguggcuccgggucugcgacagauuuuacuuuaaccauuagcucccugcaacccgaggacguagcuacauauuacugucagcgauauaacucagccccuccaaucaccuucggacagggcacucgucuagaaauuaagaga

SEQ ID NO: 27684 - RNA, 327 nt, Artificial Sequence
  derived and/or modified sequence opt3 from anti-influenza_Chain
gagaucgugaugacccagagccccggcacacugucccucucuccuggggaaagagccacucuuucaugcagggcuagucaaagcgucuccucuucguaccuggcaugguaucagcagaagccaggacaggccccgcgguuguuaauuuacgacgcgucaagccgcgcuacggauauacccgaccgauucagugguuccggcucugggaccgauuuuacacugacuaucagccgucuagagccugaagacuucgccguuuauuacugucaacaguauggauccucacucuggaccuuuggccaggguacaaaaguggagauuaagaga

SEQ ID NO: 27685 - RNA, 327 nt, Artificial Sequence
  derived and/or modified sequence opt3 from anti-influenza_Chain
agcuacgugcugacccagcccccuuccgucucuguugccccaggccaaacagcuagaaucacuugcgggggaaacaauauugguucaaagagugugcacugguaucagcagaaaccgggccaggcacccguacucguggucuacgacgauagcgacaggccuuccgggauaccagagcgguucucuggaucgaacucaggcaauacggccacccuuacaaucagccgcguggaagcgggugaugaggcugacuauuacugucaaguuugggauaguuccucugaccaugccguguuugggggaggcacucagcugaccgucuugggc

SEQ ID NO: 27686 - RNA, 327 nt, Artificial Sequence
  derived and/or modified sequence opt3 from anti-influenza_Chain
gagaucgugcugacccagagccccggcacacucucccuuucuccuggggaaagagccacucugucaugcagggcuagucaaagcgucuccucuucguacuuggcaugguaucagcagaagccaggacaggccccgcgguuacugauuuacggugcgucaagccgcgcuacgggcauacccgaccgauucaguggguccggaucuggcaccgauuuuacacuaacuaucagccgucucgagccugaagacuucgccguuuauuacugucaacaguaugguuccucaccaagaaccuuugggggaggcacaaaaguggagauuaagagg

SEQ ID NO: 27687 - RNA, 327 nt, Artificial Sequence
  derived and/or modified sequence opt3 from anti-influenza_Chain
agcuacgugcugacccagcccccuuccgucucuguugccccaggccaaacagcuagaaucacuugcgggggaaacaauauugguucaaagggcgugcacugguaucagcagaaaccggggcaggcacccguacucguggucuacgacgauagugacaggccuagcggaauaccagagcgguucuccggcucuaacucggguaauacggccacccuuacaaucucacgcguggaagcgggggaugaggcugacuauuacugucaaguuugggauagcaguuccgaccauguggucuuuggaggcggcacuaagcugaccguguugggg

SEQ ID NO: 27688 - RNA, 327 nt, Artificial Sequence
  derived and/or modified sequence opt3 from anti-influenza_Chain
gagaucgugcugacccagagccccggcacacucucccuuucuccuggggaaagagccacucugucaugcagggcuagucaaagcgucuccucuaacuacuugggauggacgcagcagaagccaggucaggcaccgcgguuacugauuuauggcgccucgucacgcgcgagcgggauacccgaccgauucaguggaggcgguuccgggaccgauuuuacacuaacuaucucucgucucgagccugaagacuucgcuguuuacuauugucaacaguacggaagcuccccacugaccuuuggcggcgggacaaaaguggagauuaagaga

SEQ ID NO: 27689 - RNA, 327 nt, Artificial Sequence
  derived and/or modified sequence opt3 from anti-influenza_Chain
cagagcguggucacccaacccccuuccguuucuguggccccaggccagacagcuagaaucacuugcgggggaaacaauauugguucaaagaguguacacugguaccagcagaaaccgggccaagcacccgugcuggucguguaugacgauagcgacaggccuuccgggauaccagagcgguucucuggaucgaacucaggcaauacggccacccucacaaucagccgcguugaagcgggugaugaggcugacuacuauugucaggugugggauaguuccucugaccauuacgucuuugggacuggaaccaaggugacaguacuuggc

SEQ ID NO: 27690 - RNA, 327 nt, Artificial Sequence
  derived and/or modified sequence opt3 from anti-influenza_Chain
agcuacgugcugacccagcccccuuccgagucugucgccccaggccaaacagcuagaaucacuugcgggggaaacaauauugguaggaacucaguucacugguaucagcagaagccgggccaggcacccgugcucguaguguacgacgauagugaccggccuagcgggauaccagaacgcuucuccggaucuaaaucgggcaauacggccacccuuaucauuucacgagucgaggugggugaugaagcggacuauuacugucaaguuuggcauagcaguuccgaucacuauguguuugggacaggaacuaaggucaccgugcugggc

SEQ ID NO: 27691 - RNA, 327 nt, Artificial Sequence
  derived and/or modified sequence opt3 from anti-influenza_Chain
gagaucgugaugacccagagccccggcacacugucccucucuccugggcaaagagccacucuuucaugcagggcuagucagagcgucuccucuucguaccuggcaugguaucagcagaagccaggacaagccccgcgguuguuaauguacggugcgucaagccgcgcuacgggcauucccgaccgauucaguggguccggaucuggcaccgauuuuacacugacuauaagccgucuagaaccugaggacuucgccguuuauuacugucagcaguaugguuccucaagucucaccuuugggggaggcacaaaacuggaaaucaagaga

SEQ ID NO: 27692 - RNA, 327 nt, Artificial Sequence
  derived and/or modified sequence opt3 from anti-influenza_Chain
caggccggccugacccaacccccuagcguguccgucgcuccagggcagacagcaagaaucacuugcggagguaacaauauuggcucuaagucaguucacugguaccagcagaaaccggggcaagcccccgugcucguaguguaugacgauagugacaggccuagcggaauaccagagcgguucuccggcucuaacucggguaauacggcgacccuuacaaucucacgcgucgaagcuggggaugaggccgacuacuauugucaggugugggauagcaguuccgaccauguuguguuuggaggcggcacuaagcugaccgucuugggg

SEQ ID NO: 27693 - RNA, 327 nt, Artificial Sequence
  derived and/or modified sequence opt3 from anti-influenza_Chain
cagagcguggucacccaacccccuuccgagucuguugccccaggccagacagcuagaaucacuugcgggggacacaacauugguucaaauagugugcauugguaccagcagaagccgggccaagcacccguacugguggucuaugacaacagcgauaggccuuccgggauaccagaacgguucucuggaucaaauucgggcaacacggccacccucacaaucagccgcguggaggcgggugacgaagcugauuacuauugucagguuugggggaguuccucugaccacuacguguuuggaacuggcaccaaagucacagugcuuggc

SEQ ID NO: 27694 - RNA, 327 nt, Artificial Sequence
  derived and/or modified sequence opt3 from anti-influenza_Chain
gagaucgugcugacccagagccccggcacacucucccuuucuccuggggaaagagccacucugucaugcagggcuagucaaagcgucuccucuaacuacuugggaugguaucagcagaagccaggucaggcaccgcgguuacugauuuacggcgccucgucacgcgcgagcgggauacccgaccgauucaguggaggcgguuccgggacggauuuuacccuaacaaucucucgucucgagccugaagacuucgcuguuuauuacugucaacaguauggaagcuccccacugacuuuuggcggcgggaccaaaguggagauuaagaga

SEQ ID NO: 27695 - RNA, 327 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguugacuccaaccuggccugguaccagcagaagccagggcaggcgccgcgguuguuaguguauucugcuucgacgcgcgccaccgguauucccgcacgauucucaggaagcggcagugggacagaguuuacucuggccauauccucucuacaaagcgaagauuucgcuguauacuauugucagcacuacaccaauuggccuccacgucucacauuuggaggcgguuccaaaguggagaucaag

SEQ ID NO: 27696 - RNA, 327 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguuucccacaaccuggccugguaccagcagaagccagggcaggcgccgcgguuguuaguguauucugcuucgacgcgcgccaccgguauucccgcacgauucucaggaagcggcagugggacagaguuuacucuggccauauccucucuacaaagcgaagacuucgcuguauacuauugucagcauuacaccaauuauccuccacgucucacauuuggaggcgguuccaaaguggagaucaag

SEQ ID NO: 27697 - RNA, 327 nt, Artificial Sequence
  derived and/or modified sequence opt3 from anti-influenza_Chain
gagaucgugaugacccagagccccgccacacuguccgucucuccuggcgaaagagcuacucucucaugcagggcaagucaaagcguugacuccaaccuugccugguaccagcagaagccagggcaggcgccgcggcuguugguguauucugcuucgacgcgcgccaccgguauucccgcacgauucucaggaagcggcagugggacagaguuuacuuuagccauauccucucugcaaagcgaagauuucgcuguauacuauugucagcacuacaccaauuggccuccacgucuaacauuuggaggcgguuccaaaguggagaucaag

SEQ ID NO: 27698 - RNA, 327 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguuuccucuaaccuggccugguaccagcagaagccagggcaggcgccgcgguuguuaguguauucggcuucaacgcgcgccaccgguauucccgcacgauucagcggaaguggcuccgggacagaguuuacucuggccauaucuagccuacaauccgaagacuucgcuguauacuauugucagcacuacaccaauuggccuccacgucucacauuuggaggcgguucaaaaguggagaucaag

SEQ ID NO: 27699 - RNA, 327 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguugaccacaaccuggccugguaccagcagaagccagggcaggcgccgcgguuguuaguguauuccgcuucuacgcgcgccaccgguauucccgcacgauucucgggaucaggcagcgggacagaguuuacucuggccauaaguucccuacaaucugaagauuucgcuguauacuauugucagcauuacaccaauuggccuccacgucucacauuuggaggcgguagcaaaguggagaucaag

SEQ ID NO: 27700 - RNA, 327 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguuucccacaaccuggccugguaccagcagaagccagggcaggcgccgcgguuguuaguguauucugcuucgacgcgcgccaccgguauucccgcacgauucucaggaagcggcagugggacagaguuuacucuggccauauccucucuacaaagcgaagacuucgcuguauacuauugucagcauuacaccaauuggccuccacgucucacauuuggaggcgguuccaaaguggagaucaag

SEQ ID NO: 27701 - RNA, 327 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguuucccacaaccuggccugguaccagcagaagccagggcaggcgccgcgguuguuaguguauucugcuucgacgcgcgccaccgguauucccgcacgauucucaggaagcggcagugggacagaguuuacucuggccauauccucucuacaaagcgaagacuucgcuguauacuauugucagcauuacaccaauuuuccuccacgucucacauucggaggcgguuccaaaguggagaucaag

SEQ ID NO: 27702 - RNA, 327 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguugacuccaaccuggccugguaccagcagaagccagggcaggcgccgcgguuguuaguguauucugcuucgacgcgcgccaccgguauucccgcacgauucucaggaagcggcagugggacagaguuuacucuggccauauccucucuacaaagcgaagauuucgcuguauacuauugucagcacuacaccaauuuuccuccacgucucacauucggaggcgguuccaaaguggagaucaag

SEQ ID NO: 27703 - RNA, 327 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguugacuccaaccuggccugguaccagcagaagccagggcaggcgccgcgguuguuaguguauucugcuucgacgcgcgccaccgguauucccgcacgauucucaggaagcggcagugggacagaguuuacucuggccauauccucucuacaaagcgaagauuucgcuguauacuauugucagcacuacaccaauuauccuccacgucucacauuuggaggcgguuccaaaguggagaucaag

SEQ ID NO: 27704 - RNA, 327 nt, Artificial Sequence
  derived and/or modified sequence opt3 from anti-influenza_Chain
gagaccacacugacucagagccccgccacgcucuccgugucuccuggcgaaagagcuacccuuucaugcagggcaagucaagucaucagccacaaccuggccugguaccagcagaagccagggcaggcgccgcgguuguuaauuuauggagcuuccacacgcgccucugguauacccgcacgauucucgggcucagggagcggaacugacuacacccugacaaucaccagucuacaauccgaggauuuugccguuuauuacugucagcauuauucuaauuggccuccacgucucacuuucggcggugggacaaaaguggaaauuaag

SEQ ID NO: 27705 - RNA, 327 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaguuauuagccacaaccuggccugguaccagcagaagccagggcaggcgccgcgguuguuaauauauggagcuuccacgcgcgccucugguauccccgcacgauucucgggcucagggagcggaaccgacuacacacugacuauuaccagucuacaauccgaggauuuugccguguauuacugucagcauuauucuaauuggccuccacgucucacauucggcggugggaccaaaguagaaaucaag

SEQ ID NO: 27706 - RNA, 327 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaguuauuagccacaaccuggccugguaccagcagaagccagggcaggcgccgcgguuguuaauauauggagcuuccacgcgcgccucugguauccccgcacgauucucgggcucagggagcggaaccgacuacacacugacuauuaccagucuacaaccugaggauuuugccguguauuacugucagcauuauuccaauuggccaccccgucucacauucggcggugggaccaaaguagaaaucaag

SEQ ID NO: 27707 - RNA, 327 nt, Artificial Sequence
  derived and/or modified sequence opt3 from anti-influenza_Chain
gagaucgugaugacccagagccccgccacacuguccgucucuccuggcgaaagagcuacucucucaugcagggcaagucaaguuauuagccacaaccuugccugguaccagcagaagccagggcaggcgccgcggcuguugauauauggagcuuccacgcgcgccucugguauccccgcacgauucucgggcucagggagcggaaccgacuacacauuaacuauuaccagucugcaauccgaggauuuugccguguauuacugucagcauuauucuaauuggccuccacgucuaacauucggcggugggaccaaaguagaaaucaag

SEQ ID NO: 27708 - RNA, 327 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaguuauuagccacaaccuggccugguaccagcagaagccagggcaggcgccgcgguuguuaauauauggagcuuccacgcgcgccucugguauccccgcacgauucucgggcucagggagcggaaccgacuacacacugacuauuaccagucuacaauccgaggauuuugccguguauuacugucagcauuauucuaauuucccuccacgucucacauuuggcggugggaccaaaguagaaaucaag

SEQ ID NO: 27709 - RNA, 327 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaguuauuagccacaaccuggccugguaccagcagaagccagggcaggcgccgcgguuguuaauauauggagcuuccacgcgcgccucugguauccccgcacgauucucgggcucagggagcggaaccgacuacacacugacuauuaccagucuacaauccgaggauuuugccguguauuacugucagcauuauucuaauuacccuccacgucucacauucggcggugggaccaaaguagaaaucaag

SEQ ID NO: 27710 - RNA, 327 nt, Artificial Sequence
  derived and/or modified sequence opt3 from anti-influenza_Chain
gagaucgugcugacccagagccccgccacacucuccgucucuccuggcgaaagaguuacucuuucaugcagggcuagucaaagcguggcaaacaaucuggccugguaccagcagaagccagggcaguccccgcgguuguuaauuuauggagcgucuacgcgcgacaccgguauacccgcucgauucucgggcucagggagcggaacagaguuuacucugaccaucaguucccuacaaucugaagauuucgccguauacuauugucagcaguacaacaauuggccuccaauguauacauuuggccaggguaccaaacucgagauuaag

SEQ ID NO: 27711 - RNA, 327 nt, Artificial Sequence
  derived and/or modified sequence opt3 from anti-influenza_Chain
gacaucgugaugacccagagccccuccacacugucugccucagucggcgauagaguuacuauuacgugcagggcuagucaaagcauagggaacuggcucgcaugguaccagcagaagccuggaaaagccccaaaacuucugaucuauaagguguccaccuuggagucugguguaccgucgcgguucucaggcagcgggaguggaacagaauuuacuuuaaccauuaauucccugcagcccgacgauuucgcgacauacuauugucaacgcuacaccucuaacagccagggcuuuacuuucggucaggggacaaagcuagagaucaaa

SEQ ID NO: 27712 - RNA, 327 nt, Artificial Sequence
  derived and/or modified sequence opt3 from anti-influenza_Chain
gacaucgugaugacccagagccccgccacacuguccgucucuccuggcgagagagcuacucucucaugcagggcaagucaaguuguggggacgaaccuugccugguaccagcagaagccaggacaggcgccgcggcuguugauuuaugcugccagcacccgcgcaacagguauacccgcccgauucuccggcucuggguuuggaacugauuucaccuuaacaaucucgucacugcaaagcgaagacuuugcuguauacuauugucagcaguacaauaacuggccucuaaguuucggcggugggaccaaaguggagauucguagaacu

SEQ ID NO: 27713 - RNA, 327 nt, Artificial Sequence
  derived and/or modified sequence opt3 from anti-influenza_Chain
gacauccagaugacccaaagccccuccucucugucagccagugugggcgauagagucacaauuguuugcagggcuagccaggggauaaacacucaccuccauugguaccagcagaagccuggaaaagcaccaaaacuucugaucuauuccgccucuacguugcacaccggugugccgucgcgguuaucaggcagcgggaguggaacagacuucacucuguccauuucuagccuacaacccgaggauuuugcgaccuacuauugucagcaguccuacaauuauccucgcacauucggccaggguaccaacguagacaucaagcgaacu

SEQ ID NO: 27714 - RNA, 327 nt, Artificial Sequence
  derived and/or modified sequence opt3 from anti-influenza_Chain
gacauccugaugacccagagccccuccucucucucagccagugugggcgauagagucacaauuacuugcagggcuagccaagacauacggaaccgccuugcaugguaccagcagaagccugggaaagccccaaagcgacugaucuaugcggcuuccucuuugcagucgggaguuccgucacguuucagcgguaguggcuccgggacggaguuuaccuuaacaauuaauucucugcaacccgaagauuucgccacuuacuauugucuacagcacaacagcuacccuuggaccuuuggaccaggcacaaaaguggagaucaagagaacc

SEQ ID NO: 27715 - RNA, 327 nt, Artificial Sequence
  derived and/or modified sequence opt3 from anti-influenza_Chain
gacaucgugaugacccagagccccgccacacuguccgucucuccuggcgagggggcuacucucucaugcagagcaagucaaggaauugguagcaaccuugccugguaccagcacaagccaggccaggcgccgaggcuguugauauaugcugccuccacgcgggcaaccgggguucccgcccgcuucucuggaucgggcucagguacagaauuuacuuuaaccaucagcagucugcaguccgaggaucuagcuguguacuucugucaacaguauaauacauggccucucaccuuugggggaggcacuaaaguagaaauuauccgaaca

SEQ ID NO: 27716 - RNA, 327 nt, Artificial Sequence
  derived and/or modified sequence opt3 from anti-influenza_Chain
gacaucgugaugacccagagccccuccacacugucugccucagucggcgauagaguuacuauuacgugcagggcuagucaaaccauauaccgguggcucgcaugguaucagcagaagccugggaaagccccaaaggugcuuaucuacaaagcgagcacacuggaguccggaguaccgucucgcuucucggguucaggcagcgggacugaauuuaccuuggcuauuaguuccuuacagcccgacgauuucgccacauauuacugucaacaguauaacucuuuuccuuaccgauucggacagggcaccaagguggagaucaaacguacu

SEQ ID NO: 27717 - RNA, 327 nt, Artificial Sequence
  derived and/or modified sequence opt3 from anti-influenza_Chain
gacaucgugaugacccagagccccuccucucugucagccagugucggcgauagaguuagcauuacaugcagggcuucccaaacuauaacgcgguuccucaacugguaccagcagaagccugggaagggaccaaaacuucugaucuaugcagccucuaccgugcaccgcgguguaccgucgcgauuuucaggcagcgggaguggaacagacuucacuuugaccauuuccucuuuacagcccgaggauuuugcgacauacuauugucaacagagcuacuccgcuccuuucaccuuuggcccagguacuacaguggacauccguagaacc

SEQ ID NO: 27718 - RNA, 327 nt, Artificial Sequence
  derived and/or modified sequence opt3 from anti-influenza_Chain
gacaucgugaugacccagcccccugccacacugagcgucuccccaggcgagagagcuacucucucuugcggggcaucacaaggacuugguaguaaccuggccugguaccagcagaagccgggccaggcgcccagguuguuaauuuaugcugccagcacgcgggcaaccgggauaacagcccgcuucuccggaucuggcucggguacugaauuuacccugacaaucaauucacuacaaagcgaggauuucgcucucuacuauugucagcaguacaccuauuggccucugacuuuugggggaggcacaaaaguugaaauuaagcgaacc

SEQ ID NO: 27719 - RNA, 327 nt, Artificial Sequence
  derived and/or modified sequence opt3 from anti-influenza_Chain
gacaucgugcugacccagagccccgccacacucuccgucucuccuggcgagagagcuacucuuucaugcagggcaagucaaagcguuaaccggaaucuggccugguuccagcagauuccagggcaggcgccgcgcuuguuaauauuugaugcuuccacgcgagccgcagacauccccgcccguuucucuggagguggcucgggggcugaauuuacccugacagugucaagccuacaaccugaggauuucgcaguauacuauugucagcaguacgacaaguggccacccggauuuggccaggguacuaaaguggaaauuaagagaacc

SEQ ID NO: 27720 - RNA, 330 nt, Artificial Sequence
  derived and/or modified sequence opt3 from anti-influenza_Chain
cagagcgugcugacccagcccccuuccgccucuggcgcuccagggcagagagucacacucucaugcaguggaagcgguuccaacaucggcucuaauacuguuucgugguaccagcagcuuccggggacggcacccaagcuguugguguucaccaacaaucaaaggccuucaggaguaccagaccgguuuagcggcaguaaauccgguacaucugccagcuuagcgauuuccgggcugcagucagaggaugaagcugacuauuacugugccgcaugggaugacagucuaaacggacaacucuucggcggcgggacuaagcugaccgugcuu

SEQ ID NO: 27721 - RNA, 330 nt, Artificial Sequence
  derived and/or modified sequence opt3 from anti-influenza_Chain
cagagcgugcugacccaacccccuuccgucucugccgcuccaggccagagaguuacaaucucaugcagugggacuagcuccaacauuggaaagaauuacgugucuugguaucagcagcucccgggugcagcccccaaacuucugauauacgacaacgauaagaggccuucgggcaucccagaccgguucucagggagcaaaaguggaacguccgcgaccuugggcauuacagguuuacaaacuggggaugaggcugacuauuacuguggaaccugggauucuagccuguccguaggcauguuuggcgggggaacacgccuaaccgugcuc

SEQ ID NO: 27722 - RNA, 330 nt, Artificial Sequence
  derived and/or modified sequence opt3 from anti-influenza_Chain
gagaccacacugacucagagccccgccacgcucuccgugucuccuggcgaaagagcuacccuuucaugcagggcaagucaaagcgucucccggaaccuggccugguaccagcagaagccagggcaggcgccgcgcuuguuaaucuauggagcuucuucgcgagccacagguauucccgaccguuucucaggcagcgggaguggaacugauuuuacccugacaauauccagacuagagccugaagacuucgcaguuuacuauugucaacaguacggcucuagcuccaucaccuuuggucaggggacuaggcucgagauuaaacggacagug

SEQ ID NO: 27723 - RNA, 330 nt, Artificial Sequence
  derived and/or modified sequence opt3 from anti-influenza_Chain
cagagcgugcugacccaacccccuuccgccucuggcacaccagggcagagagucacuaucucaugcaguggaagcuccucuaacauugguucgaauacgguuaacugguacaagcagcucccgggcaccgcucccaggcuucugauauauucaaaugaccagcggccuagcggggugccagaucgcuucaguggauccaaaucuggcacaagcgcauccuuggccaucucagguuuacaaagugaggacgaagcgaacuacuauugugcugccugggaugacagccugucuggguggguauuuggaggcggcacuaagcuaaccgugcuc

SEQ ID NO: 27724 - RNA, 330 nt, Artificial Sequence
  derived and/or modified sequence opt3 from anti-influenza_Chain
cagagcgcccugacccaacccagauccgugucuggcucaccugggcagagugucacaaucagcugcacuggauccucuucggacguuggugcuucaaacagcgugaguugguaccagcagcacccaggcaaggcaccgaaacucguaauuuaugaugugacggagaggcccuccggggucccucaucgguucucuggaagcaaguccggcaauaccgccucacuuacagugaguggucugcaaccagaagacgaggcggauuacuuuuguugcgcuuaugggggaaaauacuugguuguguucggcggcgggacuaaggucaccguguua

SEQ ID NO: 27725 - RNA, 330 nt, Artificial Sequence
  derived and/or modified sequence opt3 from anti-influenza_Chain
cagagcgcccugacccaacccgcuuccgugucuggcucaccugggcagaguaucacaauuagcugcacuggaacguccucugacgucgguggcuacaacuauguuucgugguaccagcagcacccagggaaggcaccgaaacuccuuauauaugaggugaccaauuggcccucaggaguaagcaacagauucaguggcuccaagucugguaauacagccagccugacuaucuccggguugcaagcggaagaugaggcugacuacuauuguucaaguuacgccggaagcucuaccuggguguuuggcggcgggacaagggucaccguguua

SEQ ID NO: 27726 - RNA, 330 nt, Artificial Sequence
  derived and/or modified sequence opt3 from anti-influenza_Chain
cagaccguggucacacaagagcccagccugacuguuuccccuggcgggacggugacccucacaugcgccucuucaacuggagcuguaaccaguagcuacuucccaaacugguuucagcagaagccgggucaggcacccagaccucuuaucuauuccacaaccauuaggcacucuuggacuccagcccgguucucgggcucacuguuagggggaaaagcggcuuugacacugagcggcgugcaacccgaagacgaggccgauuacuauugucuacucuacagugguggggacccugucgcauuuggaggcggcaccaagcugacggugcuu

SEQ ID NO: 27727 - RNA, 330 nt, Artificial Sequence
  derived and/or modified sequence opt3 from anti-influenza_Chain
cagagcgugcugacccaaucccccucugucucagccgcuccuggccagaagguuacaaucaguugcagcggguccgacucuaacauuggagauuacuucguguguugguaucagcaccucccagguaaaccgccccagcuucugauauacgagaauaacaagagaccuucgggcaucccagacagguuuucagggagcaaaaguggaacuuccgcaacguugggcauuaccgguauccaaacaggggaugaagccgacuauuacugcgcgacuugggauggaucuuuaagcgcuuggguauucggcggcgggaccaagcugacagugcua

SEQ ID NO: 27728 - RNA, 330 nt, Artificial Sequence
  derived and/or modified sequence opt3 from anti-influenza_Chain
cagagcgcccugacccaacccagauccgugucuggcucaccugggcagaguaucacaauuagcugcacuggagguuccucugacauaggcgcuucgaacucagucagcugguaccagcagcacccagggaaggcaccgaaacucguuaucuucgaugugacggagaggcccaguggaguaccucaucgguuuuccggcucuaagagcgguaauaccgccucccuuacagugucagggcugcaaccagacgaugaagcggacuauuucuguugcgcuuacggaggcaaauauuuggucguguuuggcgggggaacuaagguuaccguguua

SEQ ID NO: 27729 - RNA, 330 nt, Artificial Sequence
  derived and/or modified sequence opt3 from anti-influenza_Chain
caggccguggucacccaagagcccagccuggcuguuuccccuggcgggacagugacucucacgugcggaucuucaaccggugcaguaacaagaggccacuacccauauugguuccagcagaagccggggcaggcccccagggcgcuuaucuacgacagugcuggaaaccggcauagcuggacuccugcccgcuuuuccggcucucuguugggugggaaagcagccuuaacccugucgggagcucaaccagaagaugaggcagaauauuacugucuacucucauauagcggcgugugggucuucggcgggggaacaaagcugaccgugcuu

SEQ ID NO: 27730 - RNA, 330 nt, Artificial Sequence
  derived and/or modified sequence opt3 from anti-influenza_Chain
gagaucgugaugacccagagccccgccacacuguccgucucuccuggcgaaagaguuacucucucaugcagggcuagucaaagcauuacggacgggcuugcaugguaccagcagaaguccggacaggccccacggcuguugauauauggugcgucuacccgcgcuacaggcaucccggcccgauucucggggucaggaagcggcacugaguuuaccuuaacaauuaguucccugcaaucugaagauuucgcaguguacuauugucagcaguacaacaauuggcccccuguaaccuuuggucaggggacuaaaguggagaucaagcguaca

SEQ ID NO: 27731 - RNA, 330 nt, Artificial Sequence
  derived and/or modified sequence opt3 from anti-influenza_Chain
agcuccgagcugacccagcccccuucugccucaggcacaccagggcaaagagugacuaucaguugcagcggauccacgucuaacauugguuacaauccggucucgugguaucagcagguucccggcaccgcuccuaagcuccuuauauacucaaacacagaaaggccaagcggggugcccgaccgguucaguggauccaaaucuggcacuagcgcaucccuggccaucucagguuugcagagugaggaugaagcggacuauuacugugcugccugggaugacaccuuaaaugggccuguauuuggaggcggcacaaaggugaccguccug

SEQ ID NO: 27732 - RNA, 330 nt, Artificial Sequence
  derived and/or modified sequence opt3 from anti-influenza_Chain
cagagcgcccugacccaacccgcuuccgugucuggcucaccugggcagaguaucacaauuagcugcacuggaacguccucugacgucgguggcuacaacuauguuucgugguaccagcagcacccaggggaggcaccgaagcucaugauaucagaugugagcaauagacccaguggaguauccaacagguucucuggcagcaaauccgguaauaccgccucacuuacaaucagugggcugcaagcggaagacgaggcugauuauuacuguacuagcuauaccucuuccaacacauugguguuuggaggcggcaccaaguuaacuguccug

SEQ ID NO: 27733 - RNA, 330 nt, Artificial Sequence
  derived and/or modified sequence opt3 from anti-influenza_Chain
cagagcgugcugacccaacccccuuccgucucugccgcuccaggccagaagguuacaaucucaugcagugggagcuccucuaacauuggacacaauuucgugucgugguaccagcagcucccggcaacugcccccaaacuucugauauaugacacggauaagagaccuucagguaucccagacagguuuagcggcaguaaauccgggaccucugcgacauugggaauuacuggcuuacaaaccggugaugaggcugacuacuauugugggacaugggauagcucccugucaaguguaaucuucggaggcggcaccaagcuaacugugcuc

SEQ ID NO: 27734 - RNA, 330 nt, Artificial Sequence
  derived and/or modified sequence opt3 from anti-influenza_Chain
gacauccagaugacccaaagccccuccacacugucugccucagugggcgauagagucacuauuacgugcagggcuagucagaccauaaacaauuaccucgcaugguaucagcagaagccugggaaagccccaaaacuucugaucuacaaggcgagcuccuuggagucuggaguuccgucgcgguucucagguagcggcagugggacagaauuuacuuuaaccauuuccucucugcaacccgacgauuucgcuacauauuacugucaggaguauaacaaugacagcccucuaaccuuuggaggcgguacuaagguggaaaucaaacgcaca

SEQ ID NO: 27735 - RNA, 330 nt, Artificial Sequence
  derived and/or modified sequence opt3 from anti-influenza_Chain
gacaucgagcugacccaggaucccagcguguccgucgccccuggccaaacagcuaggauuccaugcguuagauucaacauggggccgacuucugugcacugguaccagcagaagcccggacaggcaccuguacucguggucuaugacgauucagaccggccaagugguauacccgaacgcuuuagcggcuccaauucuggggauucggccacgcuuaccaucucacgaguggaggcgggagacgaagcugauuacuauugucaaguuugggacaugagcagugaucguagaguguucggcggugggacaacucugaccgucuugggacag

SEQ ID NO: 27736 - RNA, 330 nt, Artificial Sequence
  derived and/or modified sequence opt3 from anti-influenza_Chain
gacaucgugaugacccagagccccggcacacugucccucucuccuggggagagagccacucuuuacugcagggcuucacaaaguguccggagcggauaucuggcaugguaccagcacaagccaggucaggccccguuguuacuguucuaugaugcguccggccgcgcuacggggauucccgaccgauuuucuggaucgggcucagguaccgauuucacacuaacuauaagccgucucgaaccugaggacuuugccguuuacuauugucugcaguacgggaguuccccaagaaccuucggacaaggcacaaaaguggaaaucaagaggacc

SEQ ID NO: 27737 - RNA, 330 nt, Artificial Sequence
  derived and/or modified sequence opt3 from anti-influenza_Chain
gacaucgugcugacccagagccccuccuuccucucugccucagucggcgauagaguuacaauuacuugcagggcuagucaacuuauaagcuccuacuuugcaugguaucagcagaagccugggaaaccaccgaagcuguugaucuacgccgcgucuacguuacagucgggagugcccucacgguucagcgguaguggcuccgggacccaauuuucucugacaauuagcucccuacagccugaggacuucgcuacuuauuacugucagcagcucaacucauauccacccaucaccuuuggacaaggcacacgccuggaaauuaaacgaacc

SEQ ID NO: 27738 - RNA, 330 nt, Artificial Sequence
  derived and/or modified sequence opt3 from anti-influenza_Chain
gacaucacccugacacagagccccgccacucucuccgugucuccuggcgagagagcuacgcuuucaugcagggcaagucaaagcgucuccucuaaccuggccugguaccagcagaagccagggcaggcgccgcgguuguuaauuuauggagcuucgaaucgcgccaccgauauacccgcacgauucucagguagcggcagugggacagaauuuacucugaccaucuccucucuacaaagcgaggacuucgccguuuacuauugucagcaguuuaacgauuggccuuuccucacauuuggaggcgguaccaaaguggaaauuaagcguacu

SEQ ID NO: 27739 - RNA, 330 nt, Artificial Sequence
  derived and/or modified sequence opt3 from anti-influenza_Chain
gacaucgugaugacccagagccccuccuuccugucugccucagucggcgauagaguuacaauuacuugcaggacgagucaagugauaagcuccuaccucgcuugguaucagcagcggccugggaaggcaccaaaacuucugaucuacgccgcgucuaccuugcagucgggaguaccgucacgcuuuagcgguaguggcuccgggacacgauucucuuuaacuauuagcaaccugcaacccgaggacuuugcuaccuauuucugucagcagcuaacaaccuacccuccaaucacuuuuggacagggcacacgucucgaaauuaagagaacc

SEQ ID NO: 27740 - RNA, 330 nt, Artificial Sequence
  derived and/or modified sequence opt3 from anti-influenza_Chain
gacaucgugcugacccagagccccuccgucucuguugccccuggccaaacagcuagaauuacuugcgggggaaacgauauagguucaaagagugugcacugguaccagcagaaaccaggccaggcaccgguacucguggucuucgacgauagggaccggcccagcgggaucccugagcgcuuuuccggaucuaauucgggcaacacggccacccuuacaauuucacgaguggaagcgggugaugaggcugacuauuacugucaaguuugggauaucacuagcgaccugguggucuucgggggaggcaccaaguugacagugguaggccag

SEQ ID NO: 27741 - RNA, 330 nt, Artificial Sequence
  derived and/or modified sequence opt3 from anti-influenza_Chain
gacaucgugaugacccagcccccuggcacacugagcgucuccccaggggagagagccacucucucuugcagggcuucacaaaguguuagcacgaaccuugcaugguaccagcagaagccgggacaggcgccccggcuguugauucacggugccuccacccgcgcuacaggcauaccugcccgauucucugggucgggaucaggcgcagaauuuacuuuaaccaucagcagucugcaauccgaggauguggccguauauuacugucagcaguaugacaauuggcuaccaauuacauucggucccgggaccaaaguggauauccagcguacu

SEQ ID NO: 27742 - RNA, 330 nt, Artificial Sequence
  derived and/or modified sequence opt3 from anti-influenza_Chain
gaccccaugcugacccagacagccagcccuguguccgcugcagucggcgggacuguuacgaucaacugccaagccucucagucaguguacaauaagaacaaucucgcgugguaucagcagaaacuuggacaaccaccgaagcuguugauuuacgcugccaguaccuuaacaagcgguguacccuccagauucaaaggcucugggucgggaacucaguuuacccugacaauaucagaucuagagugugacgaugcagccaccuauuacugcgcuggcgacuauagcggugggaucuacgcauucggaggcggcacuaagguggaaauuaaa

SEQ ID NO: 27743 - RNA, 330 nt, Artificial Sequence
  derived and/or modified sequence opt3 from anti-influenza_Chain
gagcuggugaugacccagacacccgccagcgucuccgcugcaguuggcgggacugugacgaucucuugccaaucaagugaaagcguauacaagaacaauaaccucgccugguuccagcagaaacuuggacagccuccaaagcuguugauuuaugacgcguccaaauuagcuucuggugugccgucgagauuuucaggcagcgggaguggaacccaauucacacugacuauauccgaucuagagugugacgaugccgcaaccuacuauugcgccggcgacuacucugguagcaauuaugcuuuugggggaggcacaaagcucgaaaucaaa

SEQ ID NO: 27744 - RNA, 330 nt, Artificial Sequence
  derived and/or modified sequence opt3 from anti-influenza_Chain
gagcccaugcugacccagacagccagcuccgugucugcugcagucggcgggucaguuacuaucaguugccaaagcucccagucuguggacucgaacaaucagcucucaugguaccagcaaaagccuggacagccaccgaaacuucugauuuaugccgcgagcacguugaccagugguguacccuccagauucaagggcucugggagcggaacacaguuuacuuuaaccauauccgaucuggaaugugacgaugcugccacauacuauugcgcaggcgacuacucaggugggaucuaugccuucggaggcggcaccgagguggucgugaaa

SEQ ID NO: 27745 - RNA, 330 nt, Artificial Sequence
  derived and/or modified sequence opt3 from anti-influenza_Chain
gaccccaugcugacccagacagccgcuagcguguccgcagccgucggcgggacuguuacgaucucuugccaaucaagugagagcguguacaagaacaauaaccucgcgugguuccagcagaaacuuggacagccuccaacccuguugauuugggaugcuuccaaguuagccucugguguaccgucgagauuuucaggcagcgggaguggaacacaauucacucugaccauauccgaccuagaaugugaugacgcagccacauauuacugcgcuggcgauuauucuggugugaauuacgcauuugggggaggcaccgaggucgugguuaaa

SEQ ID NO: 27746 - RNA, 330 nt, Artificial Sequence
  derived and/or modified sequence opt3 from anti-influenza_Chain
gagcuggugaugacccagacacccgccagcgucuccgcugcaguuggcgggacugugacgaucucuugccaaucaagugaaagcguauacaagaacaauaaccucgccugguuccagcagaaacuuggacagccuccaaagcuguugauuuaugacgcguccaaauuagcuucuggugugccgucgagauuuucaggcagcgggaguggaacccaauucacacugacuauauccgaucuagagugugacgaugccgcaaccuacuauugcgccggcgacuacucugguagcaauuaugcuuuugggggaggcacagaagucgugguuaag

SEQ ID NO: 27747 - RNA, 330 nt, Artificial Sequence
  derived and/or modified sequence opt3 from anti-influenza_Chain
gaccccaugcugacccagacagccagcuccgugucugcuacugucggcgggacgguuaccaucucaugccaaaguagccaguccguggauaacaauaaggaccucgcaugguuccagcagaaaccuggacacucuccaaaacuucugauuuacuuugccucgagauuggcgucagguguaccgagcagguucaagggcaguggguccggaacacauuuuacuuuaaccauaucugaucuggagugugacgaugcugccacauauuacugcgcaggcgacuauagcggugccaacuacgcuuucgggggaggcaccaagcuagaaaucaaa

SEQ ID NO: 27748 - RNA, 330 nt, Artificial Sequence
  derived and/or modified sequence opt3 from anti-influenza_Chain
gaccccaugcugacccagacagccagcccuguguccgcugcagucggcgggacuguuacgaucaacugccaaucuucacagaguguguacaauaacaauagacucagcugguuccagcagaagccaggacaaccgcccaaacuucugauuuauuccgccucuaccuuggcgucggguguaucaagcagguuuaagggcaguggguccggaacacaguucacuuuaaccauaucugaucuggagugugacgaugcugccacauacuauugcgcaggcgacuacagcggugggaucuaugccuuuggaggcggcaccgaacuagagauucuc

SEQ ID NO: 27749 - RNA, 330 nt, Artificial Sequence
  derived and/or modified sequence opt3 from anti-influenza_Chain
gagcuggugcucacccagacacccgccagcgucuccgcugcaguuggcgggacugugucuaucucaugccaaaguagccaguccguauacaagaacaauaaccuugccugguuccagcagaaacugggacaaccuccaacguuguuaauuugggacgcgucuaagcuggcuucgggugugccgucaagauuuagcggcaguggguccggaacccaguucacacuaacuauaucugaucucgaaugugacgaugccgcaaccuauuacugcgccggcgacuauagcggugucaauuacgcuuuugggggaggcacaaaacuggagaucaag

SEQ ID NO: 27750 - RNA, 330 nt, Artificial Sequence
  derived and/or modified sequence opt3 from anti-influenza_Chain
gagcuggaccucacccagacacccgccagcguguccgcugcagucggcgggacuguuacgaucucuugccaaucaagugaaagcguguacaagaacaauaaccuugccugguuccagcagaaacugggacagccuccaaccuuguuaauuugggaugcguccaagcuggcuucugguguaccgucgagauuuucaggcagcgggaguggaacacaauucacucuaaccauauccgaccucgagugugaugacgccgcaacauauuacugcgccggcgauuauucuggugugaauuacgcuuuugggggaggcaccgaagucgugguuaaa

SEQ ID NO: 27751 - RNA, 330 nt, Artificial Sequence
  derived and/or modified sequence opt3 from anti-influenza_Chain
gacauccagaugacccaaagccccuccucucugucagccagugugggcgauagagucacaauuacuugccagagcuccgagucuguuuacaagaacaauaaccucgcuugguaucagcagaaaccugggaagccaccgaaacuucugauaugggacgcaucgaaguuggccucaggagugcccagcagguucagugguuccggcucugggacggauuuuaccuuaacaaucagcucccugcaaccugaagacguagcgacuuacuauugugcuggagauuacucaggcgugaauuaugccuucggugggggaaccgaggucgugguuaaa

SEQ ID NO: 27752 - RNA, 333 nt, Artificial Sequence
  derived and/or modified sequence opt3 from anti-influenza_Chain
gacaucgugaugacccagagccccgauucccuggccgucucucucggcgagagagcuacaauuaacugcaagucaagucaaagcguuacuuucaauaacaaaaauuaccuugcaugguaucagcagaagccugggcagccaccgaaacuguugauauacugggccuccacgagggaaucuggagugcccgaccgguuuucggguucaggcagcgggaccgauuucacauuaacuaucaguucccugcaagcggaggacguagcuguguauuacugucagcagcacuaucgcaccccuccaacauuuggacagggcaccaaggucgaaauuaaa

SEQ ID NO: 27753 - RNA, 333 nt, Artificial Sequence
  derived and/or modified sequence opt3 from anti-influenza_Chain
cagagcgcccugacccaacccgcuuccgugucuggcucaccugggcagaguaucacaauuagcugcacuggaacggguuccgacgucggcagcucgaaccucguuucaugguaccagcagcacccagcaaaggccccgaaacuuauaaucuaugaggugaccaagagacccagcgggguaaguaauagguucuccggaucuaaaagcggcaacacagcgucccugacuauuucagguuugcaagcugaagaugaggccgacuacuauuguugcaguuacgcagggucuucuuccucacggguguuuggaaccggcacaaaggucaccguguua

SEQ ID NO: 27754 - RNA, 333 nt, Artificial Sequence
  derived and/or modified sequence opt3 from anti-influenza_Chain
cagagcgugcugacccaacccccuuccgccucuggcacaccagggcagagagucacuaucucaugcaguggaagcacguccaacauugguucuaaugcuguuaacugguaccagcagcucccgggcaccgcacccaaacuucugauauauucgaauaaccaaaggccuucaggggugccagaccgguucagcggaaguaaguccggcacaucugccagcuuggcgaucuccgguuuacagucagaggaugaagcugacuacuauugugccgcaugggaugacagucugagcgggucuuggguauuuggaggcggcacuaagcuaaccgugcuc

SEQ ID NO: 27755 - RNA, 333 nt, Artificial Sequence
  derived and/or modified sequence opt3 from anti-influenza_Chain
gagaccacacugacucagagccccggcacgcucucccuuucuccuggggaaagagccacccugucaugcagggugagucaaagcgucuccucuaacuacuuggcuugguaucagcagaagccaggacaggcaccgcgguuacugaucuacggugccucgucacgcgcgacaggcauucccgaccgauucagcgggaguggauccggcacugauuuuacccuaacaauaucucgucucgagccugaagacuucgcuguuuauuacugucaacaguaugguaccagcccaagagccuuugggcacggaacuaaaguggagaucaagaggacagua

SEQ ID NO: 27756 - RNA, 333 nt, Artificial Sequence
  derived and/or modified sequence opt3 from anti-influenza_Chain
cagagcgugcugacccaacccccuuccgucucuggcgccccagggcagagaguuacaaucucaugcggagguaguaggagcaacauuggcgcuggguacgacgugcacugguaucagcaguucccgggaacugcacccaagguagugauauacggcaauaacaaucggccuuccggugucccagaucgcuuuucugggucgaaaucaggaacgagcgccagucucgcgaucaccggccuucaagcugaggacgaagccaacuauuacugucaguccuaugauacaaaucugggcgggucuauuuucggagguggcacucaggugaccguuuug

SEQ ID NO: 27757 - RNA, 333 nt, Artificial Sequence
  derived and/or modified sequence opt3 from anti-influenza_Chain
aacuucaugcugacccagccccacagcguguccgagucuccuggcaagacagucacuaucucaugcacggggaguagcggauccauugccucuaauuacguucaaugguaucagcagagaccagguucggcuccgaccacagugauauacgaagacuaucagaggcccucaggcguaccugaucgguuuagcgggaguaucgacuccucuagcaacuccgcaucacucacuauuaguggacuuaaaaccgaggaugaagccgacuacuauugucaaagcuacgaugacucugaucaucugaucuucggcggugggacaaaguugaccguguua

SEQ ID NO: 27758 - RNA, 333 nt, Artificial Sequence
  derived and/or modified sequence opt3 from anti-influenza_Chain
cagagcaugcugacccaacccccuuccgccucuggcacaccagggcagagagugacuaucucaugcaguggaagcuccucuaacauugguucgaauacggucaacugguucaagcaccucccgggcaccgcucccaaacuucugauauacaggaaugacuugcggccuucagggguuccagaucgcuuuagcggaaguaaguccggcacaucugccagcuuagcaaucuccggucugcagucagaggacgaagcggauuauuacugugcuacuugggacgauagucuaaacggguucuauguguuuggaaccggcacaaaaguaaccgugcuc

SEQ ID NO: 27759 - RNA, 333 nt, Artificial Sequence
  derived and/or modified sequence opt3 from anti-influenza_Chain
gacauccagcugacccaaagccccuccucucucucagccagugcuggcgauagagugagcaugacaugcagggcaucccagauuauaucuucgucacuuaacugguaccagcagaagccugggaaagccccaaagcuguugaucuaugcggcuagcaauuuacaaaguggagucccgucccgguucucugguagcggcuccgggacugacuuuacgcugaccauuucaagucuacagcccgaggauuucgccacauacuauugucagcagagcuacucuacuccuccagaacucaccuuuggaggcgguacaaaaguugacaucaagcgcacc

SEQ ID NO: 27760 - RNA, 333 nt, Artificial Sequence
  derived and/or modified sequence opt3 from anti-influenza_Chain
agcuacgugcugacccagcccccuuccgccucuggcacaccagggcaaagagucacuaucucaugcaguggaagcacguucaacauugguuccaaugcuguugacugguauaggcagcucccgggcaccgcacccaaacuucugauauacucuaacaaucagcggccuucgggggugccagaucgcuuuucaggaagccgaaguggcacauccgccucuuuggcgaucagcgguuuacaguccgaggacgaagcugauuauuacugugccgcaugggacgauauucugaacguacccguguucgggggaggcacuaagcuaaccguccucggc

SEQ ID NO: 27761 - RNA, 333 nt, Artificial Sequence
  derived and/or modified sequence opt3 from anti-influenza_Chain
cagagcgcccugacccaacccgcugcaguguccggcucuccugggcagucaaucacaauuaguugcacuggaacgagcuccgacgucgguggcuacaacuauguuucuugguaccagcagcacccagggaaggccccgaaacucaugauauaugaggugucgaauagacccucaggaguaagcaacagguucaguggcuccaagucugguaauaccgcgagccuuacaaucuccgggcugcaagcugaagaugaggccgacuacuauuguucaaguuacacuucuagcuccaccuauguguuuggaacaggcaccaaagucacuguguugggc

SEQ ID NO: 27762 - RNA, 333 nt, Artificial Sequence
  derived and/or modified sequence opt3 from anti-influenza_Chain
agcuacgugcugacccagcccccuuccgucucuggcacaccagggcaaagaguuacuaucucaugcaguggaagcagguccaacgugggugacaauucuguauauugguaccagcacgugccggagauggcccccaagcuccuugucuauaaaaacacgcagcggccuucgggcgugccagcucgcuucucagggagcaagaguggaaccuccgcaucucuggccauuauaggcuugcagagcggugaugaagcggacuacuauuguguugcuugggaugacuccguggauggguacgucuuuggaucaggcacaaaagugacuguauuaggc

SEQ ID NO: 27763 - RNA, 333 nt, Artificial Sequence
  derived and/or modified sequence opt3 from anti-influenza_Chain
agcgugcugacccagcccccuuccgucucugccgcuccaggccaaaagguuacaaucucaugcagugggagcuccucuaacauuggaaaugacuacgugucgugguaucagcagcucccggguacugcacccaaacuucugauauacgauaacaauaagagaccuucaggcaucccagacagguucagcgggaguaaauccggaacgucugccaccuugggcauuacagguuuacagacuggggaugaggcgaacuauuacugugcuaccugggaccggcgccccacagccuauguaguguuuggaggcggcaccaagcugacuguccuaggg

SEQ ID NO: 27764 - RNA, 333 nt, Artificial Sequence
  derived and/or modified sequence opt3 from anti-influenza_Chain
cagagcgcccugacccaacccagauccgugucuggcucaccugggcagagugucacaaucagcugcacuggaacguccucugacguugguggcuacaacuaugugucgugguaccagcagcacccagggaaggcuccgaaacucaugauuuaugauguaucaaagaggcccagcggagugccugaccgguucaguggcuccaaaucugguaauaccgcaagccuuacaauauccgggcugcaagccgaggaugaagcggacuacuauuguucaaguuacacuucuagcuccacccaugucuuuggaacaggcaccaaggugacuguuuugggc

SEQ ID NO: 27765 - RNA, 333 nt, Artificial Sequence
  derived and/or modified sequence opt3 from anti-influenza_Chain
agcuacgugcugacccagcccccuuccgccucuggcacaccagggcaaagagucacuaucucaugcaguggaagcuccucuaacauugguucgaauuauguuuacugguaucagcagcucccgggcacggcucccaaguugcugauauacagggacgggcagcggccuucaggagugccagaucgcuucagcggcaguaaauccgguaccucugcaagccuugccaucuccggguuacgaucagacgaugaggcggacuauuacugugcuacaugggaugacaaccugaguggacccguauuuggcggcgggacuaagcuaaccgugcucgga

SEQ ID NO: 27766 - RNA, 333 nt, Artificial Sequence
  derived and/or modified sequence opt3 from anti-influenza_Chain
cagagcgcccugacccaacccgcuuccgugucuggcucaccugggcagaguaucacaauuagcugcacuggaacguccucugacgucgguggcuacaacuauguuucgugguaccagcagcacccagggaaggcaccgaaacucaugauauaugaggugucaaauagacccagcggaguaaguaacagguucuccggcucuaagagcgguaauaccgccucccuuacaaucucagggcugcaagcggaagaugaggcugacuacuauuguaguagcuacacuucuuccucaaccuugguguuuggaacaggcaccaaagucacuguguuaggc

SEQ ID NO: 27767 - RNA, 333 nt, Artificial Sequence
  derived and/or modified sequence opt3 from anti-influenza_Chain
accgugcugacacagcccccuagcgucuccggcgccccagggcaaagaguuacuaucucuugcacgggaucaaguagcaacauuggugcuggcuacgacgugcacugguaucagcagcucccggggaccgcacccaaacuucugauauacggaaauuccaacaggccuucuggcguaccagaucgguucucggguucaaagagcgggacaagugccacuuugggaaucaccggcuuacagacaggcgacgaggcggauuauuacugugggaccugggacuccucucugagcgcuuauguguuuggaacugguacaaaggucaccgugcuaggc

SEQ ID NO: 27768 - RNA, 333 nt, Artificial Sequence
  derived and/or modified sequence opt3 from anti-influenza_Chain
ggcagcgcccugacccagcccagauccgugucugggucaccuggacaaagugucacaaucagcugcacugguacguccucugacguuggcggguacaacuaugugucgugguaccagcagcacccaggaaaggcuccgaaacucaugauuuaugauguaucaaagaggcccagcggcgugccugaccgguucagugguuccaaaucugggaauaccgcaagccuuacaauauccggacugcaggccgaggaugaagcggacuacuauuguucaaguuacacuucuagcuccacccaugucuuuggcacaggcaccaaggugacuguuuugggg

SEQ ID NO: 27769 - RNA, 333 nt, Artificial Sequence
  derived and/or modified sequence opt3 from anti-influenza_Chain
gagaucgugcugacccagagccccggcacacucucccuuucuccuggggaaagagccacucugucaugcagggcuagucaaagcgucuccucuucguacuuggcaugguaucagcagaagccaggacaggccccgcgguuacugauuuucggugcgucaacgcgcgcuaccggcauacccgaccgauuuagcgggaguggauccggcacagauuucacucuaaccaucucucgucucgagccugaagacuuugccguuuucuacugucaacaguaugguagccugccacuuacauuugggggaggcaccaaaguggagauuaagggcacugua

SEQ ID NO: 27770 - RNA, 333 nt, Artificial Sequence
  derived and/or modified sequence opt3 from anti-influenza_Chain
gagaucgugcugacccagagccccggcacacucucccuuucuccuggggaaagagccacucugucaugcagggcuagucaaagcguccgguccaacaauuuggcaugguaccagcacaagccaggacaggccccgcgcuuacugauuuucggugcgucuucgcgagcuacgggcauacccgaccguuuuucagggagcggaaguggcaccgauuucacacuaacuaucuccagacucgagccugaagacuuugccguuuauuacugucagcaauaugguucuagcccagcacugaccuucgggggaggcacaaaaguggagauuaagaggacc

SEQ ID NO: 27771 - RNA, 333 nt, Artificial Sequence
  derived and/or modified sequence opt3 from anti-influenza_Chain
cagagccuggaggaauccggcgggggacucgugaagcccgguggcucucuuacccugacaugcacugucucaggguugaguuuauacagcaacgagaucaauuggguuagacaagccccuggaaacggccuggaauggauuggugcuauagcaggguccggaucugccgacuaugcgucgugggcuaaaggcaggucaacgaucacccggaauacagaucuaaacacugugacccucaagaugacaagccugaccgccgcagacacugccacauacuucugugcuaguuuuugggaucuuuggggcccagggacccugguaacgguguccucu

SEQ ID NO: 27772 - RNA, 333 nt, Artificial Sequence
  derived and/or modified sequence opt3 from anti-influenza_Chain
cagagcguggaggaauccggcgggggacuggucaagcccgguggcucucucacccuuacaugcacuguuucagggcugaguuuguacagcaacgagaucaauugggugagacaagccccuggaaacggcuuagaauggauuggugcuauagcaggguccggaucugccgacuaugcgucgugggcuaaaucaaggagcacgaucacccggaauacaaaccugaauacuguaacccuaaagaugacaagucucaccgccgcagauacugccacauacuucugugcuuccuuuugggaccuguggggcccaggcacccuugugacggucucuagc

SEQ ID NO: 27773 - RNA, 333 nt, Artificial Sequence
  derived and/or modified sequence opt3 from anti-influenza_Chain
cagagccuggaggaauccggcgggggacucgugaagcccgguggcucucuuacccugacaugcacugucucaggguugaguuuauacagcaacgagaucaauuggguuagacaagccccuggaaacggccuggaauggauuggugcuauagcaggguccggaucugccgacuaugcgucgugggcuaaaucaaggagcacgaucacccggaauacaaaccuaaauacugugacccucaagaugacaagucugaccgccgcagauacugccacauacuucugugcuuccuuuugggaccuuuggggcccaggcacccugguaacggugucuagc

SEQ ID NO: 27774 - RNA, 333 nt, Artificial Sequence
  derived and/or modified sequence opt3 from anti-influenza_Chain
aacaucgugcugacccagagccccgccucccucgcugucucucuuggccaaagagcaacaauuucaugcagggccagugagagcguugacauauacggaaauuccuucaugcacugguaucagcagaagccugggcagccaccgaaacuguugaucuacuuagcgucuaagcuggaauguggugugugcgcucgguuuaacggcucggggugucgcacugauuucacgcuagccauugaccccguagagggagaugacggcgcaaccuauuacugccaacagaauuaugaagauccuuggacauuuggugggggaacuaaacucgagaucaag

SEQ ID NO: 27775 - RNA, 333 nt, Artificial Sequence
  derived and/or modified sequence opt3 from anti-influenza_Chain
aacaucgugcugacccagagccccgccucccucgcugucucuccuggccaaagagcaacaauuucaugcagggccagugagagcauagacaucuacggaaauuccuucaugcacugguaucagaagaaaccagggcagccgcccaaacuucugauuuaccgggcgucuaacuuggaaucggguguuccugcucgcuuuaauggcucagggagccgaacugauuucacguuaaccaucgacccaguggagggagaugacggcgccacauauuacugucagcaaaacuaugaagaucccuggacuuuuggugggggaaccaagcuggagauuaag

SEQ ID NO: 27776 - RNA, 333 nt, Artificial Sequence
  derived and/or modified sequence opt3 from anti-influenza_Chain
gagaucgugcugacccagagccccgccacacucucccuuuacccuggcgaaagagcuacucugucuugcagggcaucacaaagugucagccgguauuuggccugguaccagcagaagccagggcaggcgccgcgcuuacugauuuaugacgcuuccaaccgagccacgggaauacccgcacguuucucugguucgggcucagggaccgauuuuacacuaacuaucagcagucucgagccugaagacuucgccguuuacuauugucaacagagauccaauuggcugaaaauuaccuuuggacagggcacaaggcuugagaucaaggguaccgug

SEQ ID NO: 27777 - RNA, 336 nt, Artificial Sequence
  derived and/or modified sequence opt3 from anti-influenza_Chain
gacaucgugaugacccagagccccgauucccuggccgucucucucggcgagagagcuacaauuaacugcaagucaagucaaagcguucuuuacuccucuaauaacaaaaauuaucuggcaugguaccagcagaagccugggcagccaccgaaauuguuaauagacugggccucgacuagggaaucaggagugcccgaucgguucagcgguaguggcuccgggacggacuuuacccugacaaucucuaaccuacaaguagaggauguggcggucuauuacugucagcaguauuaccgcagcccuuccuucggacagggcacuaagcucgaaauuaaa

SEQ ID NO: 27778 - RNA, 336 nt, Artificial Sequence
  derived and/or modified sequence opt3 from anti-influenza_Chain
gacaucgugaugacccagacaccccugagccucuccgucacuccuggccaaccagccucuauuucaugcaagaguagccagucccuucugcacucugaugggaaaacguacuuguauugguacuuacagaagccgggacagucgccccaacugcuaauauaugagguuucaaacagauucagcggugugccugacagguuuaguggcuccgggucuggaaccgauuucacacucaaaaucagccggguagaagcugaggacgugggcgucuacuauuguaugcagaauauucugcuuccacugacuuuuggugggggaaccaagguggaaaucaaa

SEQ ID NO: 27779 - RNA, 336 nt, Artificial Sequence
  derived and/or modified sequence opt3 from anti-influenza_Chain
gagaucgugaugacccagacaccccugagccucuccgucacuccuggccaaccagccucuauuucaugcagaaguagccagucccuucugcacucugacgggaagacguacuuguauugguacuuacagaaaccgggacagcccccucaacugcuaauaucggaaguuuucaacagguuuucaggugugccagaucgguucagcggcaguggguccggaaccgacuuuacacucaagaucucucgcguagaggcugaagaugugggcgucuauuacuguaugcagagccugcagcuuccccugacuuucggugggggaaccaaaguggagauuaag

SEQ ID NO: 27780 - RNA, 336 nt, Artificial Sequence
  derived and/or modified sequence opt3 from anti-influenza_Chain
gacaucgugaugacccagagcccccugucccucccugucacaccaggcgagccggccucuauuucaugcagagcuagucaaagccuucugcacuccaacggguacaauuauuuggauugguacuuacagaagcccggacagucuccucagcugcuaauacaacucgguucgacuagggcaucaggcguuccagaccgguucagcgggaguggauccggcacggauuuuacccuggaaaucucucgcguggaggccgaagacguagguguguauuacuguaugcaggcgcuucagcugcccuuggcuuucgggcagggaacacgacucgagauuaaa

SEQ ID NO: 27781 - RNA, 336 nt, Artificial Sequence
  derived and/or modified sequence opt3 from anti-influenza_Chain
gacaucgugaugacccagagcccccugucccucccugucucuccaggcgagccggccucaauuaguugcagaagcucccaaucucuucugcacgggaacggauacaauuauuuggauugguacuuacagaagcccggucagucgccuaggcugcuaauauaucucggcucaaaccgggcuagcgggguuccagaccgcuucaguggauccggcucugguacagauuuuacucugaaaaucagccgaguggaagcagaggacguagggguguacuauuguaugcaggcccuucaaacgccccugaccuucggaggcggcacaaaggucgaaauuaaa

SEQ ID NO: 27782 - RNA, 336 nt, Artificial Sequence
  derived and/or modified sequence opt3 from anti-influenza_Chain
cagagcgugcugacccaacccccuuccgucucuggcgccccagggcagagaguuacaaucucaugcacuggaaguagcuccaacauuggugcuggcuacgacgugcacugguaucagcagcucccggggacggcacccaaacuucugauauacgauaauaacaauaggccuucuggaguaccagaccgguucucgggcucaaagagcggugccagugcguccuuggcuaucaccggguuacaagccgaggaugaagcacauuauuacugucagucuuaugacaacagccuguccggaucaguguuuggcggcgggacacagcuaacuguccucagu

SEQ ID NO: 27783 - RNA, 336 nt, Artificial Sequence
  derived and/or modified sequence opt3 from anti-influenza_Chain
cagagcgugcugacccaacccccuuccgucucuggcgccccagggcagagaguuacaaucucaugcacuggaaguagcuccaacauugguucugacuacgaugugcacugguauaagcagcucccgggcacggcucccaaacuucugauauucgggaauagcaacaggccuucaggaguaccagaccgguuuagcggcaguaaguccgguaccucugcaucguuggccaucacaggguuacaggcggaggaugaagcugacuacuauugucaauccuacgauucaagucugagcggauuccauguguuuggcucuggcacuaaagucaccgugcua

SEQ ID NO: 27784 - RNA, 336 nt, Artificial Sequence
  derived and/or modified sequence opt3 from anti-influenza_Chain
cagagcgugcugacccaacccccuuccgucucugccgcuccaggccagaagguuacaaucucaugcagugggagcuccucuaacauuggaaaugacuacgugucgugguaucagcagcucccggguacugcacccaaacuucugauauacgauaacaauaagagaccuucaggcaucccagacagguucagcgggaguaaauccggaacgucugccaccuugggcauuacagguuuacaaacuggggaugaggcgaacuauuacugugcuaccugggaccggcgccccacagccuauguaguguuuggaggcggcaccaagcugacuguccuaggg

SEQ ID NO: 27785 - RNA, 336 nt, Artificial Sequence
  derived and/or modified sequence opt3 from anti-influenza_Chain
gagaucgugcugacccagagccccggcacacucucccuuucuccuggggaaagagccacucugucaugcagggcuagucaaagcgucuccucuucguacuuggcaugguaucagcagaagccaggacaggccccgcgguuacugauuuacggugcgucaacgcgcgcuaccggcauacccgaccgauucagcgggcguggaaguggcacagauuuuacucuaaccaucuccucucucgagccugaagacuucgccguuuauuacugucaaaacuaugguagcccauuucuguucacauuugggcccggaaccaaaguggauauuaagagaacugua

SEQ ID NO: 27786 - RNA, 336 nt, Artificial Sequence
  derived and/or modified sequence opt3 from anti-influenza_Chain
gacauccagcugacccaaagcccccucuccccuccagugacacuuggccagccggccucuauuucaugcagaaguagccagucccuguuguacacugauggguucacguauuuaucuugguaccaccagaggcccggacaaucgccucggcgccugauauauaagaucucaaaccgagacagcggugucccagaucguuuuaguggcuccgggucuggaaccgacuucacacuaaaaauuagcagaguugaggcugaagaugugggcguauacuauuguaugcaggcaacucauuggccccucaccuuuggugaggggacaaagguggaaaucaaa

SEQ ID NO: 27787 - RNA, 336 nt, Artificial Sequence
  derived and/or modified sequence opt3 from anti-influenza_Chain
gacaucgagcugacccaggaacccagcgccuccggcacaccugggcaaagagugacuauuucuugcucaggagauacgaguaacauagguagcaauaccgucuccugguuccagcuccuuccaggcacagcuccgaagcuguugaucuuuacugacaaccagaggcccucugggguuccuggacgguucucgggcucaaaaagcgguaccagugcauccuuagccauuucugggcugcagagcgaggaugaaacagacuacuauugugcggcuugggaugacucccuaaauggauggguguuuggcggcgggaccaagcucacuguacugggacaa

SEQ ID NO: 27788 - RNA, 336 nt, Artificial Sequence
  derived and/or modified sequence opt3 from anti-influenza_Chain
gacaucgugcugacccagagccccuccgccucuggcucaccugggcaaagugucacaauuagcugcacuggaacguccucugauguugguggcuacgacuaugugucgugguaccagcagcacccagggaaggcuccgaaacucaugauauaugagguaagaaagaggcccucaggagugccugaucgguucagcggcaguaaauccgguaacaccgcaucucuuacagucagcgggcugcaggccgaagacgaggcguacuauuacugugcuuccuaugccggaacuuacauccauuuguuuggcggcgggaccaaguuaacagugcugggacaa

SEQ ID NO: 27789 - RNA, 336 nt, Artificial Sequence
  derived and/or modified sequence opt3 from anti-influenza_Chain
caggagcaacugauggaaagcggcgggggacucgugaagcccgguggcucccuuacccugacaugcacugucucuggguugucauuauacaguaacgagaucaauuggguuagacaggccccuggaaacggccuggaauggauuggugcuauagcagggagcggauccgccgacuaugcgucuugggcuaaaucgaggucaacgaucacccggaauacaaaccuaaauacugugacccucaagaugacaagccugaccgccgcagauacugccacauacuucugugcuaguuuuugggaccuuuggggcccaggcacccugguaacgguguccucu

SEQ ID NO: 27790 - RNA, 336 nt, Artificial Sequence
  derived and/or modified sequence opt3 from anti-influenza_Chain
cagcaacagcugauggagagcggcgggggacucgugaagcccgguggcucccuuacccugacaugcacugucucuggguugucauuauacaguaacgaaaucaauuggguuagacaggccccuggaaacggccuggaguggauuggugcuauagcagggagcggauccgccgacuaugcgucuugggcuaaaucgaggucaacgaucacccggaauacagaucuaaacacugugacccucaagaugacaagccugaccgccgcagacacugccacauacuucugugcuaguuuuugggaucuuuggggcccaggcacccugguaacgguguccucu

SEQ ID NO: 27791 - RNA, 336 nt, Artificial Sequence
  derived and/or modified sequence opt3 from anti-influenza_Chain
cagcaacagcugguggagagcggcgggggacucgucaagcccgguggcucccuuacccugacaugcagaguuucuggguugucauuauucaguaacgaaaucaauugggugaggcaggccccuggaaacggccuggaguggauuggugcuauagggggaggcggcagcgcagacuacgccuccugggcgaaaucucggucgacuaucacgcgcaauaccaaccuaaauacaguaacucuccgaaugaccucacugacagcugccgauaccgcagccuauuuuugugcuagcuucugggaccuuugggggccaggaacucuggugacagucaguucc

SEQ ID NO: 27792 - RNA, 336 nt, Artificial Sequence
  derived and/or modified sequence opt3 from anti-influenza_Chain
gaggugcagcuggucgaaagcggcgggggacucguuaagcccgguggcucccuuagacugucuugcgccgcuucaggguugaguuuauucagcaacgagaucaauugggugaggcaagcaccuggaaaaggccuggaauggauuggugccauagggggaggcggcuccgcggacuacgcuucuugggccaagucgcgguuuaccaucucacgcgauaacgccaaaaauagccuauaucuccagaugaacagucugcgagcagaggacacagcuguauacuucugugcauccuuuugggaucuuugggggccaggaacucuggugacggucucuagc

SEQ ID NO: 27793 - RNA, 336 nt, Artificial Sequence
  derived and/or modified sequence opt3 from anti-influenza_Chain
gacaucgugaugacccagagcccccugucccucccugucacaccaggcgagccggccucuauuucaugcagaaguagccaaucccuucugaggucuaacggguacaauuauuuggauugguacuuacagaagcccggacagucgccucagcugcuaauauaucucgguucaaaccgggcuagcggcguuccagaccgcuucaguggguccggaucuggcacugauuuuacgcugaaaaucagccgaguggaagcagaggacguagguguguacuauuguaugcaagcccuucagacccccuacacauucgggcagggaacuaagcuggaaauuaaa

SEQ ID NO: 27794 - RNA, 339 nt, Artificial Sequence
  derived and/or modified sequence opt3 from anti-influenza_Chain
gacaucgugaugacccagagccccgauuuccugccugucucccucggcgagagagccacaauuaacugcaagucuucacaaaggguucuuuacaguagcaauaacaaaaauuaucuggcuugguaccaguugaagccagggcagccgcccaaauuaauaaucuauugggcauccacucgggaaucuggagugccugaccgcuuuucggguucaggcagcgggacggaguucacccugacaauuaguucccuacaggccgaagauguagcgguguacuauugucaacaguacuauucucgaccauacacuuuuggacagggcaccaagcucgagaucaaa

SEQ ID NO: 27795 - RNA, 339 nt, Artificial Sequence
  derived and/or modified sequence opt3 from anti-influenza_Chain
gacaucgugaugacccagagccccgauucccuggccgucucucucggcgagagagcuacaauuaacugcaagucaagucaaagcguucuuuacuccucuaauaacaaaaauuaucuggcaugguaccagcagaagccugggcagccaccgaaauuguuaauauauugggccucgacuagggaaucaggagugcccgaccggaucagcgguaguggcuccggggcggauuucacgcugaccauuucuagccuacaagcugaggacguagccguguacuauugucagcaguacuuugcaacaccucgcacuuucggacagggcaccaaggucgaaaucaaa

SEQ ID NO: 27796 - RNA, 339 nt, Artificial Sequence
  derived and/or modified sequence opt3 from anti-influenza_Chain
gacaucgugaugacccagagccccgauucccuggccgucucucucggcgagagagcuacaauuaacugcaagucaagucaaagcguucuuuacuccucuaauaacaaaucgcaccuggcaugguaucagcagaagccugggcagccaccgaaauuguuaauauacugggccucaacuagggaaagcggagugcccgaccgguucagugguuccggcucugggacggauuuuacccugaucauuagcucccuacaagcggaggacguagcuguguauuacugucagcaguauuacuucucaccucucacauuuggaggcgguacuaaggucgaaaucaaa

SEQ ID NO: 27797 - RNA, 339 nt, Artificial Sequence
  derived and/or modified sequence opt3 from anti-influenza_Chain
gacaucgugaugacccagagccccgauucccuggccgucucucucggcgagagagcuacaauuaacugcaggucaagucaaagcauauuccacaauuccaacaaugaaaacuaccuugcaugguaucagcagaagccugggcagccaccgaaacuguugaucuacugggccucuacucgggagucgggaguucccgaccgcuuuucagguagcggcagugggacggauuucaccuuaacaauuuccucucugcaagcggaagacguggcuguauauuuuugucagcaguacuauaaugccccucuaacuuucggaggcgguaccaagguggagaucaaa

SEQ ID NO: 27798 - RNA, 339 nt, Artificial Sequence
  derived and/or modified sequence opt3 from anti-influenza_Chain
gagaucgugcugacccagagcccccucucccuuccugucacaccaggcgaaccggccucuauuucaugcagaaguagccaaucccuguugcacucuaacggguacaauuauuuagacugguaccugcagaagcccggacagucgccucagcuacucauauaucuggguucaaacagggcuagcggcguuccagaucgguucaguggguccggaucuggcacugacuuuacgcuuaaaaucagccgcguggaggcagaagauguagguguguacuauuguaugcaagcccugcagacccccuugacauucgggggaggcacuaaggucgagauuaaacga

SEQ ID NO: 27799 - RNA, 339 nt, Artificial Sequence
  derived and/or modified sequence opt3 from anti-influenza_Chain
gacaucgugcugacccagcccccuagcgucuccguugccccaggccaaacagcuacuauuacgugcgggggaaacuacauagguucuaagucagugaauugguaucagcagagaccgggccacgcacccguacucguggucuacgaugacagugauaggccuagcgggaucccagaccgguucuccggaucuaacucgcgcucaaccgccacaacugcgacccuuacaauuagccgaguggaggcuggcgaugaagccgacuauuacugucagguuugggagaccagugaagaucuguggguguuuggugggggaacuaaauugacagucuuaggccaa

SEQ ID NO: 27800 - RNA, 342 nt, Artificial Sequence
  derived and/or modified sequence opt3 from anti-influenza_Chain
gacguggucaugacccagagccccgauucccuggccguuucucucggcgagagagcuacaaucaacugcaagucaagucaaagcgugcuuuacuccucuaauaacaaaaauuaucuggcaugguaccagcagaagccugggcagccaccgaaauuguuaauuuauugggccucgacuagggaaucaggaguacccgaccgguucagcgguaguggcuccgggacggauuuuacccugacaauaucuagccuacaagcggaggacguggcugucuacuauugucagcaguacuauuccacuccucucaccuucggaggcgguacaaagguggauaucaaacgc

SEQ ID NO: 27801 - RNA, 342 nt, Artificial Sequence
  derived and/or modified sequence opt3 from anti-influenza_Chain
gacauccagaugacccaaagccccgauucccuggccgugucucucggcgagaaggcuacaauuaacugcaaaucaagucagagcauacuuaauuccucuaacaauaagaacuaccuggcaugguaucagcagaaaccugggcaaccaccgaaguuguuaaucuacugggccucgacuagagaaucaggaguccccgacagguucagcgguaguggcuccgggacggauuuuacccugacaauuucuagccuacaggcggaggacguugcuguguauuacugucagcaguauuacuccucaccuccaacuuucggacaaggcaccaaaguagaaaucaagcgg

SEQ ID NO: 27802 - RNA, 342 nt, Artificial Sequence
  derived and/or modified sequence opt3 from anti-influenza_Chain
gagaucgugcugacccagagccccgccacacucucccuuuacccuggcgaaagagcuacucugucuugcagggcaucacaaagugucagccgguauuuggccugguaccagcagaagccagggcaggcgccgcgcuuacugauuuaugacgcuuccaaccgagccacgggaauacccgcacguuucucugguucgggcucagggaccgauuuuacacuaacuaucagcagucucgagccugaagacuucgccguuuacuauuguugcgauagacaacagagguccaauuggcugaaaauuaccuuuggacagggcacacggcuugagaucaaggguaccgug

SEQ ID NO: 27803 - RNA, 342 nt, Artificial Sequence
  derived and/or modified sequence opt3 from anti-influenza_Chain
gacaucgugaugacccagagccaaaaguucgucuccacaucuguuggcgauagagugucaguaacuugcaaagccagucagaacguggggagcaaugucgcuugguaccagcacaagcccggacauuccccuacggcacugauuuauucugccucgcacagguacucaggugugccagaccgguuuaccggcagcgagagugggacagauuucacucucaccauauccaacguucagucugaagaccuugcggaguauuuuugucaacaguacuauagcuacccguauacauucggaggcgguaccaaacuggaaaucaagcgcgcugaugccgcacccacu

SEQ ID NO: 27804 - RNA, 342 nt, Artificial Sequence
  derived and/or modified sequence opt3 from anti-influenza_Chain
gacaucgagaugacccagagcccccugucccucccugugacaccaggcgaaucugccucaauuaguugcagaagcucccaaucucuucugcacucgaacggguacaauuauuuggauugguacuuacagaagccgggacagucaccccagcugcuaauauaucucgguagcaguagggcuuccggcgucccugaccgguucucugggagcggauccggcacugauuuuacgcugaaaaucucacgcguugaggcagaagacguggguguauacuauuguaugcaagggcuucagaccccauacacauucggacagggcacuaagcuggagauuaaacgaacc

SEQ ID NO: 27805 - RNA, 342 nt, Artificial Sequence
  derived and/or modified sequence opt3 from anti-influenza_Chain
gacaucgagaugacccagagcccccugucccucccugugacaccaggcgaaccggccucuauuucaugcagaaguagccaaucccuucugcacucuaacggguacaaucacuuggcuugguauuuacagaagcccggaaggucgccucaucugcuaauauaccucgcaucaacucgggccagcggugucccagaucgcuucaguggcuccgggucuggaacggacuuuacccugaaaaucagccgaguugaggcggaagaugugggcauuuauuacuguaugcagucccuucagacaucaaucacuuucggucaagggacccgucuggagauuaagagaaca

SEQ ID NO: 27806 - RNA, 345 nt, Artificial Sequence
  derived and/or modified sequence opt3 from anti-influenza_Chain
caggugcaacugguccagagcggcgccgagguuaagaaacccggguccucugugagaguaucaugcaagaccaguggagguacauucagcuccuacgcugugacuugggucaggcaggcaccuggccaggggcucgaauggaugggaggcaucauugguauguuugggacgaccaacuaugcccaaaaauuccagggacggcuuacaauaacugcggacgagaugaccucuacagcuuacauggaacugucgucauugcgcagcgaggauaccgccguguauuacugugcacgaggcaguuauuacuaugaaacuacauuagacuacuggggccgugggacccug

SEQ ID NO: 27807 - RNA, 345 nt, Artificial Sequence
  derived and/or modified sequence opt3 from anti-influenza_Chain
gaggugcagcugguccaaagcggcgccgaaguuaagaaacccggguccucugugaagguaucaugcaaaaccaguggagguacauucagcuccuacgcugugacuugggucagacaggcaccuggccaggggcucgaguggaugggagccaucauuggcauguuugguacgaccaacuaugcgcagaaguuccaagggagggugacaauaacugcugacgaacuuaccucuacagccuacauggagcugucgucauugcggagcgaugacaccgcaguuuauuacugugcccgcggaaguuauuacuaugaauccucuuuagauuacuggggcaaaggcacucug

SEQ ID NO: 27808 - RNA, 345 nt, Artificial Sequence
  derived and/or modified sequence opt3 from anti-influenza_Chain
caggugcaacugguccagagcggcgccgagguuaagaaacccggguccucugugaagguaucaugcaaaaccaguggagguacauucagcuccuacgcugugacuugggucagacaggcaccuggccaggggcucgaauggaugggaggcaucauugguauguuugggacgaccaacuaugcccaaaaguuccagggaagggugacaauaacugcggacgagcuuaccucuacagcuuacauggaacugucgucauugcggagcgaggauaccgccguuuauuacugugcacgcggcaguuauuacuaugaauccucuuuagacuacuggggccgagggacucug

SEQ ID NO: 27809 - RNA, 345 nt, Artificial Sequence
  derived and/or modified sequence opt3 from anti-influenza_Chain
gaggugcagcugguccaaagcggcgccgaaguuaagaaacccggggcuuccgugaagguaucuugcaaagcaucaggauacaccuucacagguuauuacguguauugggucagacaggccccuggccaggggcucgaguggaugggauggaucagugcguacaacggcaauacuaacuaugcucagaaguuucaagguagggugacgauuaccgccgacaaaagcacauccacugcauacauggaacuuucuucgcugcggucagaggauaccgccguuuauuacugugcucgcagccgaaguuuggacgugugggggcagggaacaaccgucacuguguccucu

SEQ ID NO: 27810 - RNA, 345 nt, Artificial Sequence
  derived and/or modified sequence opt3 from anti-influenza_Chain
gacaucgugaugacccagagcccccugucccucccugucacaccaggcgagccggccucuauuucaugcagaaguagccaaucccuucugcacucuaacgggcauauauacuucgauugguauuugcagaagcccggacagucgccucaguuacugaucuaccuaguuucaaaaagggcuagcggugugccagaccgguuuaguggcuccgggucuggaacugauuucacgcucaagauuagccgcguagaagcagaggacgugggcgucuauuacuguaugcaagcccuggaaacccccuuuacauucgguccugggacuaaagugcacaucaagcgaaccguu

SEQ ID NO: 27811 - RNA, 345 nt, Artificial Sequence
  derived and/or modified sequence opt3 from anti-influenza_Chain
cagagcgcccugacccaacccgcuuccgugucuggcucaccugggcagaguaucacaauuagcugcacuggaacguccucugacgucggugcauacaacuauguuucgugguaccagcaccauccaggcaaggccccgaaacucaugauauaugaugugaccuacagacccucagggguaagcacaagguucaguggauccaagucuggcaauacugcgagccuuaccaucuccggucugcaggcugaggacgaagccgauuauuacuguucaagucaaagccggucuuccacauuggugauuuuugggggaggcaccaaauuaacuguccugggccagccuaag

SEQ ID NO: 27812 - RNA, 345 nt, Artificial Sequence
  derived and/or modified sequence opt3 from anti-influenza_Chain
gacaucgugcugacccagagccccgucucccucgccguuucucuuggcgagucagcuacagugaacugcaagaguagccaauccguacugucuaauucgaaaaacuugaauuacuuagcaugguaucagcacaagccugggcagccaccgaaacugcuaauuuacugggccucaacuagagaaagcggagugcccgauagguucagugguuccggcucugggacggacuuuacccucacaauaagcucccugcaggcggaggaugucgcuguguauuacugucaacagcauuauucaaucccucuuacuuucggaccaggcaccaagguugacauuaaacggaca

SEQ ID NO: 27813 - RNA, 348 nt, Artificial Sequence
  derived and/or modified sequence opt3 from anti-influenza_Chain
gacaucgugcugacccagagcccccucucccuuccugucacaccaggcgagccggccucuauuucaugcagaaguagccaaucccuguuggauucuaacggguacaauuauuuagacugguaccugcagaagcccggacagucgccucagcuacucauauaucuggcuucauacagggcaccagguguucccgaucgguucagcggcaguggguccggaacugacuuuacgcuuaaaaucucucgcguggaagccgaggauguaggccuguauuacuguaugcaagcguugcagaccccuccaauguauacauucggucaggggacuaagcucgaaauuaaacgaacc

SEQ ID NO: 27814 - RNA, 351 nt, Artificial Sequence
  derived and/or modified sequence opt3 from anti-influenza_Chain
cuggagagcggcgggggacucgugcagcccgguggcucccuuagacugucuugcgccgcuucagggaucaccuucaguagcuacgcaauguccugggucaggcaagccccuggaaagggcuuggaauggguuucuacagugaacucgggugggggaucaacuuauuacggcgacagcguacggggccgcuuuacgauuagucgagauaauuccaaaucuaccuuauaucugcagcuaaacagccuccgugcggaggacacagcuauauacuauugugccaaggauaaagggagaccaaucuucggacuggugacuccguccuacuauauggacgucugggguaauggcacc

SEQ ID NO: 27815 - RNA, 351 nt, Artificial Sequence
  derived and/or modified sequence opt3 from anti-influenza_Chain
caggagcaacuggugcagagcggcgccgaagucaagaaacccggggcuuccguuaaggugucuugcaaagcaucaagaaagaguuucaucggauacuauguacacugggugaggcaggccccuggucagggccucgaguggaugggguggauuagcccagacuccgaugcgaccaaauacgcucaaaaguuucagggaucugucauaaugacacgggacacuucggugucaacgguuuauauggaacuuagccgccugaccagugaugacacagccuuguacuauuguuuacuguuccgaggcgguaacucccuaucuugggggcagggaacucucgugaccgucagcucc

SEQ ID NO: 27816 - RNA, 351 nt, Artificial Sequence
  derived and/or modified sequence opt3 from anti-influenza_Chain
caggugcaacugcaggagagcggccccgggcucgucaagccuuccgaaacccuuucucugacaugcacuguuucaggaaguagcaucuccaacuacuauuggucuuggauuagacagucgccagguaaaggcuuggaguggauaggguucaucuacuauggaggcaauacgaaguacaacccgucauuaaaaagcagggugaccauuagucaggacacauccaagucucaaguaagccugacuauguccucagugaccgccgcugaaagugcagucuauuuuugugcccgggcgagcugcucugguggguacuguauccuagauuauuggggacagggcacacucgugacc

SEQ ID NO: 27817 - RNA, 351 nt, Artificial Sequence
  derived and/or modified sequence opt3 from anti-influenza_Chain
gaggugcagcuggucgaaagcggcgggggacucguucaacccgguggcucccuuagacugucuugcgccgcuucaggguucaccuuuaguaucuacgcaaugagcugggugaggcaggccccuggaaagggcuuggaguggguauccgcgauuucuucgucaggugacagcacauauuacgcugauagugugaaagggcgguucacuauaucccgcgacaacgcccgaaauacguuauaucugcagaugaacucucuacgugcagaagauaccgccgucuacuauugugcuagagcauacggauauacauuugacccauggggccagggcacucucgugaccguuagcucc

SEQ ID NO: 27818 - RNA, 354 nt, Artificial Sequence
  derived and/or modified sequence opt3 from anti-influenza_Chain
caggugcaacugcaggagagcggccccgggcucgucaagccuuccgaaacccuuucucugacaugcacuguuucaggauacaguuucgacagcgguuauuacuggggcugguugagacagccaccggggaaaggauuagaguggaucggcuccauuuaucacucuaggaacacguacuauaaucccucgcugaagucacgggugaccauaagcguagauacaaguaaaaaccaguuuucccuacaacucucuagcgugacugccgcugacaccgcagucuacuauugugcccgcgguacaugguacuccucaaaucugcgauacugguucgauccuugggggaagggaacccuu

SEQ ID NO: 27819 - RNA, 354 nt, Artificial Sequence
  derived and/or modified sequence opt3 from anti-influenza_Chain
cagcccgugcugacccaaccuccaagcgccuccgcuucucucggcgcaucagucacacuuacuugcacgcugaguagcgccuacuccaacuauaagguugacugguaccagcagagaccggggaaaggacccagguucgugaugcggguagguaccggcgggaucgugggaucuaagggcgaugguauuccugaccgcuuuucggucuuggggucaggauuaaaucgauaucugacaaucaaaaacauacaggaggaagaugagagcgacuaccacuguggcgcggaucauggcaguggguccaauuucgugucuccauauguuuuuggagguggcacuaagcuaaccgugcuc

SEQ ID NO: 27820 - RNA, 354 nt, Artificial Sequence
  derived and/or modified sequence opt3 from anti-influenza_Chain
caggugcaacugguccagagcggcgccgacguuaagaaacccggguccucugugaccguaucaugcaaggcuaguggagguagcuucuccaacuacggcaucaauugggugagacaggcaccugggcagggacucgaguggaugggcgguauuauaccacuuaucaacgccccgaauuaugcgcccaaauuucaagggagggucacaauuacugcugauauguucucuaacaucgugucgcugcaguugacgucauuacggaccgacgauacagccguuuacuauugugcacgccgaaagaugacuaccgccauugacuacuggggacagggcacacuggugaccgucagcagu

SEQ ID NO: 27821 - RNA, 354 nt, Artificial Sequence
  derived and/or modified sequence opt3 from anti-influenza_Chain
caggugcaacugguccagagcggcgccgagguuaagaaacccggguccucugugaagguaucaugcagagaaaguggagguaccuucaacggcuacacaaucacuugggugaggcaggcuccugggcagggacucgaguggaugggcgguauuauaccaaugauggggacggucaauuaugcacaaaaacuucagggacgggugaccaucacaacugacuacuuuaccaagacagccuauauggaucugaacaauuugcgcagcgaagacaccgcgauguacuauuguguuaaaauucgauacacuggccagcaguuacuguggggccaagggacccuagugacagucuccucu

SEQ ID NO: 27822 - RNA, 354 nt, Artificial Sequence
  derived and/or modified sequence opt3 from anti-influenza_Chain
caggugcaacugguccagagcggcgccgagguuaagaaacccggggcuuccgugaagguaucuugcaaagcaucaggacacaccuucacagguuacuauauccauugggugagacaggccccuggccaggggcucgaauggaugggauggauuaacccagacaguggcgcgacuagcuccgcucaaaauuuucaggguagggucacgaugaccggggauacaucuucgucaacugccuacauggagcuuagccggcugaguuucgacgauaccgcaguguauuacugugcccgcguuuuguuuacauccccguucgacuuuuggggagaaggcaccuuagugacugucucuagc

SEQ ID NO: 27823 - RNA, 354 nt, Artificial Sequence
  derived and/or modified sequence opt3 from anti-influenza_Chain
cagcccgugcugagccaaccuccauccgccucugcuucacucggcgcaagugucacccuuacaugcacucugagcuccggguucgacaacuaccagguugccugguaucagcagagaccgggaaagggucccagguuugugaugcggguaggcaaugggggaaacguggcgucuaaaggcgaugguaucccugaccgcuucucggucucagggagcggauugaaucgauacuuaacgauuaagaacauacaagaggaugacgaaagugauuauuacuguggcgcugaccacggcuccgggaauaacuuugugucuccauauguuuucggagguggcaccaaacugacagugcua

SEQ ID NO: 27824 - RNA, 354 nt, Artificial Sequence
  derived and/or modified sequence opt3 from anti-influenza_Chain
gaggugcagcuggucgaaagcggcgccgagguuaagaaacccggggcuuccgugaagguaucuugcaaagcaucaggauacaccuucaguagauauuacauccacugggugaggcaagccccuggucaggaacucgaguggaugggcuggauuaacccagacagcggggauacaaauuaugcgcagaaguuucggggacgcgucacuauggcucgagacacguccauaucuaccguguacauggaacuuaacucgcugcguuaugaugacacagccguuuacuucugugcaagaaucauuuggucaagcaguggcauggauguguggggucaggggacuaccgucacagugucc

SEQ ID NO: 27825 - RNA, 354 nt, Artificial Sequence
  derived and/or modified sequence opt3 from anti-influenza_Chain
gaggugcagcugcucgaaagcggcgggggagucguucaacccgguagaucccuuaggcugucuugcgccgcuucaggcuucaccuuucggacauacgggaugcacugggugcgccaggcaccuggaaagggcuuggaguggguagccgugaucagucaugacgguaauuuaaaauauuacgggggaagcgucaagggccgauucacuauuucccgugauaauucuaaaaacgcgcuguaucuacagaugaacucgcucagaguggacgauacggcucuguacuauugugccaggggcauagggaucaccgacgcauuugauauucggggacaggguacaaugguuguggucuca

SEQ ID NO: 27826 - RNA, 354 nt, Artificial Sequence
  derived and/or modified sequence opt3 from anti-influenza_Chain
gaggugcagcuggucgaaagcggcgggggacucguucaacccgguggcucccuuagacugucuugcaccgccucaggguugagugugagcuccacauacaugaacuggguaaggcaggcuccuggaaagggcuuagagugggugucugucuucuauucggaaacucggacguacuaugcagacucagugaaaggucgcuuuaccguuagccgacacaauaguaacaauacacuguaccuacagaugaacucccuccguguggaggauacugccgucuauuacugugcgagagugcagaggcugucuuaugggauggacguauggggacaaggcaccacaguuaccgugagcucc

SEQ ID NO: 27827 - RNA, 354 nt, Artificial Sequence
  derived and/or modified sequence opt3 from anti-influenza_Chain
gaggugcagcuggucgaaagcggcgggggacucguucaacccgguggcucccuuagacugucuugcaccgccucaggguugagugugagcuccacauacaugaacuggguaaggcaggcuccuggaaagggcuuagagugggugucugucuucuauucggaaacucggacguacuaugcagacucagugaaaggucgcuuuaccguuagccgacacaauaguaacaauacacuguaccuacagaugaacucccuccgugccgaggauacugcgguguauuacugugcuagaguccagaggcugucuuaugggauggacguguggggacaaggcaccacaguaaccguuagcucc

SEQ ID NO: 27828 - RNA, 354 nt, Artificial Sequence
  derived and/or modified sequence opt3 from anti-influenza_Chain
gacaugcagcugguggagagcggcgggggacucguucccccugguggcucccuuagacugucuugcgccgcuucaggguucagugucagcgauaauuacaucaauugggugaggcaagcaccaggaaagggcuuggacuggguauccguguuuuauucugccgaucggaccucguacgcggacucagucaaaggucgcuucacagugagcagucacgauuccaagaacacuguuuauuuacagaugaacucucugcgagcugaagacacggccguguacuauugugcacguguccagaaaagcuacuaugggauggauguguggggacagggcaccacaguaacuguuuccuca

SEQ ID NO: 27829 - RNA, 357 nt, Artificial Sequence
  derived and/or modified sequence opt3 from anti-influenza_Chain
gaggugcagcuggucgaaagcggccccguucucgugaagccuaccgagacacuuacuguaacgugcaccguguccggguucucugucgacaacgauagaaugggagugucauggaucaggcaaccaccggguaaagcccuggaaugguuggcucacauuuuuaguaaugacgaaaagagcuacuccacaucuuuacggucgcgccugacuauaucaaaagauaccagcaagcgacagguugugcuaaguaugacagacauggaucccgucgacaccgcaacuuauuacugugcccgugcgccuuccgaguaugcugccauggauguguggggccaggggacaaugguaaccguuucu

SEQ ID NO: 27830 - RNA, 357 nt, Artificial Sequence
  derived and/or modified sequence opt3 from anti-influenza_Chain
caggugcaagucguucagagcggcaccgaggugaagaaacccggguccucuguaaaggugucaugccagacaaguggagguagauucaugagcuacgccaucacuugggucaggcaggcuccuggccaagggcuggaauggaugggaggcauugugccaguuuuugguacggcaaacuaugcccagaaauuccaggggcgggugaccauaacaacugacgauuccacccgcacagcguacauggagcucucuucgcuucgaucagaagacaccgcugucuauuacuguggauuucguuauggcagcggcuacggguucgauaguuggggacaggguacucuggugacaguauccucu

SEQ ID NO: 27831 - RNA, 357 nt, Artificial Sequence
  derived and/or modified sequence opt3 from anti-influenza_Chain
gaggugcagcuggucgaaagcggcgccgggguuaagaaacccggauccucugugaagguaucaugcaaagcuagugguaacaccuucagcuccaaugcaaucucuugggugagacaagccccuggccaggggcucgaguggaugggaggcauucuugguaugcugaggacaacuaacuacgcgcagaaguuucaggggcgggucacgauaaccgcugacgaguucaugaauacagccuauauggaauugucgucauuaacuagcgaagauaccgcaguguacuauugugcccgcaguuccggauacuauccagacuacuuucaccuguggggccaaggcacccuaguuacagugucu

SEQ ID NO: 27832 - RNA, 357 nt, Artificial Sequence
  derived and/or modified sequence opt3 from anti-influenza_Chain
caggugcaacugcaggagagcggccccgggcucgucaagccuuccgaaacccuuucucugacaugcacuguuucaggaaguagcaucuccaacuacuauuggucuuggauuagacagucgccagguaaaggcuuggaguggauaggguucaucuacuauggaggcaauacgaaguacaacccgucauuaaaaagcagggugaccauuagucaggacacauccaagucucaaguaagccugacuauguccucagugaccgccgcugaaagugcagucuauuuuugugcccgggcgagcugcucugguggguacuguauccuagauuauuggggacagggcacacucgugaccguuucc

SEQ ID NO: 27833 - RNA, 357 nt, Artificial Sequence
  derived and/or modified sequence opt3 from anti-influenza_Chain
gaggugcagcuggucgaaagcggcgggggacucguucaacccgguggcucccuuagaaucucuugcgccgcuucaggguucaccgugaguagcaacuacauguccuggguaaggcaggcaccuggaaagggccuggagugggugucugucauuuauucgggugggucaacauacuaugccgacagcgugaaaggacgguuuaguuucucccgcgauaauucuaagaacacuguguuuuugcagaugaauagcuuacgagcggaagacacggcuguuuacuauugugcccguugccuguccagaaugaggggcuacggccuagaugucugggggcagggaaccacagugacuguauca

SEQ ID NO: 27834 - RNA, 357 nt, Artificial Sequence
  derived and/or modified sequence opt3 from anti-influenza_Chain
caggugcaacugcaggagagcggccccgggcucgucaagccuuccgaaacccuuucucugacaugcacuguuucaggagccaguaucagcuccgacuacuggucuuggauuagauugccaccggguaaaggcuuagaguggauaggguauaucuacaacaggggaucgacgaaguauacccccucacugaaaagccgggugacaauuagucuagauacugcugaaaaucaguucucccuccgccugcgaucuguaaccgcagccgacacagcgaucuacuauugugcucgucacgugggcggucauaccuacgggauugauuauuggggacagggcacucuugucacagugagcucc

SEQ ID NO: 27835 - RNA, 357 nt, Artificial Sequence
  derived and/or modified sequence opt3 from anti-influenza_Chain
caggugcaacugcaggagagcggccccgggcucgucaagccuuccgaaacccuuucucugacaugcacuguuucaggagccaguaucagcuccgacuacuggucuuggauuagauugccaccggguaaaggcuuagaguggauaggguauaucuacaacaggggaucgacgaaguauacccccucacugaaaagccgggugacaauuagucuagauacugcugaaaaucaguucucccuccgccugcgaucuguaaccgcagccgacacagcgguguacuauugugcucgucacgucggcggucauaccuacgggaucgauuauuggggacagggcacucuugugacaguuagcucc

SEQ ID NO: 27836 - RNA, 357 nt, Artificial Sequence
  derived and/or modified sequence opt3 from anti-influenza_Chain
caggugcaacugcaggagagcggccccagacucgucaagccuuccgaaucucuuucacugaccugcacaguuagugggggaagcaucuccaacucuuucugggguuggauuaggcagccaccgggcgagggguuggaauggauaggauacguguauaauucgggcaacacuaaauacaaucccucauuaaagagccggguaacgaucagucgcgacaccuccaaaucucagcuguauaugaagcuacgaagcgugacagccgcugauacugcagucuacuauugugcccgucacgacgaugcgucccaugguuacucaauuaguugggggcacggaacccucgugacaguuagcucu

SEQ ID NO: 27837 - RNA, 357 nt, Artificial Sequence
  derived and/or modified sequence opt3 from anti-influenza_Chain
gaggugcaccuccagcaaagcggccccgaacuggucaagccuggggccuccguuaaaaugucuugcgaggcuucaggauacaccuucacagacuauuacguggcauggguaaagcagaguccaggugagagcuuugaauggaucggcagagugaacccguauuccgggggaacuucuuacaaucagaaauucaagggcaaagccacgcuuauugucgauaagucgucaagcaccgcguauauggaacugaguuccuugacaucugaggacagcgcuguguacuauugugccaggugggauuacgguguuuacgagggguauauagacuacuggggacagggcuccgcauuaacugug

SEQ ID NO: 27838 - RNA, 360 nt, Artificial Sequence
  derived and/or modified sequence opt3 from anti-influenza_Chain
caggugcaacugguccagcccggcgccgagguuaagaaaccugggagcuccgugaagguaucuugcaaggcuucaggagguaucuucaguccauacgcaauuagcugggugagacaggccccgggccaggggcucgaauggaugggaggcauaaucgcgauuuuugguaccacaaauuaugcucaaaaauuccaggggagggucacuaucacggccgacaaauccaccacaacugcauaccuugagcugaacucuuugcgguuugaagauaccgccguguauuacugugcucgcggaggccgauauuacguugacuauuucgauuacuggggccaggggacauuagugucggucucaagc

SEQ ID NO: 27839 - RNA, 360 nt, Artificial Sequence
  derived and/or modified sequence opt3 from anti-influenza_Chain
caggugcaacugcaggagagcggccccgaccucgucaagccuggggccuccguuaaaaugucuugcaaggcuucaggauacaguuucaccuauuaccacaugcauugggugaaacagacacacgguaagagccuugaauggaucggcaggauuccauauaacgggggaacuaauuacucccagagauuuaaaggcaaggcaguauucacgguggauaugucuucgucaaccgccuauauggagcugcggagcuugacaagugaagacuccgcggucuacuauugugcucgcgaugccaacuacgagggugacugguacuuugaugugugggggcaaggaacuaccguuacagugucuagc

SEQ ID NO: 27840 - RNA, 360 nt, Artificial Sequence
  derived and/or modified sequence opt3 from anti-influenza_Chain
caggugcaacugguccagagcggcgccgagguuaaggaacccggguccgcuaugaaagugucuugcaaggcaucaggagguaccuucaguagcgacgccuuuuguuggguaagacaggcgccuggcagggggcucgaguggaugggaggcaucauuccaguguuccagacagcuaacuacgguccgaauuuucaagggcgggucacuauauccgccgauguguauacgaccacacuuuaccuggaauugucuggauuaacuucggaggacaccgcaguuuauuucugcgcccgcucaggcgauggcuacaacuauuacuuuccccugugggggcagggaacccuagugacagucagcagu

SEQ ID NO: 27841 - RNA, 360 nt, Artificial Sequence
  derived and/or modified sequence opt3 from anti-influenza_Chain
cagaucacccugagagagagcggccccacacucgugaagccuacucaaacgcuuacccugacaugcacuuucuccggguuuucuuugucaaccaacggagucaauguugguuggauuaggcagccaccgggcaaagccuuagaauggcuggcucuaauauacugggacgaugacaagcgguauagucccagccucaaacgccgacugacaaucaccaaggauacuuccaaaaaccaggugguacuuacacugaccaauauggacccuguggauacggcaacuuacuauugugcccaccguccagacuucuacggggauuuugaguauuggggacccggcaccuuggucacagugucuucg

SEQ ID NO: 27842 - RNA, 360 nt, Artificial Sequence
  derived and/or modified sequence opt3 from anti-influenza_Chain
caggugcaacugguccagagcggcuccgagguuaagaaacccgggaccucugugaagguaucaugcacagccaguggaagcguguucacuaacuacgguaucuccugggucagacaggcuccuggccaggggcucgaauggaugggaggcauuauaccacuuuuuggugcagccaaauaugcgcaaaaguuccaggggagggugacgaucaccgcugacgagucuacaaaaacuguuuacauggaacugucgcgguugaccucaaaggauacagccauuuauuuuugugcaaaggccccgcgcguguacgaguauuacuucgaccaguggggacagggcacccccgucacugugagcagu

SEQ ID NO: 27843 - RNA, 360 nt, Artificial Sequence
  derived and/or modified sequence opt3 from anti-influenza_Chain
caggugcaacugguccagagcggcgccgaccucaagaaacccggggcuuccguuaaggugucuugcaaagcaucaggauacaccuucacagauuauuacauccacuggguaagacaggccccuggucagggccuugaguggaugggguggauuaacccagaaaguggagacacuaaguaugcgcaaaaauuucagggcagggugacgaugacccgggauacaagcauaacuaccgcuuacauggagcugggucgcuugcgauccgacgauacagccgucuauuacugugcacgugacgugucuaccacuuggucgugguucgccccgugggggcagggaacauuaguuaccgugucaagc

SEQ ID NO: 27844 - RNA, 360 nt, Artificial Sequence
  derived and/or modified sequence opt3 from anti-influenza_Chain
caggugcaacugcaggagagcggccccgggcucgucaagccuuccgaaacccuuucucugacaugcucaguuaguggagguagcaucaacuacuauuacugguccuggauuagacagccaccgggcaaaggguuggaguguauaggauauaucucugacacuggcaggacguacuauaaucccucguuacggucacgcgugaccauuagcguagauacaaguaagaaccaguucucccugaaucuaacuucuaugaccgccgcugacacagcaguguacuauugcgcccgagauccuaccgguagccgucagaaaaacgcguuugacaugugggggcaaggaacuauggucacagugucc

SEQ ID NO: 27845 - RNA, 360 nt, Artificial Sequence
  derived and/or modified sequence opt3 from anti-influenza_Chain
caggugcaacugcaggagagcggccccagagucguuaggccuuccgaaacccucucucuuacaugcacugugucagggggaaguaucagcuccuacaacuggauuuggauacggcagccaccggguaagggccuggaguggaucgggcacauuuaugacuacggacgcacguucuauaauucuucguugcagucacgacccaccaucagcguagaugccaguaaaaaccaauuaucccugcgucuaacaucugugacugcuagcgacaccgcagucuacuauugugccagaccucucggcauucugcauuacuaugcgauggaucuuuggggucaggggacaaccgugacuguuuccuca

SEQ ID NO: 27846 - RNA, 360 nt, Artificial Sequence
  derived and/or modified sequence opt3 from anti-influenza_Chain
caggugcaacugcaggagagcggccccgggcucgucaagccuuccgaaacccuuucucugacaugcucaguuaguggagguagcaucuccucugacuucuggucguggauuagacagccaccgggcaaaggguuggaguggauaggauacguguauaacaggggcucaacuaaguacagccccaguuuaaaaucccggguaacgaucucugccgauaugagcaagaaucaguuuucccugaacaugucaagugugaccgcugcagacacagccgucuauuacugugcgaaaaauggucgcagcucuacuuccugggggauugauguguggggaaagggcaccacaguuaccgugucaagc

SEQ ID NO: 27847 - RNA, 360 nt, Artificial Sequence
  derived and/or modified sequence opt3 from anti-influenza_Chain
caggugcaacugcaggagagcggccccgggcucgucaagccuuccgaaacccuuucucugacaugcacuguuucaggagguaguaucagcgccuaccacugguccuggauuagacagccaccgggcaaaggguuggaguggauaggacauaucuucgacucuggcucgacguauuacaaccccucauuaaagagcagggugaccauuagucuggaugcuuccaaaaaucagcuaucucuccggcugacaagcguaacugcauccgacaccgccaucuauuacugugcgcgcccucuugguucacgauauuacuaugggauggauguguggggacaaggcacaaccgucacugugaguagc

SEQ ID NO: 27848 - RNA, 360 nt, Artificial Sequence
  derived and/or modified sequence opt3 from anti-influenza_Chain
gaggugcagcuggucgaaagcggcgggggacucguucaacccgguggcucccuuagaaucucuugcgccgcuucaggguucaccgugaguagcaacuacauguccuggguaaggcaggcaccuggaaagggccuggagugggugucugucauuuauucgggugggucaacauacuaugccgacagcgugaaaggacgguuuaguuucucccgcgauaauucuaagaacacuguguuuuugcagaugaauagcuuacgagcggaagacacggcuguuuacuauugugcccguugccuguccagaaugaggggcuacggccuagaugucugggggcagggaaccacagugacuguaucaagu

SEQ ID NO: 27849 - RNA, 360 nt, Artificial Sequence
  derived and/or modified sequence opt3 from anti-influenza_Chain
caggugcaacugcaggagagcggccccgggcucgucaagccuuccgaaacccuuucucugacaugcacuguuucaggaaguagcaucuccaacuacuauuggucuuggauuagacagucgccagguaaaggcuuggaguggauaggguucaucuacuauggaggcaauacgaaguacaacccgucauuaaaaagcagggugaccauuagucaggacacauccaagucucaaguaagccugacuauguccucagugaccgccgcugaaagugcagucuauuuuugugcccgggcgagcugcucugguggguacuguauccuagauuauuggggacagggcacacucgugaccguuuccuca

SEQ ID NO: 27850 - RNA, 360 nt, Artificial Sequence
  derived and/or modified sequence opt3 from anti-influenza_Chain
caggugcaacugcagcagagcggcgccgaggucaagaaacccggguccucuguuaaggugucaugcaaaguaaguggagugaucuucagcgguuccgcuauuucuugggucagacaggcaccuggccaagggcucgaauggaugggaggcauaucgccacuuuuugguaccacaaacuacgcccagaaguuccaggggagggugacuaucacggcggaccagucaaccaauacaacuuauauggagguuaacagccugcgguacgaagauaccgcuguguauuuuugugcccgcggaccgaaauacuauagugaguacauggacgucuggggcaagggcacaaccgugacuguauccucu

SEQ ID NO: 27851 - RNA, 360 nt, Artificial Sequence
  derived and/or modified sequence opt3 from anti-influenza_Chain
caggugcaacugguccagagcggcgccgagguuaagaaacccggguccucugugaagguaucaugcaaagcuaguggagguaccuucagcuccuacgcaaucucuugggugagacaggccccuggccaggggcucgaauggaugggaggcauuauggguauguuugggacaacuaacuaugcgcaaaaguuccagggaagggucacgauaaccgcugacgaguuuacaucggccgcauacauggaacuucggucacugcgcagcgaggauacugccguguauuacugugcucgaaguuccggcuauuacccagaauauuuccaggacuggggccaggggaccuugguuacagugucuagc

SEQ ID NO: 27852 - RNA, 360 nt, Artificial Sequence
  derived and/or modified sequence opt3 from anti-influenza_Chain
cagaugcaacuggugcagagcggcgccgaggucaagaaacccggguccucuguuaaggugucaugcaaagcuaguggagguaccuucagcuccuacgcaaucacauggguaagacaggccccuggccaggggcucgaauggaugggaggcauuauagguauguuugggucuacuaacuaugcgcaaaauuuccagggaagggugacgaucaccgcugacgagucgacaucaacugccuacauggaacuuagcagucugcgguccgaggauaccgcagucuauuacugugcccgcucuacaggcuauuacccagcuuauuugcaccauuggggccaggggaccuuagugacuguuagcucc

SEQ ID NO: 27853 - RNA, 360 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguaccuucagcuccuacggcaucucuugggugagacaagcaccugggcagggacucgaauggaugggcgacauuauagguauguuugggucgacaaacuaugcccagaauuuccagggaaggcuuacuaucacggcggaugagucaaccagcacagcuuacauggaacugaguuccuugcggucugaggacacugccgucuauuacugugcacgcagcuccggcuauuacccagccuauuuaccgcacuggggccaagggacccuggugacaguuucaagu

SEQ ID NO: 27854 - RNA, 360 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguaccuucagcuccuacgcaaucucuugggugagacaagccccuggccaggggcucgaauggaugggaggcauuauagguauguuugggacagcgaacuaugcucagaaguuccagggaagggucacuaucacggccgacgaguuuaccucgacagcauacauggaacuuucaagccugcggagugaggauacugccguguauuacugugcucgcggcaauuauuacuaugaguccucuuuggacuacuggggccaagggaccuuaguuacagugagcucc

SEQ ID NO: 27855 - RNA, 360 nt, Artificial Sequence
  derived and/or modified sequence opt3 from anti-influenza_Chain
caggugcaacugguccagagcggcgccgagguuaagaaacccggguccucugugaagguaucaugcaaagcuaguggagguccuuucagaaacuuugcaaucaauugggugaggcaggccccaggccaggggcucgaauggaugggaggcauuauagcggucuucgguaccacaaaguacgcucacaaauuucaagggcgggugacuaucacggccgacgauagcaccaacacagcauauauggagcuuggaucccugaagucugaagacacugccguuuacuauugugcucgcggcccgcauuacuauucgucauacauggauguguggggcgaggggaccacagucaccgugagcagu

SEQ ID NO: 27856 - RNA, 360 nt, Artificial Sequence
  derived and/or modified sequence opt3 from anti-influenza_Chain
gagguggcccuggucgaaaccggcgcugagguuaagaaacccgggagcuccgugaagguaccuugcaaaucuucaggaaguccauucagaagcaacgcaguguccugggucaggcaggccccgggucaaggccucgaauggguugggggaauccuuggcguguuugguucucccucguacgcgcagaaguuccaggggcgggugacaauuacugcugacgagucaacgaauaccguccacauggaacugcgcggauugcgaagcgaggauacagccguguauuacugugcacguggcccuacuuauuacuauaguuacauggacguauggggcaaagggaccacaguuaccguguccucu

SEQ ID NO: 27857 - RNA, 360 nt, Artificial Sequence
  derived and/or modified sequence opt3 from anti-influenza_Chain
cagaugcaacuggugcagagcggcgccgaggucaagaaacccggguccucuguuaaggugucaugcaaagcuaguggagguaccuucagcuccuacgcaaucucuuggguaagacaggccccuggccaggggcucgaauggaugggaggcauuuuugguauguucgggacagcgaacuaugcucaaaaguuucagggaagggugacuauaacggccgacgaguucaccucggcagccuacauggaacuuucaagccugggcagugaggauacagcuauguauuacugugcacgguccucuggcuauuacccacaguauuuucaggacugggggcaaggaacuuuggucaccgugagcucc

SEQ ID NO: 27858 - RNA, 360 nt, Artificial Sequence
  derived and/or modified sequence opt3 from anti-influenza_Chain
caggugcaacugguccagagcggcgccgagguuaagaaacccggguccucugugaagguaucaugcaaagcuaguggagugaccuucagcuacuaugcaauguccugggucagacaggccccuggucagggccucgaauggaugggagggaucucuccaauguuuggcacaacuacguacgcgcaaaaguuccaggguagggugaccauuacagcugacgauucgacuucaaccgccuauauggagguucggagccuucgcagugaagacacagcaguguacuauugugcccgauccucuaacuacuaugauagcgucuacgacuacugggggcagggaacccuggugacuguauccuca

SEQ ID NO: 27859 - RNA, 360 nt, Artificial Sequence
  derived and/or modified sequence opt3 from anti-influenza_Chain
gaggugcagcuggucgaaaccggcgccgagguuaagaaacccgggagcuccgugaagguaccuugcaaaucuucaggaaguccauucagaagcaacgcuguguccugggucaggcaagcaccgggucagggccucgaauggguugggggaauccuuggcguguuugguucucccucguacgcccagaaguuccaggggcgggugacaauuacugcggacgagucaacgaauaccguccacauggaacugcgcggauugcgaagcgaggauacagcuguguauuacugugcccguggcccuacuuauuacuauaguuacauggacguauggggcaaagggaccacaguuaccguguccucu

SEQ ID NO: 27860 - RNA, 360 nt, Artificial Sequence
  derived and/or modified sequence opt3 from anti-influenza_Chain
caggugcaccugguccaaagcggcgccgagguuagaaagcccggggcuuccgugaaaguaucuugcaaggugucaggauacacccucaacgaacuuaguauccauuggcugaggcaggcaccuggucggggcuuggaguggauggggagcuucgacccagaagauggagagacaauuuaugcccagaaauuucagggccgcgucacuaugacgggugacaccuccacagauacugcguacuuagaacugaccucucuacgaucggaggacacagcucucuauuacugugcccguggguggggagcagugaccucaccguucgauuuuuggggccaaggcacucugguuacagugagcagu

SEQ ID NO: 27861 - RNA, 360 nt, Artificial Sequence
  derived and/or modified sequence opt3 from anti-influenza_Chain
gaggugcagcugguccaaagcggcgccgaaguuaagaaacccggguccucuaugaaggugucaugcaaagcuaguggaagcaucuucuccaacuacgguauuucuuggguaagacaggcaccuggccaggggcucgaguggaugggaggcauaaucccaauuuuuggugccgcgaauuaugcucagaaguuccaagggagggugaccaucacagccgacgaaucgacuucaacggucuacauggaggugcggagccuucgcagugaagauaccgcaguuuauuacugugcccgacgucagcagcuguauaaaggauacuaucaccauuggggccagggcacauuggugacugucuccucu

SEQ ID NO: 27862 - RNA, 360 nt, Artificial Sequence
  derived and/or modified sequence opt3 from anti-influenza_Chain
caggugcaacugguccagagcggcgccgggguuaagaaacccggauccucuaugaaggugucaugcaaagcuagugguagcaucuucuccaacuacggcauuucuuggguaagacaggcaccugggcagggacucgaguggaugggcgguauaaucccaauuuuuggggccgcgaauuaugcucaaaaguuccagggaagggugaccaucacagccgacgaaucgacuucaacggucuacauggaggugcggagccuucgcagugaagauaccgcaguuuauuacugugcccgacgucagcagcuguauaaaggcuacuaucaccauuggggccaagggacauuggugacugucuccucu

SEQ ID NO: 27863 - RNA, 360 nt, Artificial Sequence
  derived and/or modified sequence opt3 from anti-influenza_Chain
caggugcaacugcaggagagcggccccgggcucgucaagccuuccgaaacccuuucucugacaugcacuguuucaggagguuugaucggcacggggaguuacuauuggggauggauuagacagaccccaggcaaagguauggaguggauagggagcaucuccuacucuggaucgacauauuaccacccgucauuaaagagcagggugacuauuagugacgauaccuccaaaaaccagcuguuccuaaagcuccggucuguaacagccgcugacaccgcacaauauuacugugcccgcuauaauuggggcauccgauacuuugauuucuggggccgugggacucuggugacagucagcucc

SEQ ID NO: 27864 - RNA, 360 nt, Artificial Sequence
  derived and/or modified sequence opt3 from anti-influenza_Chain
caggugcaacugguccagagcggcgccgagguuagaaagcccggguccucugugaaaguaucaugcaaggugaguggagguaucauuaggaaauacgcuauaaacuggguccggcaggcaccuggccaggggcucgaauggaugggaggcaucauugccaucuucaauaccgcgaacuaugcucaaaaguuucagggucgcgugacaauuacugccgacgagagcacguccaccguuuacauggaacuuucuucgcugcgaucagaggauacagcauuguauuacugugcccgugggaugaauuauuacagcgacuauuucgauuacuggggacagggcaguuuagugacugucucccca

SEQ ID NO: 27865 - RNA, 360 nt, Artificial Sequence
  derived and/or modified sequence opt3 from anti-influenza_Chain
caggugcaacugguccagagcggcgggggaguugugcagcccgguagaucccucaggcuuucuugcgccgcuucaggcuucaccuuucggagucacgcaaugcauuggguacgccaggccccugggaagggaccagaguggguggcgcugaucagcuacgacgaagucaacaaauucuaugcugauuccgugaagggccgauuuacaauuucucgugacguuucgaaaaauacuguguucuugcaaaugaacucauuaagcgccgaugacacggcagucuacuauugugccagaggucacaguggguccuacaggcuguuugauuucuggggacagggcacccuagugacaguaucuagc

SEQ ID NO: 27866 - RNA, 360 nt, Artificial Sequence
  derived and/or modified sequence opt3 from anti-influenza_Chain
caggugcaacuggucgagagcggcgggggacucguucagcccgguggcucccuuagacugucuugcgccgcuucaggguucaucuuuggagacuucgcaauucacugggugaggcaggccaguggcaaggguuuggaauggguagcgcggauacgcagcggguuaaaccgauuugagaccgcuuacgccgcauccguggaaggacgucugacaaucucuagagaugacucgaaaucaauggccuaucuacagaugaauaacgucaaggcugaggauacugcaguguaccucuguacguaucugguuggcgccgugggcuuccaacauugggggcagggaacccuugucacagugagcagu

SEQ ID NO: 27867 - RNA, 360 nt, Artificial Sequence
  derived and/or modified sequence opt3 from anti-influenza_Chain
caggugcaacuggucgagagcggcgggggaguugugcagcccgguagaucccucaggcuuucuugcgccgcuucaggcuucaccuuuaguagcuacgggaucuauuggguacggcaggcaccuggaaagggccuggaauggguggccuucauuuccuacgacgagauaaacaaauuuuaugcggauucugucaagggucgcuucacaaucucgcgagacaauucaaagaacacuguguuuuugcagaugaauagcuuacgugaugaagacacggcuguuuacuauugugccaaaccacugagagggaguuacagguauuucgaucuauggggacggggcaccguggucacaguguccucu

SEQ ID NO: 27868 - RNA, 363 nt, Artificial Sequence
  derived and/or modified sequence opt3 from anti-influenza_Chain
caggugcaacugcaggagagcggccccgaccucgucaagccuggggccuccguuaugaucucuugcaaggcuucaggauacaguuucaccuauuacuauaugcacugggugaaacagagccaugguaaaacacuugaauggauuggcagaauauacccauauaacggggauacuaauuacaacaggcgguuuaaggacaaagcaauccugacgguagaugaguccucuucgaccgccuauauggaauugcgcucauuaacaagcgaggacagugcgguguacuucugugcucgagaugccaauuacgaaggagacugguauuuugaugucuggggccaggguacuaccgugacaguuuccucu

SEQ ID NO: 27869 - RNA, 363 nt, Artificial Sequence
  derived and/or modified sequence opt3 from anti-influenza_Chain
caggugcaacugguccagagcggcgggggaguugugcagcccgguagaucccucaggcuuucuugcgccgcuucaggcuucaccuuuaguagcuacgcaaugcacuggguacggcaggccccugggaagggacuggaguggguggcgaucauuuccuaugacggcaacgaucaauacuauacagacucugucaaaggucgcuucacuauaucgcgagauucaagcaagguguacuugcagaugcaucguuuaagaccagaagacacggcuguuuauuacugugccaaagaguuugaaaccaguggguauuuccacggauccuuugauuacuggggccagggcauccuggugacagucucuagc

SEQ ID NO: 27870 - RNA, 363 nt, Artificial Sequence
  derived and/or modified sequence opt3 from anti-influenza_Chain
caggugcaagucguucagagcggcgccgaggugaagaaacccggguccucuguaagagugucaugccaggcuaguggagguaccuucaugaacuacgcaaucauuugggucaggcgggccccuggccaggggcuggaauggaugggaggcauaaucccaguguuuccgacacccaauuaugcgcaaauguuccagggucgcguuacuauuagcacggacgagucccgaucuaccucguuucucgaacuuacaaaccugcguuacgaggauacugcuguguauuacugugccagaaggaucuaucacgggggaaauucaggcuucgacuuuuggggccaggggaccuuggucacagugagcagu

SEQ ID NO: 27871 - RNA, 363 nt, Artificial Sequence
  derived and/or modified sequence opt3 from anti-influenza_Chain
caggugcaacugcaggagagcggccccgggcuccuuaagccuuccgacacccuggccuugacaugcacugucucuggagguucaaucacgagugauuacuggagcuggauuagacagccaccgggcaggggguuagacuggauaggauucuuuuauaacggcgguuccaccaaauacaaucccucucugaagucgcggguuacaaucucagcugauacuagcaaaaaccagcuaagucucaagcugaccuccgugacagcagccgacaccgggguauauuacugugcgcgccacgaugcuaaauucucuggaagcuauuacguggccuccuggggccaaggcacucgagucacagugucaagu

SEQ ID NO: 27872 - RNA, 363 nt, Artificial Sequence
  derived and/or modified sequence opt3 from anti-influenza_Chain
caggugcaacugcaggagagcggccccgggcuccuuaagccuuccgacacccuggccuugacaugcacugucucuggagguucaaucacgagugauuacuggagcuggauuagacagccaccgggcaggggguuagacuggauaggauucuuuuauaacggcgguuccaccaaauacaaucccucucugaagucgcggguuacaaucucagcugauacuagcaaaaaccagcuaagucucaagcugaccuccgugacagcagccgacaccgggguauauuacugugcgcgccacgaugugaaauucucuggaagcuauuacgucgcuuccuggggccaaggcacucgagugacaguuucaagu

SEQ ID NO: 27873 - RNA, 363 nt, Artificial Sequence
  derived and/or modified sequence opt3 from anti-influenza_Chain
caggugcaacugcaggagagcggccccgggcucgucaagccuuccgaaacccuuucuguuacaugcaaagugucaggagacaguaucagcuccuacucuuggucguggauuagacagccaccggguaagggccuggaguggguaggguauuuguacuauucaggaagcacuaaauacaaccccaguuuaaaguccaggacgaccauaucuguggauacaagcacuaaucagcugucccuaaaacucucauucgucaccgccgcugacacagcaguguauuuuugugcccggaccggcagugaaagcacuacagguuacgggauggauguuuggggacaaggcaccacggugacugucucuucc

SEQ ID NO: 27874 - RNA, 363 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguccuuucagaagcuacgcaaucuccugggugaggcaagccccaggccaggggccggaauggaugggaggcauuauacccaucuuugguaccacaaaguaugcgccuaaauuccaggggcgggucacuauuacggcugacgauuuugccggaaccguguacauggagcucucuucgcuucgcucagaagacacagcaauguauuacugugccaagcacaugggcuaucagguucgagagacuauggauguguggggcaaggggaccacagucaccgugagcagu

SEQ ID NO: 27875 - RNA, 363 nt, Artificial Sequence
  derived and/or modified sequence opt3 from anti-influenza_Chain
caggugcaacugguccagagcggcgccgagguuaagaaacccggguccucugugaagguaucaugcaaagcuaguggagguccuuucagaagcuacgcaaucuccugggugaggcaggccccaggccaggggccggaauggaugggaggcauuauacccaucuuugguaccacaaaguaugcgccuaaauuccaagggcgggucacuauuacggcugacgauuuugccggaaccguguacauggagcucucuucgcuucgcucagaagacacagcaauguauuacugugccaagcacaugggcuaucagguucgagagacuauggauguguggggcaaggggaccacagucaccgugagcagu

SEQ ID NO: 27876 - RNA, 363 nt, Artificial Sequence
  derived and/or modified sequence opt3 from anti-influenza_Chain
gaggugcagcuggucgaaaccggcgccgagguuaagaaacccggggcuagcgugaagguauccugcaaagcaucuggauacacauucacuucauauuacaugcacugggugagacaagccccuggucagggccucgaauggaugggguggaucaacccaaauaguggaggcacgaacuaugcgcagaaguuucaggguagggucaccaugacacgggacacuagcauuuccaccgcuuacauggagcuuucucgccugcgaucggaugacacagccguguauuacugugcacgugaagggaaauggggaccgcaagccgcuuucgauauauggggccagggcaccaugguuacugugucaagc

SEQ ID NO: 27877 - RNA, 363 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguaccuucagcuuuuacuccaugucuugggugagacaagcaccuggccaggggcucgaauggaugggaggcaucauuccaauguucgguacaacuaacuaugcccagaaguuucaggggagggucacgauaaccgcgguggagucgacaucaacugcuuacauggaaguuagcagucuucgguccgaggacaccgccguguauuacugugcacgcggagauaaaggcaucuauuacuauuacauggacgucuggggcaaggggacaaccgugacuguaucuagc

SEQ ID NO: 27878 - RNA, 363 nt, Artificial Sequence
  derived and/or modified sequence opt3 from anti-influenza_Chain
gaggugcagcuggucgaaaccggcgccgagguuaagaaacccgggagcuccgugaagguaucuugcaaggcuucaggagguacauucagaacucacgcaaucaguugggugaggcaagccccuggccaggggcucgaauggaugggaggcauuauagcgaucuuugguacggcuaacuacgcccagaaauuccaggggcggauuaccaucacagcagacgagagcacuuccaccgccuauauggaacuuucuucgcugcgcucagaggauacagcugucuacuuuugugcacgaggaagcggcuaucauauuaguaccccauucgacaauuggggccaagggacuuuggugacaguuuccucu

SEQ ID NO: 27879 - RNA, 363 nt, Artificial Sequence
  derived and/or modified sequence opt3 from anti-influenza_Chain
gaggugcagcugguccaaagcggcgccgaaguuaagaaacccggguccucugugaagguaucaugcaaagcuaguggagguaucuucagaagcaacuccauuucuugggugaggcaggcaccuggccaggggcucgaguggaugggaggcauauuugcccuuuucgguaccacagacuacgcgcagaaguuucaagggcgggucacuaucacggcugaugaaucgucaaccacaguguaucuggaguugagcaguuuaacuuccgaagacaccgccguuuacuauugugcacgcggaucuggcuacacaacccgaaauuauuucgauuacuggggccaggggacucuggugacagucagcucc

SEQ ID NO: 27880 - RNA, 363 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguaucuucaacagcuacgcaauuuccugggugagacaagccccuggccaggggcucgaauggaugggaggcauaaucgcgauuuuucacaccccaaaguaugcucagaaauuccaggguagggucacaaucacugccgacgagucuacgaauaccgcauacauggaacuucggucgcugaagucagaggauacagccuuguauuacugugcucgcgggagcacuuaugacuuuaguuccggauuagauuacuggggccaaggcacccuggugacaguuucuagc

SEQ ID NO: 27881 - RNA, 363 nt, Artificial Sequence
  derived and/or modified sequence opt3 from anti-influenza_Chain
caggugcaacugguccagagcggcgccgagguuaagaaacccggguccucugugaagguaucaugcaaaaguagcggagguaacuucaauaacuacgcuguguccugggucagacaggcaccuggccaggggcucgaauggaugggaggcaucucuccaauuuuugguucgaccaaucacgcccaaaaguuccaggggagggugacaauaucagcggacaucuuuacuaacacggcuuauauggagcuuagcagucugcgguccgaugacaccgccauuuacuauugugcacgcggacgaggcuacuauuucuaccaugccauggauguuuggggccaggggucuacagugacugucagcucc

SEQ ID NO: 27882 - RNA, 363 nt, Artificial Sequence
  derived and/or modified sequence opt3 from anti-influenza_Chain
caggugcaacugguccagagcggcgccgagguuaagaaacccggguccucugugaagguaucaugcaaagcuaguggagguaccuucaacaauuacgcaaucaacugggugagacaggccccuggccaggggcucgaauggaugggaggcauuagcccaauauuugguuccgucaauuaugcgcaaaaacuucaggggagggugacaaucacugcugacguuuucacgucuaccgccuacauggagcugucgucauugcggagcgaagauacagcaguguauuacugugccaagggaaguggcuauuacuauuacuacggcuuagacgucugggggcugggaacuaccgugacaguauccucu

SEQ ID NO: 27883 - RNA, 363 nt, Artificial Sequence
  derived and/or modified sequence opt3 from anti-influenza_Chain
caggugcaacuggucgagagcggcgggggaguugugcagcccgguagaucccucaggcuuucuugcgccgcuucaggcuucaccuuuacaaauuacgcaaugcacuggguacggcaggccccugggaagggacuggaauggguggcggucaucaguuucgacgaggauaauaaaagcuaugcugacuacgugaagggccgcuuuacuauuucccgagauaacucuaauaaccguuuguauuuacagaugaacucgcugagagccgaagacacggcaguuuacuauugugccagggguccagaggggguguggggacggucaauagauagcuggggccaaggcacccuagucacagugaguucc

SEQ ID NO: 27884 - RNA, 363 nt, Artificial Sequence
  derived and/or modified sequence opt3 from anti-influenza_Chain
caggugcaacugguccagagcggcggggaccucguucagcccggagguucccuuagacugucuugcgccgcuucaggcuucaccuuuaguagguacagcaugaacugggugcggcaggcaccugggaugggauuggaguggguagccuauaucuccgauacaucucgcacuauuuacuaugcggacucggugaagggccgauucacgauaucacgugauaaugcuaaaaacagcuuauaccugcaaaugaagagucuaagagacgaagauaccgccgucuauuacugugcaagggacccagauacaccguuugugcgggccuucgacuccuggggucaggggacucucguuaccgugucuagc

SEQ ID NO: 27885 - RNA, 363 nt, Artificial Sequence
  derived and/or modified sequence opt3 from anti-influenza_Chain
caggugcaacuggucgagagcggcgggggacucguucagcccgguggcucccuuagacugucuugcguggccucaggguucaccuuuaguagguucagcaugaacuggguacggcaggcuccuggaaugggcuuggaauggguguccuacaucucugacacaggucgcacuauuuauuacgcagauucggucaaggggcgauuuacgauaucacgugacaaugauaagaacaccuuauaucugcagaugaaaagccuaagagacgaggauagugccuucuacuauugugcgagggacccagauacaccguuugugcgggcuuucgacuccuggggacaaggcguucucgugacugucucuagc

SEQ ID NO: 27886 - RNA, 363 nt, Artificial Sequence
  derived and/or modified sequence opt3 from anti-influenza_Chain
caggugcaacugcaggagagcggccccgaccucgucaagccuggggccuccguuaaaaugucuugcaaggcuucaggauacaguuucaccuauuaccacaugcauugggugaaacagacacacgguaagagccuugaauggaucggcagaauuuauccauacaacgggggaacuaauuauucccagagguuuaaaggcaaggcaguauucacgguggauaugucuucgucaaccgccuacauggagcugcggagcuugacaagugaagacuccgcggucuauuacugugcucgcgaugccaacuacgagggugacugguauuuugaugugugggggcaaggaacuaccguuacagugucuagc

SEQ ID NO: 27887 - RNA, 366 nt, Artificial Sequence
  derived and/or modified sequence opt3 from anti-influenza_Chain
cagggccaacuggugcagagcggggccgaggucaagaaauccggaucuucaguuaaggugaguugcaaaaccagcgguggcacauucaacucccacgcuaucucuuggguaagacaggcacccgggcagggacucgaauggauuggcgguauaaucccuauguuugggacuacgaauuacgcccaaaaacuuaagggaaggauugcgaucaccgcugaccagcugccaacaacugccuauuuggaguuaucgucacugcggagcgaagauaccgcaguguacuauugugcccgcggccagcgauacuauuacgaccgugauggcauggacgucugggggcagggaacaauggugaccguuaguucc

SEQ ID NO: 27888 - RNA, 366 nt, Artificial Sequence
  derived and/or modified sequence opt3 from anti-influenza_Chain
caggugcaccugguccaaagcggcgccgagguuaagaaacccggguccucugugagacucucaugcagugcuagcggagguccuuucuccggcuuugcaaucucuuggcuuaggcaggccccagggcagggacuggaaugguugggcgguauuucggcgguauucgggaccgcuacauacgcccagaaguuucaaggacgggugacuauaacggcagaccaguucaccucaacaagccauauggauuuaagucgccugacuuaugacgauaccgccgucuacuauugugcucgauccggcggcuaccuaccgcagaacaauuggaucgaccccugggggcagggaacacucgugauuguuucuagc

SEQ ID NO: 27889 - RNA, 366 nt, Artificial Sequence
  derived and/or modified sequence opt3 from anti-influenza_Chain
caggugcaacugguccagagcggcgccgagguuaagaaagcuggguccucugugaagguaucaugccagaguagcggagugaccuucuccauguacgcagucucuugggugagacaggcccccggucaaggccucgaauggaugggagggaucauuccucuuuuuggcacaacuacguaugcgcagaaauucgaggguaggcugaccauaacagcugacacuucgaccaacauggccuacuuggaauuacggucacugcgcagcgaggauacagcaguuuauuuuugugcccgagcugggaccacugugacacguuucaauugguuugacccauggggacagggcacccuagucacggugaguucc

SEQ ID NO: 27890 - RNA, 366 nt, Artificial Sequence
  derived and/or modified sequence opt3 from anti-influenza_Chain
caggugcaacugguccagagcggcgccgagguuaagaaacccggguccucucucaaggugucaugcaaagcuaguggaguaaccuucagcauguacacaaucuccugggugagacaggcaccuggucagggccuugaauggaugggagggauuauaccacuguuuggcacugccaacuaugagcaaaaguuccaggguagggucacgaucaccgcggacacaucuacuaauaccgcuuacauggaauugucgucauuacggagcgaggauacagccguguauuacugugcacgcgccgggaccacucugacacgauuuaacugguucgacccguggggacagggcacccuaguuacggugaguucc

SEQ ID NO: 27891 - RNA, 366 nt, Artificial Sequence
  derived and/or modified sequence opt3 from anti-influenza_Chain
auggccgacaacaugaccacaacucagaucgaguggagaaugaagaaaauggcuauuggcagcuccacgcacucuucaagugugcugaugaaggauauacaaagccaguucgaacagcucaaacuuaggugggaguccuaccccaaucuggucaagucuaccgacuaucaucagaaacgggaaacaauccgcuuggcaacugaggaauuauaccugcuaucgaagcgaauugaugacucaauccucuuucacaagaccguuauugccaacagcaguaucauagcggauaugaucgugucccugucucuucuggagacauuguaugagaugaaagacguaguggaagucuacagccgucaaugccuc

SEQ ID NO: 27892 - RNA, 366 nt, Artificial Sequence
  derived and/or modified sequence opt3 from anti-influenza_Chain
gaggugcagcugguccaaagcggcgggggacucguucagcccgguggcucccuuagacuggccugcgugguaucuggguucaccgugacaucaaacuacaucacuugggucaggcaggcuccuggaaaaggcuuggaaugggugaguguuauuuauagccacggucgggcauacuauuccgccucugugaaugggcgcuuuacgauaucgcgacauaccucaaagaacacagucuacuuagagaugaauagccugcguccagaagacacugcgguguauuacugugcuggaggcggccuaguagggggauaugaugaguacuucuuugacuacuggggucagggcacccucgccacaguuaguucc

SEQ ID NO: 27893 - RNA, 366 nt, Artificial Sequence
  derived and/or modified sequence opt3 from anti-influenza_Chain
caggugcaacugguccagagcggcgccgagguuaagaaacccggggcuuccgugaagguaucuugcaaagcaucaggauacaccuucacagguuauuacaugcacugggugagacaggccccuggccaggggcucgaauggaugggauggaucaacccaaauaguggcgacacuaacuaugcgcaaaaguuucaggguagggucacgaugacccgggauacaagcauuacuaccgcuuacauggagcuuuccucucugcgcucggacgauacagccguguauuacugugcacgagacucaccguauagcaguuccuggucuuucuuugauuacugggggcagggacccuugguuaccgugagcucc

SEQ ID NO: 27894 - RNA, 366 nt, Artificial Sequence
  derived and/or modified sequence opt3 from anti-influenza_Chain
gaggugcagcuggucgaaagcggcgggggacucguucaacccgguggcucccuuagacugucuugcgccgcuucaggguucaucuuuaggaauuacuggaugaguugggugcggcaggcaccuggaaagggcuuggaguggguagccaauauuaaacaggacggucgcgaaaaguauuacguggauagcuuacgagggcgugucaacauauccagagacaaugcggagaacucucuguaucuacacaugaacucgcucaggguggaagauaccgcuguuuacuucugugcccgggcacgcaugguggucgugacaggagacggcuuugauguauggggccaugggacuaugguuacggugucaagc

SEQ ID NO: 27895 - RNA, 366 nt, Artificial Sequence
  derived and/or modified sequence opt3 from anti-influenza_Chain
gaggugcagcugcucgaaagcggcgggggacuuguccaacccgguggcucccugagauugucuugcgccgcuucaggguucgcauuuaguagcuacggaauguccuggguuaggcaggccccuggcaaggguuuagagugggugucugcguucucggggucaggaaccagcacauauuacgcugacaguguaaaaggccgguuuacuaucucccgcgauaagucuaaaaacacgcuguaucuacagaugaauagccuccgagccgaagacaccgcaauuuacuauugugccaagccaccgggccccuacauaguggucgcugggcuguucgagaacuggggacgugguacacuugugacuguuucc

SEQ ID NO: 27896 - RNA, 366 nt, Artificial Sequence
  derived and/or modified sequence opt3 from anti-influenza_Chain
gaggugcagcuggucgaaagcggcgggggaguugugcaacccgguagaucccucaggcuuucuugcgccgcuucaggcuucaguuuuagcaacuacgcaaugcacuggguacggcaggccccugggaagggacuggaguggguggcguugaucuccuucgacggcucugauaaauauuacgcugacucggucaagggucgcuuuaccaugucacgagauaauagcaaaaacacauuauaucugcagaugaauagucuacgugccgaagacacugcaguguacuauugugccagagaugagccauacugcgggggagacuguuucgcuuuugauguuuggggccagggcacgauggugaccgucucc

SEQ ID NO: 27897 - RNA, 366 nt, Artificial Sequence
  derived and/or modified sequence opt3 from anti-influenza_Chain
caggugcaacugcagcagagcggccccgggcucgucaagccuucccagacccuuucucugacaugcacuguuucaggagguccagugaguggcgggggauacagcuggaacuggaucagacaaaggccgggccaggguuuggaguggguaggguucauguuucacuccggaucuccccgguauaauccuacguuaaaaucgcgcauuaccauaucaguggacacaagcaagaaccuggucagucuaaaacucuccucugugacugccgcugauaccgcaguuuacuucugugcccgagugggccagauggacaaguauuacgcgauggaugucuggggccaggggacaaccgugacuguaagcucc

SEQ ID NO: 27898 - RNA, 366 nt, Artificial Sequence
  derived and/or modified sequence opt3 from anti-influenza_Chain
caggugcaacugguccagagcggcgggggacucguuaagcccgguggcucccuuagacugucuugcgccgcuucaggguucaccuuuaguagcuacuccaugaacugggugaggcaggcaccuggaaaaggcuuggaguggguaucuucgaucucaagcaguuccucuuauauuuacuauguggacagcgucaagggucgguucacaauaucccgcgauaaugccaaaaacucauuauaccugcagaugaauagucuacgagcggaagacacugcuguguauuacugugcccgugggggaggcagcuauggcgcauacgagggguuugauuacuggggacaagguacgcucguuaccgugucuucc

SEQ ID NO: 27899 - RNA, 366 nt, Artificial Sequence
  derived and/or modified sequence opt3 from anti-influenza_Chain
caggugcaacugguccagagcggcgggggaguugugcagcccgguagaucccucaggcuuucuugcgccgcuucaggcuucaauuuuaguagcuacgggaugcacuggguacggcaggcaccuggaaagggccuggagugguuguccgugaucuggucuggugggucgaauaaauauuacgccgacucagucaagggacgcuucaccauuagccgagaugacaguaaaaacacaguguauuuacaaaugaacucccugcgugaugaagacacugcgguuuacuauugugcuagagcccauacggcacuaaccagguuucgguggcucgauccauggggccagggcauacuggugacagucucuagc

SEQ ID NO: 27900 - RNA, 366 nt, Artificial Sequence
  derived and/or modified sequence opt3 from anti-influenza_Chain
caggugcaacugguccagagcggcgggggaguugugcagagagguaggucccuccggcuuucuugcgccgcuucaggcuucaccuuucgcacauacgggaugcacuggguacgacaggcacccggaaagggccuggaguguguggccuugaucaguuaugacgguacuaacaaauacuaugcggauagcgucaaggggcguuucacgauuuccagagacaauucuaaagauaccuuauaccugcaaaugaacucgcuaagggcugaagacacaggaguguauuacugcgccucacucgauuaugacuuuagcuacuacuaucaucgggauguuuggggcccuggcacuaccgugacagucaguucc

SEQ ID NO: 27901 - RNA, 366 nt, Artificial Sequence
  derived and/or modified sequence opt3 from anti-influenza_Chain
caggugcaacuggucgagagcggcgggggacucguucagcccgguggcucccuuagacugucuugcgccgcuucaggguucaccuuuagugacuacuggaugguguggguaaggcaggcaccuggaaagggcuuggugugggucagccggaucuccucugaugguucgacaacuucauaugccgacagcgugaaagggccauucacgauuagucgcgauaacgcgaagaauaccuuauaccugcagaugaacucccuacgagcugaagacacagccguuuauuacugugcacguguggccacuccguauuacuaugagucuggauuugauuacuggggccaaggcgcucucgucaccgugagcucc

SEQ ID NO: 27902 - RNA, 369 nt, Artificial Sequence
  derived and/or modified sequence opt3 from anti-influenza_Chain
caguuccaacuggugcagagcggccccgaggucaagaaaccugggaccuccguuaaggugucuugcaaagccucaggauacacaaguacuacguaugguaucagcuggguaagacaggugccaggccaggggcucgaauggaugggauggauuaacccguacaauggcaacccccacuauggucaaaaguuucaggggagggucacccuuacacgggacacuuccaccaauacagcuuaccuggagauauugucuuuacgcucggaugacaccgcaguguauuacugugcccgagauggauggggccagcagcugguuccuuauuacuucgacuacuggggccaagggacucuagugacagucucaagc

SEQ ID NO: 27903 - RNA, 369 nt, Artificial Sequence
  derived and/or modified sequence opt3 from anti-influenza_Chain
caggugcaacuggcccagagcggcgcugaggucaagagacccggguccucuguuaaagugucaugcaccgcaaguggagguaucuucaggaagaacgccauuagcuggguacggcaggcgccuggccaggggcucgaauggaugggaggcauaaucgcuguguuuaauacagccaacuacgcacaaaaauuccagggucgcgucaagauuacugccgacgaguccgggaauacggcuuauauggaacuuucuucgcugcgaucagaugacaccgcaguguacuauugugccagccacccaaaauacuuuuauggaaguggcuccuacccggauuucuggggccaggggacauugguuacugugucuagc

SEQ ID NO: 27904 - RNA, 369 nt, Artificial Sequence
  derived and/or modified sequence opt3 from anti-influenza_Chain
caggugcaacugcaggagagcggccccgggcucgucaagccuuccgaaacccuuucucugacaugcacuguuucaagaggaaguaucggucacuacuucuggagcuggauuaggcagccaccgggcaaaggguuggaguggauaggauauaucuccuacucuggcucgacgaaguauaaccccucauuacggagccgcgugaccauuaguguagacacauccaaaaaucaguuuucucugaaccuaaauagcgugacugccaccgauacagcucucuacuauugugcacgagaagacuacgauauccugaccggugccgggccuggaauggaggucuggggccaaggcacuacagugaccguuuccuca

SEQ ID NO: 27905 - RNA, 369 nt, Artificial Sequence
  derived and/or modified sequence opt3 from anti-influenza_Chain
caggugcaacugcaggagagcggccccgggcucgucaagccuuccgaaacccuuucucugacaugcacuguuucaggagccaguaucaacagccacuacugguccuggauuagacagccaccggguaaaggcuuggaguggauaggguauguguacuauucuggaucgacgaccuacaaucccucauuaaagagcaggguaacacugaguguggacacuuccaaaaaccaguucucucuaaaucucagcuccgucaccgcugcagauacagccuuuuauuacugugcgcggcauccuuaugacgugcugaccggcucaggugauugguucgacccaugggggcaaggaacucuuguuacagugaguagc

SEQ ID NO: 27906 - RNA, 369 nt, Artificial Sequence
  derived and/or modified sequence opt3 from anti-influenza_Chain
caggugcaacugguccagagcggcgccgagguuaagagacccggguccucugugaaaguaucaugcaccgcuaguggagguaucuucaggaagaacgcaauuagcugggugcggcaggccccuggccaggggcucgaauggaugggaggcauaaucgcggucuuuaauacagcuaacuacgcccaaaaauuccagaaucgcgugaagauuacugcagacgaguccgguaacacggccuauauggaacuuucuucgcugaccucagaugacacagcuguuuacuauugugcaagccacccaaaauacuuuuaugggaguggauccuacccggauuucuggggccagggcacuuuggugaccgucucuagc

SEQ ID NO: 27907 - RNA, 369 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguaccuucagaagcuacgcaguguccugggucaggcaagccccuggccaggggcucgaauggaugggaggcaucauugcgauauuugguacaacuaacuaugcucagaaguuccaggaccgggugacgaucaccgccgaugaccuuccaucuacagcauacauggagcugacuucguugcgcucagaagauaccgccguuuauuuuugugugcgagggcguggauacuauuuaggcggcgacuacgggagccuggauaguuggggacaagguacccuagucacagugucc

SEQ ID NO: 27908 - RNA, 369 nt, Artificial Sequence
  derived and/or modified sequence opt3 from anti-influenza_Chain
gaggugcagcuggucgaaagcggcgggggacucguucaacccgguagaucccuuaggcugucuugcgugggcucaggguucaacuuugacggauacgccaugcaguggguacgccaggugccuggcaaggguuuggagugggucagugggaucagcuggcacuccgauucuaccggauaugcugacucggugcggggccgauucacaauuucacgugauaaugccaaaaacagcuuauaccugcagauggacagucuaagaccagaagauacugcauuuuauuacuguggcaaguccauagggcauguuggagguucuuauaggcacccgaucgacuacuggggccaagggacgcucgugaccgucagc

SEQ ID NO: 27909 - RNA, 369 nt, Artificial Sequence
  derived and/or modified sequence opt3 from anti-influenza_Chain
caggugcaacugcaggccagcggccccgggcucgucaagccuuccgagacccuuucucugacaugcacuguuucaggagacaguaucacgagcggugcuuacuauuggaccuggauuagacagcacccaggcaaaggguuggaauggauaggauacaucuauuacuccggcaacacauauuacaauccgucuuuaaagucgagggugacuauuucacuggauaccagcaaaaaccaguucagucuaaagguaaauuccgugacagcagccgacaccgcggucuauuacugugcucgggccgcaucuacuagcgugcucgguuacgggauggauguuuggggacaaggcacaaccgugacggucuccuca

SEQ ID NO: 27910 - RNA, 369 nt, Artificial Sequence
  derived and/or modified sequence opt3 from anti-influenza_Chain
caggugcaacugguccagagcggcgccgagguuaagaaacccggguccucugugagaguaucaugcaaggcuaguggaagcaucuucaggaacuacgcaauguccugggugcggcaggccccuggucagggccucgaauggaugggagggauuauagcgaucuuuggcaccccaaaauaugcucaaaaguuccagggucgcgucacaauuacugccgacgagucuacgucgaccguguacauggaacuuucagggcugcgaagcgaggauacagcaauguauuacugugcccguaucccgcacuauaauuuuggaaguggcuccuacuucgacuauuggggccaggggacuuugguuaccgugucuagc

SEQ ID NO: 27911 - RNA, 369 nt, Artificial Sequence
  derived and/or modified sequence opt3 from anti-influenza_Chain
cagcugcaacuccaggagagcggccccagacuugugaagccuuccgaaacccugucuuugacaugcucagucagugggguuagcaucuccucuucgaacuacuauuggggauggauuaggcagccaccggguaaaggcuuagaguggauagggacuaucuaccacucaggaagcacguauuacaaucccagucugaagucccggcuaauuaucucuguggacaccagcaaaaaccaguucuaucuccaacugacaucccuuacugccgcugauucagcaguauacuauugugccaccggcgguggguuuggauggagucagacauacuucggcuacuggggccaggggacccuggugacugcgagcucu

SEQ ID NO: 27912 - RNA, 369 nt, Artificial Sequence
  derived and/or modified sequence opt3 from anti-influenza_Chain
gaggugcagcugcaacagagcggccccgaacucgucaagccuggggccuccguuaaaaugucuugcaaggcuucaggauacaccuucacaaguuuuaucauguauugggugaaacagaagccaggucagggccuugaguggcugggguacauugacccguauaacgauggaacuaaauacaaugaaaaguucgagggcaaggcaacguugaccagcgacaaauccucuucgacagccuauauggaauuaucaagccugaccagugaggauuccgcgguauacuauugugcuaagagagguaacuacgggaauggauuugccuacuggggccaaggcacucuagugacagucucugcagccaaaaccagc

SEQ ID NO: 27913 - RNA, 369 nt, Artificial Sequence
  derived and/or modified sequence opt3 from anti-influenza_Chain
caggugcaacugcucgagagcggcggggacgucguucagcccggaaccucccuuagacugucuugcgccgcuucagguuucaguuuguggacaagcggcaugcacugggugaggcaggcaccugggaagggauuagaauggguagccgugauguccuacgaugagacuaaaaaguauuacgcggacucuguccggggccgcuuuucgaucucacgagauaacagccguaauacgcuguaucuacagaugaacagucucagaguggaagacaccgcuguuuacuucugugccaaaccaaggcuggauuaucuugacuacuuucaugcagccgauuccuggggucaagggacacuggugucugucagcucc

SEQ ID NO: 27914 - RNA, 369 nt, Artificial Sequence
  derived and/or modified sequence opt3 from anti-influenza_Chain
caggugcaacuggucgagagcggcgccgaaguuagaaagcccggggagucccucaggaucucuugcaaagcucacggagacucauucaccaguuacuggauugguugggugcggcagcuuccuggcaaggggcuggaauggauggcaguaauauauccacgcgauagcgagacaaaauuuuccccggccuuccauggacaggugucuaucucggucgacaagucaacuagcacggugcacuugcaguggaacaguuuaaaagcguccgauaccgcuguuuacuauugugcccgaucucccggcuacagcgguuaucuguacgggugguuugacccuuggggacaaggcacaccagugacugucuccuca

SEQ ID NO: 27915 - RNA, 369 nt, Artificial Sequence
  derived and/or modified sequence opt3 from anti-influenza_Chain
caggugcaacuggucgagagcggccccgggcucguuaagccuuccgaaacccuuucucugacaugcacugugucaggagacaguguaaucaacagcgccuacuauugggauuggauuagacagccaccggguaaaggcuuggagugggugggguccgucuacuauucuggaauaacguacuauaaucccucguuaaagucaagggugaccaucagcguugacacaaguaaaaaccaguucucccugcggcuaucuuacgugacugcugcagauaccgcccucuauuacugugcgcgccgaggcgguggguggcaguacuauuacggaauggacgucuggggccaaggcacaaccgugacuguaagcucc

SEQ ID NO: 27916 - RNA, 369 nt, Artificial Sequence
  derived and/or modified sequence opt3 from anti-influenza_Chain
caggugcaacugguccagagcggcgccgagguuaagaaacccggggcuuccgugaagguaucuugcaaagcaucaggauacaucuucaccgguuauuacauucacugggugagacaggccccuggccaggggcucgaauggaugggaaggauagacccaaacggcagugguacaacuuaugcgcaaaaguuucaggggcgggucacgcuuaccauggauacaagcaucacuaccgcuuacauggagcugucccgcuugcgauucgacgauacagccauuuauuacugugcacguugggacuggaauuuugauuuauaucugggaugguucgacccguggggccagggcacccccgugacuguugccucu

SEQ ID NO: 27917 - RNA, 369 nt, Artificial Sequence
  derived and/or modified sequence opt3 from anti-influenza_Chain
gaggugcagcugguccaaagcggcgccgaaguuaagaaacccggggcuuccgugaagguaucuugcaaagcaucaggauacaucuucaccgguuauuacauucacugggugagacaggccccuggccaggggcucgaguggaugggaaggauagacccaaacggcgcggguacaacuuaugcucagaaguuucaagggcgggucacgcuuaccauggauacaaguaucacuaccgccuacauggaacugagccgcuugcgauucgacgauacagcaauuuauuacugugcccguugggacuggaauuuugauuuauaucugggaugguucgacccguggggccagggcacccccgugacuguugcuucc

SEQ ID NO: 27918 - RNA, 369 nt, Artificial Sequence
  derived and/or modified sequence opt3 from anti-influenza_Chain
caggugcaacugguccagagcggcgccgagguuaagaaacccggggcuuccgugaagguaucuugcaaagcaucaggauacaccuucaacgcccaccauaugcacugggugagacaggcgccuggucagggccucggguggaugggauggaucgacccaaauaacgauggcacaauuuaugcucaaaaguuucaggguagggucacucuuacgauggacaccaguauacauacagccuacauggaacugagcggguugcgguaugaugacacugcaaucuacuauugugugcgcugggccuggaauuucgacuuuuucuuaggaugguuugauccguggggccagggcacccugguuacaguggcuucc

SEQ ID NO: 27919 - RNA, 369 nt, Artificial Sequence
  derived and/or modified sequence opt3 from anti-influenza_Chain
gaggugcagcugguccaaagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcgacuccgauacaaucuacucuccgucguuucagggucaagugacuauuucagcugacaacagcaucaguacggcauaucugcagugguccucuuugaaagccagcgauaccgcgauuuacuauugugcuuccgggcccggauacucaggcuaucacuacggcugguucgacacaugggggcagggaacuuuagucaccgugaguagc

SEQ ID NO: 27920 - RNA, 369 nt, Artificial Sequence
  derived and/or modified sequence opt3 from anti-influenza_Chain
gaggugcagcugguccaaagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcgacgcugaugcaaucuacuccccgucuuuucagggucaagugacaauuucggccgacaacucaaucagcacugcguaucugcaguggaguuccuugaaagccucugauacggcuauuuacuauugugcaagcgggcccggauacuccggcuaucacuacggcugguucgacaccugggggcagggaacauuagucacugugucaagu

SEQ ID NO: 27921 - RNA, 369 nt, Artificial Sequence
  derived and/or modified sequence opt3 from anti-influenza_Chain
gaggugcagcugguccaaagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcgaguccgaaacaaucuacucuccgucguuucagggucaagugacuauuucagcugacaacagcaucaguacggcauaucugcagugguccucuuugaaagccagcgauaccgcgauuuacuauugugcuuccgggcccggauacucaggcuaucacuacggcugguucgacacaugggggcagggaacuuuagucaccgugaguagc

SEQ ID NO: 27922 - RNA, 369 nt, Artificial Sequence
  derived and/or modified sequence opt3 from anti-influenza_Chain
gaggugcagcugguccaaagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcgacgcugauacaaucuacuccccgucuuuucagggucaagugacuauuucggcagacaacucaaucagcacggccuaucugcaguggaguuccuugaaagcgucugauaccgcuauuuacuauugugccagcgggcccggauacuccggcuaucacuacggcugguucgacacaugggggcagggaacuuuagucaccgugucaagu

SEQ ID NO: 27923 - RNA, 369 nt, Artificial Sequence
  derived and/or modified sequence opt3 from anti-influenza_Chain
gaggugcagcugguccaaagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcuccucugacacaaucuacucgccgucauuucagggucaagugacuauuagcgcugauaacaguaucuccacggcauaucugcaguggucuagcuugaaagccuccgacaccgcgauuuacuauugugcuucagggcccggauacaguggcuaucacuacggcugguucgauacaugggggcagggaacuuuagucaccgugagcucu

SEQ ID NO: 27924 - RNA, 369 nt, Artificial Sequence
  derived and/or modified sequence opt3 from anti-influenza_Chain
gaggugcagcugguccaaagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcgacuccgaugcuaucuacucuccgucguuucagggucaagugacaauuucagcagacaacagcaucaguacugccuaucugcagugguccucuuugaaagcgagcgauacggcuauuuacuauugugccuccgggcccggauacucaggcuaucacuacggcugguucgacaccugggggcagggaacauuagucacugugaguagc

SEQ ID NO: 27925 - RNA, 369 nt, Artificial Sequence
  derived and/or modified sequence opt3 from anti-influenza_Chain
gaggugcagcugguccaaagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcgacacagauacuaucuacuccccgucuuuucagggucaagugacgauuucggcugacaacucaaucagcaccgcauaucugcaguggaguuccuugaaagccucugauacagcgauuuacuauugugcuagcgggcccggauacuccggcuaucacuacggcugguucgacacuugggggcagggaaccuuagucacagugucaagu

SEQ ID NO: 27926 - RNA, 369 nt, Artificial Sequence
  derived and/or modified sequence opt3 from anti-influenza_Chain
gaggugcagcugguccaaagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcgaguccgacacaaucuacucuccgucguuucagggucaagugacuauuucagcugauaacagcaucaguacggcauaucugcagugguccucuuugaaagccagcgacaccgcgauuuacuauugugcuuccgggcccggauacucaggcuaucacuacggcugguucgauacaugggggcagggaacuuuagucaccgugaguagc

SEQ ID NO: 27927 - RNA, 372 nt, Artificial Sequence
  derived and/or modified sequence opt3 from anti-influenza_Chain
caggugcaacugguccagagcggcgccgagguuaagaaacccggguccucugugaagguaucaugcaaagcuaguggagguaucuucauuagccaggcaauauccugggugagacaggccccuggccaagggcucgaauggaugggaggcaucauuccaauguuuggugcgaccaacuacgcucagaaguuccaggggagggucacaaucacugccgacaaaucuacgaauaccguguauauggagcuuucgucacugacaagcgaagauacugcaguuuacuauugugcccgguugggaaguggcuccuaccacaacggcccgaauugguuugaccccugggggcagggaaccuuagugacagucucuagc

SEQ ID NO: 27928 - RNA, 372 nt, Artificial Sequence
  derived and/or modified sequence opt3 from anti-influenza_Chain
caggugcaacugcaggagagcggccccgggcucgucaagccuuccgaaacccuuucucugaacugcgccguuucaggagguaguaucagcaauuacuauugguccuggauuagacagccaccgggcaaaggguuggaguggauaggauacaucucuuauaacggcaggcccaaguacaauccuucguuaacaucacgggugacuauuagcguagacacgaguaaagaucaguucucccuggaacuacgcucugugaccgcugcagacacagcccucuauuacugugcgcgagagacucguuuuggugaacugcuuagcccauaugaugcuuucgagaucugggggcaaggaaccauggucacaguguccuca

SEQ ID NO: 27929 - RNA, 372 nt, Artificial Sequence
  derived and/or modified sequence opt3 from anti-influenza_Chain
caggugcaacugcaggagagcggccccgggcucgucaagccuuccgaaacccuuucucugacaugcacuguuucaggagguagugugagcuccgagacguacuauuggucuuggaucagacagccaccgggcaaaggguuggaauggauuggauacauauauuacaucggcaacaccgacuauaggcccucguuaaagucacggguaacaauuagccuggauaccaguaaaaaucaguucucccuaaagcucucuagcgugacugccgcugacacagcagucuacuauugugcccgcggugcguacuacgauuccucaggguauccugcuuuuuacaucuggggacaaggcaccauggugacuguuaguagc

SEQ ID NO: 27930 - RNA, 372 nt, Artificial Sequence
  derived and/or modified sequence opt3 from anti-influenza_Chain
caggugcaacugcaggagagcggccccgggcucgucaagccuuccgaaacccuuucucugacaugcgccguuucaggagugaguaucagcaacauugacuucuacugggguuggauaagacagccaccgggcaaaggguuggaguggaucggaaauauuuauuacacuggcaucacguuuuauaaccccuccuuaucuucgaggguagcuauuucaaucgauaccagcaagaaucaguucagucugacacuaacuuccgugaccgcagccgacacagcgauguacuauugugcucggcacuacggugauucugaagccauaaacgacgcauuugauaucugggggcaaggaaccaugcucacugucagcucc

SEQ ID NO: 27931 - RNA, 372 nt, Artificial Sequence
  derived and/or modified sequence opt3 from anti-influenza_Chain
caggugcaacuggucgagagcggcgccgaaguuaagaaauucggggcuuccgugaagguaucuugcaaagcaucaggauacacccucaucgacuauuacaugcacugggugagagucgcccccggucagggccuugaguggaugggguggauuaacccuauaaauggaggcacaaacuaugcgcagaaguuucaggguagggugacuaugacgcgggauaccaguaucaauacagcuuacauggaccugagcuccuugcgcucugaugacacugccauguauuacuguacccgagggcguccaauuggaagaaacugggaaccgagggauaaagacuauuggggccaaggcacacccguuaccgugucguca

SEQ ID NO: 27932 - RNA, 372 nt, Artificial Sequence
  derived and/or modified sequence opt3 from anti-influenza_Chain
caggugcaacugguccagagcggcgccgagguuaagaaacccggguccucugugaccguaucaugcaagacaaguggacacacuuucaucagcuacgcuauuuccuggcucagacaggcaccuggucagggccuugaauggaugggagggauagugccaaucuuuggcacggucaacuauacccaaaaauuccaggguaggcugacaauuacugccgacgagucuaccucgacagcguacauggauuugucacgguuaaccuuugaagacacugcuaucuauuucugugcccgcgaggcaggguaccauagcaguuuuuccggaguguauuucgauuacuggggccagggcacacugcuaaccguuucuagc

SEQ ID NO: 27933 - RNA, 372 nt, Artificial Sequence
  derived and/or modified sequence opt3 from anti-influenza_Chain
gaggugcagcugcaacagagcggccccgaacucgucaagccuggggccuccguuaaaaucucuugcaaggcuucaggauacaccuucacagacuauaacaugcacugggugaaacagagucuugguaagagccuggaguggauuggcuacauauauccaaauaacgggggaacuggcuacaaucagaaauuugaauccaaggcaacguugaccguagauaacucuucgucaacagccuauauggaguuaagaacucugaccagcgaagacagugcgguguacuauugugucagguccggugcuuacuacuucaauuaucuagugccguacuuugauuauugggggcaaggaacaacccucacuguuucuagc

SEQ ID NO: 27934 - RNA, 372 nt, Artificial Sequence
  derived and/or modified sequence opt3 from anti-influenza_Chain
gaggugcagcugcaacagagcggccccgaacucgucaagccuggggccuccguuaaaaucucuugcaaggcuucaggauacaccuucacagguuauaacaugcacugggugaaacagagucauggcaagagccuugaguggauugggaaaauauacccaaauaacggaguaacuggcuauaaucaggaauuuagauccaaggcaacgcugaccguggacaacucuucgucaacagccuacauggaguugaggagcuuaaccagugaagauuccgcgaucuauuucuguguccggucuggugcuuacuaugugaauuaccugguuccguacuuugacuauugggggcaaggaacuacacuaaccgugagcucc

SEQ ID NO: 27935 - RNA, 375 nt, Artificial Sequence
  derived and/or modified sequence opt3 from anti-influenza_Chain
caggugcaacugguccagagcggcgccgagguuaagaaacccggguccucugugaagguaucaugcaaagcuaguggagugaccagcuccaacuacccuaucacaugggucagacaggcaccaggucagggccucgaauggaugggaggggugcuuccgcuguucggcguuacuaauuaugcccaaaaguuucaggguagggugacgauuucugcggacaaaucgaccaacacagcuuacauggaguugagcucauuacggagugaagauacugccgucuauuacugugcacgcgggaagcgacccggauauugcuccggcggcguguguucuagcgacuacugggggcagggaacccugguaacaguuuccuca

SEQ ID NO: 27936 - RNA, 375 nt, Artificial Sequence
  derived and/or modified sequence opt3 from anti-influenza_Chain
caggugcaacugcaggagagcggccccgggcucgucaagccuucccagacccuuucucugacaugcacuguuucaggagguaguaucagcuccggcacguacuauuggucuuggauuagacaccauccagggaaaggauuggaauggauaggcuacaucuaucacucggguucagccuacuauaacccgagcuuagagaguagggugaccauguccguagacacaucuaagaaucaguucagccugaaacuauccucagugacugcugcagauaccgccauuuacuauugugcgcgggcugaaaaccuccugagucccuaccuugccgagggguuugacccuuggggacaaggcacacuggucaccgugagcucu

SEQ ID NO: 27937 - RNA, 375 nt, Artificial Sequence
  derived and/or modified sequence opt3 from anti-influenza_Chain
gaggugcagcugguccaaagcggcgccgaaguuaagaaacccggggagucccucaagaucucuugccaggcuucaggauacaguuucaccagcagauggauugguugggugaggcagaugccuggcaaagggcuugaauggguaggauuuauauauccauccgacucugaugugcgguacucgccgucauuccgcggccaggucacaaucagcgcagacaagaguauuuccacugccuaucugcaauggucuagcuugaaagcguccgauacggcuauguacuuuugugcccgauuaggugggaacaaggacuauggagauuaccugugguauuucgaccuauggggccguggcgcacucgugaccguuucaagu

SEQ ID NO: 27938 - RNA, 375 nt, Artificial Sequence
  derived and/or modified sequence opt3 from anti-influenza_Chain
caggugcaacuggucgagagcggcgggggaguugugcagcccgguagaucccucaggcuuucuugcgccgcuucaggcuucaccuuuaguagcuacgggaugcacuggguacggcaggcaccuggaaagggccuggaauggguggccgucaucugguaugacggugauaauaaauacuauggggacuccgugaagggacgcuucacaauuucucgagauaauucgaaaaacacuuuguuuuuacagaugaacucacugcgugcggaggacacggcuguuuacuauugugccaaggauaccgcagaccauggcgauuacguggaccuaggcuucuuugaugccugggggcaaggaacacucgucacugugagcagu

SEQ ID NO: 27939 - RNA, 375 nt, Artificial Sequence
  derived and/or modified sequence opt3 from anti-influenza_Chain
gaggugcagcugguccaaagcggcgccgaacucaagaugcccggggagucccuuaaaaucucuugcaaggcuucaggauacaccuucacaaacuauuggauugguuggguuagacagacuccuggcaaagggcuggaauggaugggaauaaucuuuccaccggacagucagacgagcuacucccccucuuuccagggccaagugaccuuuucgguagauaauucaauuagcguggcauauauccaguggaguuccuugaaggccucugacacagcgauuuacuauugugcuaggagcgguaucuucgauugguccgccccuuuagucgaggcauuugacauaugggggcagggaacugugguuaccgugucaagu

SEQ ID NO: 27940 - RNA, 375 nt, Artificial Sequence
  derived and/or modified sequence opt3 from anti-influenza_Chain
gaggugcagcugguccaaagcggcgccgaaguuaagaaacccggggagucccucaagaucucuugcaaaggaucagguuacaguuucagcgacuauuggauuggcugggugagacagaugccuggggaaggacuugaguggaugggcauaaucuacccagcuuccucugaaauuagguauucgccgucauuucagggucugguaaccaucagcgcagauaagaguauuaacacagccuccuugcaguggucuagcuuaaaagcguccgacacugcuaucuacuauugugcccggcacgcaucaugcagugcccgcagcuguuacugggggcccguggauuauuggggacaaggcacgcuggucaccgugucuucc

SEQ ID NO: 27941 - RNA, 375 nt, Artificial Sequence
  derived and/or modified sequence opt3 from anti-influenza_Chain
caggugcaacuggucgagagcggcgggggaguugugcagcccgguagaucccucaggcuuucuugcgccgcuucagaaaucaccuucauuacauacgcaaugcacuggguacggcaggccccuggcaaggggcuggaguggguggcguugauaagugacgauggaagcaauaaauuuuaugcugacuccgucaagggccgcuucacuaucucucgagauaauucgaaaaacacguuauaccugcagaugaacucacuacgugccgaagacaccgcagccuauuacugugcuagagaggguguguauuuugauagcgggacauacaggggauauuucgacuacuggggccaagaaacucucguuaccgugaguucc

SEQ ID NO: 27942 - RNA, 375 nt, Artificial Sequence
  derived and/or modified sequence opt3 from anti-influenza_Chain
caggugcaacugcaggagagcggccccgggcucgucaagccuucccagacccuuucucugacaugcacuguuucaggagguaguaucagcuccggcaacuacuauuggaauugggugagacagcacccagggaaaggauuggaauggauuggcuacauauauuacagggguucuacguucuauaacccgucguuaaagucacggguaaccaucagcauugacacaaguaaaaaucaauuuucccugcgccuaucuagcgugacugccgcugauaccgcagucuacuauugugccaaggacacacgauccucacucgauaacuaccaguacgggauggacguguggggacagggcaccacuguuacagugaguagc

SEQ ID NO: 27943 - RNA, 375 nt, Artificial Sequence
  derived and/or modified sequence opt3 from anti-influenza_Chain
gaggugcagcugcucgaaagcggcgggggacuuguccaacccgguggcucccugagauugucuugcgccgcuucaggguucaguuuuagcaccuacgcaauguccuggguuaggcaggccccuggaaagggcuuagagugggugucugguaucucggggucaggagaaagcacauauuacgcggacaguguaaaaggccgguucacugugucccgcgauaacucuaagaauacgcuguaucuacagaugaacagccuccgagcugaggacaccgccgucuacuauugugcaaaacagggcgaucacauugccuggcugcuucgugggauaaauuuugacuacuggggacaaggugugcugguuacaguguccuca

SEQ ID NO: 27944 - RNA, 375 nt, Artificial Sequence
  derived and/or modified sequence opt3 from anti-influenza_Chain
caggugcaacuggucgagagcggcgggggaguugugcagcccgguagaucccucaggcuuucuugcgccgcuucaggcuucgcauuucacaaucgggccaugcauuggguacgccaggcgccugggaagggacuggaauggguggcuuugaucuacuucgacggcaguaaacaguauuacgccgauagcgucaagggucgauuuaccauuucccgugacaauucuaaaaacacaguguucuuacaaaugaacucgcugagaccagaggauacugcaguuuauuacugugccgugccggggcccauauuuggaaucuucccuccauggucauauuuugaccacuggggccagggcauucuagucacggugagcagu

SEQ ID NO: 27945 - RNA, 375 nt, Artificial Sequence
  derived and/or modified sequence opt3 from anti-influenza_Chain
gaggugcagcuggucgaaagcggcgggggaguugugcaacccgguagaucccucaggcuuucuugcgccgcuucaggcuucgcauuucacaaucgggccaugcauuggguacgccaggcgccugggaagggacuggaguggguggcuuugaucuacuucgacggcaguaaacaguauuacgccgauagcgucaagggucgauuuaccauuucccgugacaauucuaaaaacacaguguucuuacagaugaacucgcugagaccagaagauacugcaguuuauuacugugccgugccggggcccauauuuggaaucuucccuccauggucauauuuugaccacuggggccaaggcauucuagucacggugagcagu

SEQ ID NO: 27946 - RNA, 375 nt, Artificial Sequence
  derived and/or modified sequence opt3 from anti-influenza_Chain
gaggugcagcugguccaaagcggcgggggaguugugcagcccgguaaaucccucagacuuucuugcgccgcuucaggccugaccuucaguagcuacgcaguacacugggugaggcaggccccugggaaaggauuggaaugggucacauuaaucuccuaugacggcgcgaaccaguacuaugcugauucugugaagggucgguuuacuauuucgcgcgacaauucaaagaacacgguuuaccugcaaaugaauagccuacgaccagaggauaccgccguguauuacugugcagucccggggcccguguucggaauauuuccuccauggaguuauuucgacaacuggggccagggcauccucguaacaguuuccucu

SEQ ID NO: 27947 - RNA, 375 nt, Artificial Sequence
  derived and/or modified sequence opt3 from anti-influenza_Chain
caggugcaacuggucgagagcggcgggggaguugugcagcccgguaaaucccucagacuuucuugcgccgcuucaggccugaccuucaguagcuacgcaguacacugggugaggcaggccccugggaaaggauuggaaugggucacauuaaucuccuaugacggcgcgaaccaguacuaugcugauucugugaagggucgguuuacuauuucgcgcgacaauucaaagaacacgguuuaccugcaaaugaauagccuacgaccagaggauaccgccguguauuacugugcagucccggggcccguguucggaauauuuccuccauggaguuauuucgacaacuggggccagggcauccucguaacaguuuccucu

SEQ ID NO: 27948 - RNA, 375 nt, Artificial Sequence
  derived and/or modified sequence opt3 from anti-influenza_Chain
caggugcaacuggucgagagcggcgggggaguugugcagcccgguaaauccccuagacucucuugcgccgcuucaggcccaaccuucaguagcuacgcaguacacugggugaggcaggccccggggaaaggacuugaaugggucacacugaucuccuaugacggcgcgaaccaguacuaugcugauucugugaagggucgguuuacuauuucgcgcgacaauucaaagaacacgguuuacuugcaaaugaauagcuuacgacccgaggauaccgccguguauuacugugcagucccugggccaguguucggaauauuucccccuuggaguuauuucgacaacuggggccagggcauccugguaacaguuuccucu

SEQ ID NO: 27949 - RNA, 375 nt, Artificial Sequence
  derived and/or modified sequence opt3 from anti-influenza_Chain
gaggugcagcuggucgaaagcggcgggggaguugugcaacccgguaaaucccucagacuuucuugcgccgcuucaggccugaccuucaguagcuacgcaguacacugggugaggcaggccccugggaaaggauuggagugggucacauuaaucuccuaugacggcgcgaaccaguacuaugcugauucugugaagggucgguuuacuauuucgcgcgacaauucaaagaacacgguuuaccugcagaugaauagccuacgaccagaagauaccgccguguauuacugugcagucccggggcccguguucggaauauuuccuccauggaguuauuucgacaacuggggccaaggcauccucguaacaguuuccucu

SEQ ID NO: 27950 - RNA, 375 nt, Artificial Sequence
  derived and/or modified sequence opt3 from anti-influenza_Chain
caggugcaacugguccagagcggcgccgagcucaagagacccggggcuuccguuaaagugucuugcaagaccucaggauacaguuucaacaauuaugguaucaacuggguaaggcaggcaccuggccaggggcuugaauggaugggauggauuagcgccuacacaggcaauacucacuaugcgaaaaacuuugagggucgggugacgcugaccacagacacuuccaccucuacagcuuacauggaaguccgcucguugcgaucagaugacagcgccguguauuucugugcacgugccaugauacaagggguugugaccuuauaccugagaccaggagauuauuggggccagggcacucuagucacagugaguucc

SEQ ID NO: 27951 - RNA, 375 nt, Artificial Sequence
  derived and/or modified sequence opt3 from anti-influenza_Chain
caggugcaacugguccagagcggcgccgagguuaagcagcccggggcuuccgugaaaguaucuugcaaggcaucaggauacaccuucaacgccuauuacauccacugggugagacaggcgccuggucaaggccucgaauggaugggguggauuaauccaaacuuuggaggcacacauuaugcuaggaaauuccagggucgggucacuaugacgcgcgacgccaguauaaauaccgcauacauggagcuugaucgacugaucagcgacgauacagccguguauuacuguguucguuggagagcugcagccgugauuauggaccaguuuuauaagauggaugucugggggcagggaacuuuggugaccguauccucu

SEQ ID NO: 27952 - RNA, 375 nt, Artificial Sequence
  derived and/or modified sequence opt3 from anti-influenza_Chain
caggugcaacugguccagagcggccccgagcucaagaaaccuggguccucuguuaaacuuucaugcauggccaccggagguacauucaucaacuacgcuuuuaguugggugagacaggcaccaggccaggggcuggaaugguugggaggcauuauaccgguauaugguacuagcaaucacguggagaaguuacaagggagggucacgaucaccgccgacgcguccacaaacacugcuuacauggaacugucuggacuacgguucgaugacaccgccguguauuuuugugcagccucgacagcuaccucaggcacuuacuaugcaaugcgccccuucgauuuuuggggccaggggacacucguuagcgugaguucc

SEQ ID NO: 27953 - RNA, 378 nt, Artificial Sequence
  derived and/or modified sequence opt3 from anti-influenza_Chain
gaggugcagcuggucgaaagcggcgggggaguugugcaacccgguggcucccucagacuuucuugcaucgccucagcuuucaaccuggggauuuuuggaaugcacuggguaaggcaggcaccuggcaaggguuuggaguggguggccuucauacgguacgacgggggaaaaaccuuuuaugcggauagugucaagggccgcuucacaaucagccgagacaauuccaaaaacacuuuauaccugcagaugaacucucuacguacggaagauaccgcucucuauuacugugccagagacgcaacagccgauuauuacggcccagggucguauccgaauuggcuggaccccuggggacaggguacucuugugaccguuuca

SEQ ID NO: 27954 - RNA, 378 nt, Artificial Sequence
  derived and/or modified sequence opt3 from anti-influenza_Chain
gaggugcagcuggucgaaagcggccccgcccucguuaagccuacccaaacacuuacucugacgugcuccuucucuggguuuucauugaguaccagcggaauguccgugucuuggaucagacagccaccggguaaggcuuuagaguggcuggcacuaauugacugggaugacgauacauacuauauaacuuacucgucaagccucaaaaccaggcugacaaucaguaaagacaccuccaagucucagguagugcuuacuaugacaaacauggaucccgucgacaccgccacguauuacugugcgcggacucugcgcgugagcggcgauuauguucgagacuucgauuugugggggcguggaacccucgugacagucucc

SEQ ID NO: 27955 - RNA, 378 nt, Artificial Sequence
  derived and/or modified sequence opt3 from anti-influenza_Chain
caggugcaacugcaggagagcggccccgggcucgucaagccuuccgaaacccuuucucugacaugcacuguuucaggagguaguaucaacagcuacuauuggaauuggauuagacagccaccgggcaaaggguuggaguggauaggauacaucuaucacuccggcucuacgaacuacaaucccucguuaaagucaagggugaccauuagcguagacacaaguaaaaaccaguucucccugcaacuaucuagcgugacugccgcugauaccgcagucuauuacugugcccggcuccgcacagacuauggugauccugacuccguguacuacuaugggauggauguuuggggacagggcaccacugugacagucucaagu

SEQ ID NO: 27956 - RNA, 378 nt, Artificial Sequence
  derived and/or modified sequence opt3 from anti-influenza_Chain
caggugcaccugguccaaagcggcgccgagguuagaaagcccggggacuccgugaaaguaucuugcaagaccucaggauacacauucaguacuuauccuguggcuugggucaggcaagugccaggucagggccucgaauggaugggguggaucagcacguacaacggaaauaccaacuuugcacagaauuuccagggccggguuacacuuacuaccgauacaaccacuaacacagccuauauggaggugcgcucccugaaauuugacgauaccgcggucuacuauugugcucgaguggaagguucuuaccgugacuucuggaauaaccagaauagauuugauccgugggggcagggaacguugguaacuguuucguca

SEQ ID NO: 27957 - RNA, 378 nt, Artificial Sequence
  derived and/or modified sequence opt3 from anti-influenza_Chain
gaggugcagcuggucgaaagcggcgccgagguuaagaaacccggggcuuccgugaagguaucuugcaaagcaucaggauacaccuucacaaguuuugacaucaacugggugagacaagccccuggucagggccucgaauggaugggguggaugacuccaacgagcggaaagaccggcuaugcgcagaaauuccaggguaggauuacaaugacucggaauaccuccauaaacacagcuuacauggagcuuucuucgcugcgcucagaagauaccgccgucuauuuuugugcacgagggccggagcguagaacuacaaucuucgacgugauuuuggauugguuugaccccuggggacaaggcaccuuaguuacggugagc

SEQ ID NO: 27958 - RNA, 378 nt, Artificial Sequence
  derived and/or modified sequence opt3 from anti-influenza_Chain
caggugcaacugguccagagcggcgccgagguuaagaaacccggguccucugugaagguaucaugcaaagcuaguggagguuucuuuagcuccuacgcaaucucuugggugagacaggccccuggccaggggcucgaauggaugggaggcgucauuccaauauucaggaccgcgaacuaugcucaaaauuuucagggucgggugacaaucacugccgacgaguucacgucguacauggaacuuucaagccugcgcagugaugacaccgcaguuuauuacugugcccgauugaacuaucacgauuccgggacauacuauaaugcuccgcguggaugguuugaccccuggggccagggcacuuuagugaccgucucuagc

SEQ ID NO: 27959 - RNA, 378 nt, Artificial Sequence
  derived and/or modified sequence opt3 from anti-influenza_Chain
caggugcaacugguccagagcggcgccgagguuaagaaacccggguccucugugaagguaucaugcaaagcuaguggaggugcauucagcaacuacgccaucuccugggugagacaggcgccuggccaggggcucgaauggaugggaggcauuauaccaaucuuugguaccacaaauuaugcucaaaaguuccaggggagggucacuauuacggccgacaaauuuaccacaaucgcauacauggagcuucggucucugcgcucggaagauacugccguguauuacugugcucgacacggaggcguuuauuacuauggcucagcaagcagugggugguucgacccguggggacaggguaccuuggugacagucuccucu

SEQ ID NO: 27960 - RNA, 378 nt, Artificial Sequence
  derived and/or modified sequence opt3 from anti-influenza_Chain
caggugcaacugcucgagagcggcgggggagucguuagacccgguaggucccuucggcuggccugcgcuggcucuggguucaccuuuucagcauacgccaugcacugggugcgccaggcgccuggaaagggcuuggaauggguagcucauacaaguuaugacggucgagauagcuacuauguggacuccgucaaagggcguuucacuaucucuagagaugacucgaagaacacguuauaccugcagaugaacucacuaaggccagaggauaccgccguguauuacugugcaaaaguuggaccguauacaggcuacgacgauuacaauuauuacggcauggacgugugggggcacggaacuaccgucacagugagcagu

SEQ ID NO: 27961 - RNA, 378 nt, Artificial Sequence
  derived and/or modified sequence opt3 from anti-influenza_Chain
caggugcaacuggucgagagcggcgggggaguugugcagcccgguggcucccucagacuuucuugcgccgcuucaggguucaacuuugacgaauacguaauguauugggugaggcagaguccuggaaagggccuggagugggucagcuugaucggugcagaugggcggggaaccuacaauuccgacucugugaaaggccgcuucacaauuucgcgagauaaccguaaaaauucauuauaucugcagaugaacagccuaagaagugacgauacugcccucuacuauugugcgaagguugaaagguccuuuuacgacggcucuggguauggagaugcucuggagauauggggucaaggcacgauggugaccgucagcucc

SEQ ID NO: 27962 - RNA, 381 nt, Artificial Sequence
  derived and/or modified sequence opt3 from anti-influenza_Chain
gaggugcagcugcucgaaagcggcgggggacuuguccaccccgguggcucccugagauugucuugcgccgcuucaggguucaccuuuaguaacuacgcaaugagcuggguuaggcaagccccuggaaagggcuuagaguggguguccucuaucaauucgggugggggagcgacauauuacgcugacucaguaaaaggccgguucacuauuagccgcgauaacaguaagaauacgcugucccuacagaugaacucucuccgagccgaagacaccgcaguguauuacugugccaaagagggcgggaauacaauauuuggacuggucacuauggcuuauuacuucgauagcuggggucagggcacccuugugacaguuuccuca

SEQ ID NO: 27963 - RNA, 381 nt, Artificial Sequence
  derived and/or modified sequence opt3 from anti-influenza_Chain
cagccccaacugcaggagagcggcccugggcucgugagaccauccgaaacccuuucucugacaugcacugucucaggagacaguguuacgagggguggcuucuacuggggguggauccggcagccgcccggaaagggcuuggaguggauugguagcauauauuacaacuauaauaucuaccacuccccuucuuuaaaaucgcgcgugucacugagcguagauaccaguaagaaccaggugucccuaaaacucgccucugucacagcugcagacacugccguguauuacugugcgcgacauuauccauacuacgaucugcccaccggguuuuauagccaauucgacuuuuggggacagggcacaccuguuaccguguccuca

SEQ ID NO: 27964 - RNA, 381 nt, Artificial Sequence
  derived and/or modified sequence opt3 from anti-influenza_Chain
ugguggcagcuggugcaaagcggcgccgaggucaagaaacccggguccucuguuaaggugucaugcaaagcuaguggagguaccuucagcuccuacgacaucucuuggguaagacaggcaccuggccaggggcucgaauggaugggaggcauuauaccaaucuaugguacagccaacuacgcgcagaaguuucaagggagggugacuauuacggcugaugagucgaccucaacagccuauauggaacuuagcagucugcgguccgaggacacugcagucuacuauugugcccgcgcuggaggcgauucuagcggcuacuauggggcauugggacgauucuuucagcacuggggucagggcaccuuagugacaguuuccuca

SEQ ID NO: 27965 - RNA, 381 nt, Artificial Sequence
  derived and/or modified sequence opt3 from anti-influenza_Chain
gaggugcagcugguccaaagcggcggggccguugugcagcccggaagaucccucaggcuuucuugcgcugcaucagguuucaccuuuaguaucuacgccaugcacuggguacggcagacaccuggcaaggggcuggaauggguggcguugauuagcuaugacggaaacaauaaauacuaugcugauuccgucaagggccgcuucacuauaucucgagacaacuacaaaaauacguuauaucugcagaugaagggucuacgugccgaggauaccgcacucuacuauugugccagaaggaucacagaaaaaggguacuacaacgacucgggacggccaaauugguuugauccguggggccaaggcacucuggugaccguuuca

SEQ ID NO: 27966 - RNA, 381 nt, Artificial Sequence
  derived and/or modified sequence opt3 from anti-influenza_Chain
caggugcaacugcagcagagcggccccagacucgucaagccuucccagacccuuucucugacaugcgccaucucaggggacaguguuagcggagauuccgguacuuggaacuggauuaggcaaucuccaucgcggggcuuggagugguuagggcgcacguacuaucgaucaaaaugguacaaugacuaugcugaaagcgugaagagucguauaguaaucaaagcagauaccuccaagaacgaguucucucugcagcuaaauagcgugacaccggaagacacugccauuuacuauugugcgagagcuggagucaaaaucuuuggccucauugugggugcccuggauaacugggggaggggaacccuuguuacaguguccuca

SEQ ID NO: 27967 - RNA, 381 nt, Artificial Sequence
  derived and/or modified sequence opt3 from anti-influenza_Chain
caggugcaacugcagcaguggggcgccgggcuccuuaagcccagcgagacccuguccuugacaugcacugucucuggagguucauuaacggacuacaguuggaacuggaucagacagccuccaggcaaagggcuggaauggauuggagauacccuacacaauggcuauacaaacuacaauccgagccucaggggucggguuuccauaucuaucgacacuucgaagaaccaagugucacugcgccuuaccagcguaacagcugcagauaccgcccuguauuacugugcgcgagggaguggaggcuauggcggguucgacuacuuuggaaaauugcguacuugggauuucuggggucagggcacacucgugaccgucuccucu

SEQ ID NO: 27968 - RNA, 381 nt, Artificial Sequence
  derived and/or modified sequence opt3 from anti-influenza_Chain
caggugcaacugguccagagcggcgccgagguuagaaagcccggggaaucccucaggaucucuugccggggaucagguuacaacuucccuaaauauuggauuggcugggugcgccagaugccagggaagggacuugaguggaugggcaugauauacccgggugacagugauguacgauauaaucccagcuuucaggggcaagugaccaucuccgcugacgaaucuauuaacacagcauaccugcaguggucgucauugcguacuagcgauacggccagauauuacugugcgaggcacuuaggacagcagcuggucaguaauaccuauuacuacuauggcauggacguguggggccaagggacaacuguuaccguguccucu

SEQ ID NO: 27969 - RNA, 384 nt, Artificial Sequence
  derived and/or modified sequence opt3 from anti-influenza_Chain
cagauccaacugcaggagagcggccccgggcucgugaagccuucccagacccuuucucugacaugcgccauuucaggagacagugucagcuccaacaaugcuguuuggaacuggauaagacagucuccaucgagggguuuggaaugguuaggccggacuuacuaucgcucaaaaugguacaaugauuaugcagagagcgugaagagucgaaucacgguaaacccggacaccuccaaaaaucaauucucucugcaccuaaagagcgugacacccgaagauacugccgucuuuuacugugugcguuccgggcauauuaccguuuucggagugaacgucgacgcguuugauauguggggccaggguacaauggugaccguaucaagu

SEQ ID NO: 27970 - RNA, 384 nt, Artificial Sequence
  derived and/or modified sequence opt3 from anti-influenza_Chain
caggugcaacugcaggagagcggccccgggcucgucaagccuucccagacccuuucucugacaugcgccaucucaggagacaguguuagcuccaacaaugcuguguggaacuggauuagacagucuccaucgagggguuuggaaugguuaggccggacuuacuaucgcucaaaaugguacaaugauuaugcagagagcguaaagagucgaauaacggugaacccggacaccuccaaaaaucaauucucucugcaccuaaagagcgucacacccgaagauacugccguguuuuacuguguucguuccgggcauaucaccguguucggagucaacguggacgcguuugauauguggggccaggguacaaugguaaccguuucaagu

SEQ ID NO: 27971 - RNA, 384 nt, Artificial Sequence
  derived and/or modified sequence opt3 from anti-influenza_Chain
caggugcaacugcagcagagcggccccgggcucgucaagccuucccagacccuuucucugacaugcgccaucucaggagacagaguuaguagcaacuccgcuguguggaauuggauuaggcaaucuccaucgcgggguuuggagugguuaggccgcacuuacuaucgaucaaaaugguacuaugauuacgcagaaagcguaaagagucguauagugaucgacccggauacguccaaaaaccaggucucucugcagcuaaauagcgugacccccgaggacuccgccauuuauuacugugcgagagggggacacaucacaguuuucggccucaacauugaugcuuaugacaucuggggucagggggccaaggugacugucucaagu

SEQ ID NO: 27972 - RNA, 384 nt, Artificial Sequence
  derived and/or modified sequence opt3 from anti-influenza_Chain
caggugcaacugcagcagagcggccccgggcucgucaagccuucccagacccuuucucugacaugcgccaucucaggagacagaguuaguagcaacuccgcuguguggaauuggauuaggcaaucuccaucgcgggguuuggagugguuaggccgcacuuacuaucgaucaaaaugguacuaugauuacgcagaaagcguaaagagucguauagugaucgacccggauacguccaaaaaccaggucucucugcagcuaaauagcgugacccccgaggacuccgccauuuauuacugugcgagagggggacacaucacaguuuucggccucaacauugaugcuuaugacaucuggggucagggggccauggugacugucucaagu

SEQ ID NO: 27973 - RNA, 384 nt, Artificial Sequence
  derived and/or modified sequence opt3 from anti-influenza_Chain
caggugcaacugcagcagagcggccccgggcucgucaagccuucccagacccuuucucugacaugcgccaucucaggagacagaguuaguagcaacuccgcuguguggaauuggauuaggcaaucuccaucgcgggguuuggaaugguuaggccgcacuuacuaucgaucaaaaugguacuaugauuacgcagaaagcguaaagagucguauagugaucgacccggauacguccaaaaaccaggucucucugcagcuaaauagcgugacccccgaggacuccgccauuuauuacugugcgagagggggacacaucacagaguucggccucaacauugaugcuuaugacaucuggggucagggggccaugguuacugugucaagu

SEQ ID NO: 27974 - RNA, 384 nt, Artificial Sequence
  derived and/or modified sequence opt3 from anti-influenza_Chain
caggugcaacugcagcagagcggccccgggcucgucaagccuucccagacccuuucucugacaugcguuaucucaggagacacugugaguagcaacagagccacguggaauuggaugaggcaauccccauugcgggguuuagaguggcugggccgcaccuacuaucgaucuaaaugguacaacgauuaugcuguaucggugaagucacgugucgugauuaauccggacacaagcaaaaaccagguuagucuacagcucaauacugugacccccgaugacuccggggucuacuucugugcaagaggaggccacauaacaguguuugguguaaacaucgaugccuucgacauuugggggcugggaaccaagguuacugugucuagc

SEQ ID NO: 27975 - RNA, 384 nt, Artificial Sequence
  derived and/or modified sequence opt3 from anti-influenza_Chain
cagguggagcugcaacagagcggccccgggcucgucaagccuucccagacccuuucucugacaugcgccaucucaggagacaguguuagcuccaacucugcuacuuggaauuggauuaggcagucgccaucaagggguuuggaaugguuaggccggacguacuaucgcagcaaaugguacaacgauuaugcagacuuccugaagcgacguauaaccaucaauccggauacaaguaacaaugaggugucccuaagacucacuucuguaacccccgacgauacagcccuguacuauugugcgagagggggacacauuaccguguuuggcgucaacaucgacgcuuucgauguguggggucaagggacuauggccacaguuagcucc

SEQ ID NO: 27976 - RNA, 384 nt, Artificial Sequence
  derived and/or modified sequence opt3 from anti-influenza_Chain
caggugcaacugcagcagagcggccccgggcucgucaagccuucccagacccuuucucugacaugcgccaucucaggagacaguguuagcuccaacucugcuacuuggaauuggauuaggcaaucgccaucaagggguuuggagugguuaggccggacguacuaucgcagcaaaugguacaacgauuaugcagacuuccugaagcgacguauaaccaucaauccggauacaaguaacaaugaagugucccuaagacucacuucuguaacccccgacgauacagcccuguacuauugugcgagagggggacacauuaccguguuuggcgucaacaucgacgcuuucgauguguggggucaggggacuaugguuacagugagcucc

SEQ ID NO: 27977 - RNA, 384 nt, Artificial Sequence
  derived and/or modified sequence opt3 from anti-influenza_Chain
caggugcaacugcagcagagcggccccgggcucgucaagccuucccagacccuuucucugacaugcgccaucucaggagacaguguuagcuccuacaacgcuguguggaauuggauuagacaaucuccaucgagggguuuggagugguuaggccggacuuauuaccgcucagggugguauaacgauuacgcagaaagcguaaaaagucgaauaacgaucaauccggacaccuccaagaaccaguucucucugcagcuaaauagcgugacacccgaggauacugccgucuauuacugugcgcguuccggacacauuaccguguuuggcguuaacguggacgcuuucgauauguggggucaggggacaauggucaccgugucaagu

SEQ ID NO: 27978 - RNA, 384 nt, Artificial Sequence
  derived and/or modified sequence opt3 from anti-influenza_Chain
caggugcaacugcagcagagcggccccgggcucgucaagccuucccagacccuuucucugacaugcgccaucucaggagacaguguuagcuccaacaaugcuguguggaacuggauuagacaaucuccaucgagggguuuggagugguuaggccggacuuacuaucgcucaaaaugguacaaugauuaugcagaaagcguaaagagucgaauaacgaucaacccggacaccuccaaaaaucaguucucucugcagcuaaacagcgugacacccgaggauacugccgucuacuauugugcgcguuccgggcacauuaccguguuuggaguuaauguggacgcuuucgauauguggggccaggguacaaccgucacugugucaagu

SEQ ID NO: 27979 - RNA, 384 nt, Artificial Sequence
  derived and/or modified sequence opt3 from anti-influenza_Chain
agaggccagcuggugcaaagcgggggaggugucguucagcccggcaggucccuccggcuuucuugcgccgcuucaggguucguguuuaacguauucggaauccacugggugcgccaggcaccuggcaagggucuggagugguuggccaccauuaguuacgacggguuaaauaaauauuacgcggauagcgucaagggacgaauaacaaucucccgugacaacucuaaaaauacucuguaucuacagaugaacucgcucagagcugaagauacggccguguacuauuguguuagggacucagaggaaagcaccuacuauggcgauuacauguggguguacaauugguuugaccuguggggccaagggacacuugucacugugagu

SEQ ID NO: 27980 - RNA, 384 nt, Artificial Sequence
  derived and/or modified sequence opt3 from anti-influenza_Chain
caggugcaacugcagcaguggggcagcgggcuccuuaagcccuccgagacccugucuuugacaugcgccgucuacggagguucauucagagacgauuauuggacuuggaucaggcagccuccaggcaaaggguuagaauggauuggagagauaaaccacaguggccggacgaauuacaacccgagccugaagucccgcguuaccaucucuguggacacaucgcuaaaacaauuuucacucaagguaauuagcgugacugcugcagauaccgccgucuauuacugugcgcgagguacaagucaugugucccguuauuucgacuggcugcccccuaccaauugguuugauccaugggggcagggaacucagguuacagugucuagc

SEQ ID NO: 27981 - RNA, 384 nt, Artificial Sequence
  derived and/or modified sequence opt3 from anti-influenza_Chain
caggugcaacugcagcaguggggcgccgggcuccuuaagcccagcgagacccuguccuugucuugcgcugucuucggagguucauuuagugacuacuauuggacauggaucagacagccuccaggcaaaggguuagaauggauuggagagauaaagcacagcggcaggacuaacuacaauccgucccuggaaucucggguuacgaucucgguggauaccagcaaaaaccaauucucacuaaagcucaguuccguaacagcagccgacacugcgauuuauuacugugcucgcgguaccgaucccgacacagagggguauugccgaucuggaagcuguuccgccuuugauuucuggggccagggcacccuggugacugucucaagu

SEQ ID NO: 27982 - RNA, 384 nt, Artificial Sequence
  derived and/or modified sequence opt3 from anti-influenza_Chain
caggugcaacugcagcaguggggcgccgggcuccuuaagcccagcgagacccuguccuugacaugcggagucuacgguggcucuuuaucagacuauuacuggaguuggaucagacagccuccagggaaaggacuggaauggauuggcgagauaaaccacagcggugggacuaauuauaacccgucccuaaagaggcggguuacgaucucuguggauaccucgaaaaagcaauucucacucaaaaugaauagcguaacagcugcagacacugccguguacuauugugcgcgcggaaccgaucccgacacagaagucuacugccgagcuggcaacugugccgcauuugauuucuggggccaggggacccuggugacuguuaguucc

SEQ ID NO: 27983 - RNA, 384 nt, Artificial Sequence
  derived and/or modified sequence opt3 from anti-influenza_Chain
caggugcaacugcaggagagcggccccgggcucgucaagccuucccagacccuuucucugacaugcacuguuucaggagacaguaucagcuccguggaucacuacuggucuuggauuagacagcauccaguaaaagguuuggaauggauaggcuucauguauuacucggccucaacguauuacaacccgagcuuaaagaguagggugaccaucuccacagacacuucuaaaaaucaauuuagccugcggcuauccucagucaccgcugcagauacagccguguauuacugugcgcgcgggaccugcgcuggagacuguagucuccacuauuacuacuauggccuggauguuuggggucaggggcgaacugugacagucagcucu

SEQ ID NO: 27984 - RNA, 384 nt, Artificial Sequence
  derived and/or modified sequence opt3 from anti-influenza_Chain
gagguggcccuggucgaaagcggcgcugagguuaagaaacccggguccucugugaagguaucaugcaaagcaaguggacacaucuucagcgguuacgccauuuccugggugagacaggcgccuggccaagggcucgaauggaugggaggcauaaucccaauuuuugguaccacaaacuaugcucagaaguuccaggggagggucacuaucacggccgaccagucuaccucgacagcauacauggaucuuucaaaucugcggagcgaggacacugccguguauuacugugcucgcguuaaagauggauauugcaccuugacaaguuguccggugggcugguacuuugacuuauggggccgagggacccuggucacuguguccucu

SEQ ID NO: 27985 - RNA, 384 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggacacaucuucagcgguuacgcaauuuccugggugagacaagccccuggccaggggcucgaauggaugggaggcauaaucccaauuuuugguaccacaaacuaugcgcagaaguuccaggggagggucacuaucacggcugaccaaucuaccucgacagccuacauggaucuuucaaaucugcggagcgaggacacugcaguguauuacugugcccgcguuaaagauggauauugcaccuugacaaguuguccggugggcugguacuuugacuuauggggccgagggacccuggucacuguguccucu

SEQ ID NO: 27986 - RNA, 384 nt, Artificial Sequence
  derived and/or modified sequence opt3 from anti-influenza_Chain
caggugcaacugguccagagcggcgccgagguuagaaagcccggggcuuccgugaaaguaucuugcaaggcaucaggauacaccuucacaaggcacgguaucaguugggugcggcaggccccuggccaggggcucgaauggaugggauggauuagcgcguauacuggcgacacggauuacgcucaaaaauuucagggucgcgucaccaugacaacugacaccuccacaaacaccgccuauauggagcuucgaucucugcguucggaugacgcagccguguacuauugugcuagauugagguuacagggggaaguuguggucccaccgucacagagcaauugguucgaucccuggggacaaggcacucuggugacaguaaguucc

SEQ ID NO: 27987 - RNA, 384 nt, Artificial Sequence
  derived and/or modified sequence opt3 from anti-influenza_Chain
caggugcaacuggucgagagcggccccgggcucaugaagccuuccgaaacccuuucucugacaugcacuguuucaggagguagugugagcaacuacuauugguccuggaucagacagccaccgggcaaaggguuggaguggauuggauacguauucuauucuggcucgucaaauuacaaccccagcuuaaauaacccuagucugaaguccagggugacgauaucuaucgacaccagcaauaaccaguuuucccuaaaacucucaagugucacagccgcugauacugcaguguauuacugugcccggggucgcguuaauagcggguaugacuggggaccaaacuucgauucuuggggccagggcgcgcuggugaccgucuccuca

SEQ ID NO: 27988 - RNA, 384 nt, Artificial Sequence
  derived and/or modified sequence opt3 from anti-influenza_Chain
caggugcaacugguccagagcggcgccgagguuaagaaacccggguccucugugaagguaucaugcaaagcuaguggagguaccuucagcuacuaugcaaucuccugggugagacaggccccuggccaggggcucgaauggaugggaggcauuauaccaaucgucgguacagcgcacuacacucaaaaguuucaggggagggugacgauuaccgcugacgagucuacaucgacugccuauauggaacuuucaagccugcggagugaggauaccgcaguuuacuucugugcccgcgcugcagacgaauccguggagucuuugacaaucaaagccuuucgaaccaacuaucauuggggacagggcacuuuagucacagugagcucc

SEQ ID NO: 27989 - RNA, 387 nt, Artificial Sequence
  derived and/or modified sequence opt3 from anti-influenza_Chain
gaggugcagcuggucgaaagcggcgggggagccguucaacccggugagucccucaaacuuccuugcgcugcaucuggcuucaccuuuucaaacuacgggaugcacugggugagacaggccccaggaaagggccuggaauggguagcggugaucaguuaugacgguagcaauaaguacuaugcugauuccgucaaagggagguucacaauuucucgggacaacucgaaggauacuuuguacuuacagaugaacucacugcgcgccgaggacacggcacuauuuuauugugccaaagaacgaccgcuccgucugcuuagauacuucgauuggcugagcggaggcgcuaaugacuauuggggccaggggaccuuggugacaguuaguucc

SEQ ID NO: 27990 - RNA, 387 nt, Artificial Sequence
  derived and/or modified sequence opt3 from anti-influenza_Chain
gaggugcagcuggucgaaagcggcgggggagccguucaacccggugagucccucaaacuuucuugcgcugcaucaggcuucaccuuuaguaacuacgggaugcacugggugagacaggccccuggaaagggccuggaauggguagcggugaucagcuaugacgguuccaauaaguacuaugcugauucugucaaagggagguucacaauuucgcgggacaacucaaaggauacuuuguacuuacagaugaauagccugcgcgccgaggacacggcacuauuuuauugugccaaagaacgaccacuccgucugcuuagauacuucgauuggcugaguggaggcgcuaacgacuauuggggccaggggaccuuggugacaguuuccucu

SEQ ID NO: 27991 - RNA, 387 nt, Artificial Sequence
  derived and/or modified sequence opt3 from anti-influenza_Chain
caggugcaacuggucgagagcggcgggggaguugugcagcccgguagaucccucaggcuuucuugcgccguaucaggcuucaccuuuaguagcuacgcuaugcacugggugcggcaggcaccugggaagggacuggaaugggucgccgugaucuccuaugacggcucuaaccaguacuaugcggauucgguuaaaggucgcuucacaauuucacgagacaauagcaagaacacuuuguacuuacaaaugaauagucugcgugcugaggauacggcccuauauuacugugcaaaagacccaagacucaggcaucugcuuuauuuuccguucaccuccaugauauacuuugauuacugggggcagggaacacuggugacugucucuagc

SEQ ID NO: 27992 - RNA, 387 nt, Artificial Sequence
  derived and/or modified sequence opt3 from anti-influenza_Chain
caggugcaacugguccagagcggcgggggaguugugcagcccgguagaucccucaggcuuucuugcguagccucaggcuucaccuuuaguacauacgcuaugcacugggugcggcaggcaccugggcgcggacuggagugggucgccgugaucagcuaugacgcgaacuacaaguauuacgcugauuccguuaaaggccgauucucuauuucgcgugacaauucacaaaacacuuugcauuuagaaaugaauacgcugagaaccgaggauacagcccuauauuacugugcaaaggacagccagcucaggagucugcuuuauuuugaauggcugucccaggguuacuucgagccaugggggcagggaacuuuggugaccgucacaucu

SEQ ID NO: 27993 - RNA, 387 nt, Artificial Sequence
  derived and/or modified sequence opt3 from anti-influenza_Chain
caggugcaacugguccagagcggcgggggaguugugcagcccgguagaucccucaggcuuucuugcguagccucaggcuucaccuuuaguacauacgcuaugcacugggugcggcaggcaccugggcgcggacuggagugggucgccgugaucagcuaugacggcaacuacaaguauuacgcggauuccguuaaaggucgauucucuauuucgcgugacaauucaaacagcacuuugcauuuagaaaugaauacgcugagaaccgaggauacagcucuauauuacugugccaaggacagucaacucaggucccugcuuuauuuugaauggcugucucagggguacuucgauccauggggacagggcacuuuggugaccgucacaagc

SEQ ID NO: 27994 - RNA, 387 nt, Artificial Sequence
  derived and/or modified sequence opt3 from anti-influenza_Chain
caggugcaacugguccagagcggcgccgagguuaagaaacccggguccucugugaccguaucaugcaaggcuaguggagguacauucagcaacuacggcaucuccugggugagacaggcaccugggcagggacucgacuggaugggcgguauuauaccacuuuuugggacugccaauuaugcgcaaaaauuccagggaagggucacgaucaccgcugaugaaucuacaucgucaagcaacauggagcugaguuccuugcggucugaagacacugccguguacuauugugcacgcgauguucacaauuacgacuuuuuaaccggcuauccgcugcaucuauacggcauggaugugugggggcagggaacaaccgucacugugagcucc

SEQ ID NO: 27995 - RNA, 387 nt, Artificial Sequence
  derived and/or modified sequence opt3 from anti-influenza_Chain
caggugcaacugcaggagagcggccccgggcucgucaagccuuccgaaacccuuucucugaucugcgccguuucaggagcuaguauuagcuccucuuacuggucguggauaagacagccaccggguaaaggcuuggaguggaucggguauauuuacuauucaggagugacaaaguacaaccccagcuuaaaaaguaggguaacucuguccguggacacgucuaagaaucacuucagccuaaaacucuccuaugucaccgcagccgauacagcgguguacuauugugcucggaaccugccugacaucgccguugugacugcaguccaggaugccaccccagugugguuugaccccuggggcccugguacacuuguaucaguuaguagc

SEQ ID NO: 27996 - RNA, 387 nt, Artificial Sequence
  derived and/or modified sequence opt3 from anti-influenza_Chain
gaggugcagcuggucgaaagcggcgggggacucguucaacccgguagaucccuuaggcugucuugcgccgcuucaggcuucaccuuuagugacuucuggaugagcugggugcggcaggcaccugggaagggauuggaguggguagccaacaucgaucaggacggcaaugaacgcuuuuacgcggauuccgugaaaggucgauucacaauuucucgugacaacgcuaaaaauucguuauaucugcagaugacuucacuaagagccgaugacacggcagucuacuauugugccagggaugggcgggagggauacuuuuauggcagcggcaguuucuacaaccucaaggggcugaauuggggacaagguacccuucugacaguguccucu

SEQ ID NO: 27997 - RNA, 387 nt, Artificial Sequence
  derived and/or modified sequence opt3 from anti-influenza_Chain
gaggugcugauggucgaaagcggcgggggacucguucagcccgguggcuccgugagacuuucuugcguagccucaggguucaguuuuagcucccacuggaugaccugggugaggcaagcuccuggaaagggccuggagugggucgcaaacaucgaagacgaugguggggacaaauacuauguggauucuguuaagggacgguucauuauaucgcgcgacaaugccaaaaacucaguguacuugcagaugaauagcuuacgagcggaggauacagcugucuauuuuugugcccguggcaguggcuccucugacagaagcgauuacgacccacauuauuacuauuaccuggaugugugggggaagggagcaacuguaacgguuuccuca

SEQ ID NO: 27998 - RNA, 387 nt, Artificial Sequence
  derived and/or modified sequence opt3 from anti-influenza_Chain
gaggugcagcuggucgaaagcggcggggaccucguucaacccggaagaucccuuaagcugucuugcaccgguucaggcuucacauuuggggauuacggagugacuuggguaaggcaggccccuggcaaagguuuggagugggugggguucauccggacgcgcccauggggaggcaccgcugacacagcagccagugucaagggccgauuuacuauuagccgugaugacuccaaaucuuuagcguaucugcagaugaacucgcuaaagaccgaagauacagcuguguacuauuguugcagagacgccccgcccaauguugagguggcaucaaugaccaacugguacuucgaucucugggggaggggaacucuggucacagugagcagu

SEQ ID NO: 27999 - RNA, 387 nt, Artificial Sequence
  derived and/or modified sequence opt3 from anti-influenza_Chain
gaggugcagcugguccaaagcggcuccgaaguuaagaaacccggggagucucucaagaucucaugcaaaggaagugguuacagcuucuccaacuauuggauuggcugggugagacacaugccugggaagggacuugaauggaugggcauaaucuacccaggugacucugauaccagguauucgccgucauuucaggggcagguaacaaugagcgccgacaaaaguuccucuacuguguaccugcaguggagcuccuugaaggcuucagauacggcaauuuauuacugugcccggcgcggaggccauaguuucggcuaugggagcggaggugacacccacucugaguuugauuccuggggccaagggacauuagucacugugucaagc

SEQ ID NO: 28000 - RNA, 387 nt, Artificial Sequence
  derived and/or modified sequence opt3 from anti-influenza_Chain
caggugcaacugcucgagaccggcgggggacuugucaagcccggucagagccugaaauuguccugcgccgcuucuggcuucacauuuacuucauacgcaaugcacuggguuagacagccuccagggaagggauuagaauggguggccguagugaguuaugacggcaacuacaaauauuacgcggauagcguccaggguagguucacgaucucccgggacaauucuaagaacacccuguaucuacaaaugaacucgcuccgcgcugaggauacagccguguacuauugugcaaaagacucacgacugcguagccuucuguacuuugaaugguugagucagggguacuucaauccguggggacagggcacuacccucacaguuuccucu

SEQ ID NO: 28001 - RNA, 387 nt, Artificial Sequence
  derived and/or modified sequence opt3 from anti-influenza_Chain
caggugcaacuggucgagagcggcgccgaaguuaagaaacccggggcuuccgugaagcucucuugcaccgcaucaggauacaacuucgccgcguauuacauccacuggguaagacaggcuccuggucagggccuugaguggaugggguggaguaauccaaacacaggaggcgccaauuaugcacaggacuuucaagguagggugacuaugacggccgucaccagcacauccacugcuuacauggaacugucucgguugaccucggaugacacagcauuauauuucugugcccgcgugccgcgagaucgucugcuaacccucuacuaugagucaagcacuuacggguuugacuacuggggacagggcacacugguuaccgugaguucc

SEQ ID NO: 28002 - RNA, 387 nt, Artificial Sequence
  derived and/or modified sequence opt3 from anti-influenza_Chain
caggugcaacuggucgagagcggcgggggacucguucagcccgguggcucccuuagacugucuugcaccgugucaggguucacauuuaauaguuacgccaugaauuggguaaggcaggcuccuggaaagggcuuggaaugggugagcgguauccggggguccggagagaacacuuauuacgcagaaacggucaaaggccgcuucaccauuucucgagacaauucgaagaacacauuauaucuggagaugaacucacuacgugccgaagauacugcgguguacuauugugcuagaaaauggggcaggaugaccguuuuugggguggccacagaccagcucuacuauuucgauuacuggggacaagguacccuggucacugugagcagu

SEQ ID NO: 28003 - RNA, 387 nt, Artificial Sequence
  derived and/or modified sequence opt3 from anti-influenza_Chain
caggugcaacuggucgagagcggccccgggcucguuaagccuucccagacccuuucucugacaugcacugugucaggagguaguaucagcaacggcggguaccacugguccuggauuagacagcauccaggaaaaggcuuggaauggauagguaauaucuauuacagggggucuacguucuaugacccgucguuaaagucacggguaaccauuagcguggauacaaguaaaucccaguuuucucugaagcuaacuagcgucaccgccgcugacacagcaguguacuauugugcccgcaugccccucgcgaacuacgaucugcuuaccggacuguauaucggcgcuuucgacuuguggggccaagggacuaugguuacaguguccuca

SEQ ID NO: 28004 - RNA, 387 nt, Artificial Sequence
  derived and/or modified sequence opt3 from anti-influenza_Chain
caggugcaacuggucgagagcggcgccgaaguuaagaaacccggggcuuccgugagaguaucuugcaagggaucagguuacaccuucacagcauaucacaugcauugggugaggcaggccccuggccagggguuugagugggucggauggaucaacccaaauaguggcgcgacuuacuauacgagcaccuucgaaggucgggugacaaugacucgcgacaccuccauuacaaccgcuuacauggagcugucuucgcuucgaucagaugacacugccguuuauuacugugcaacagauauaguggucgaacgugacgccagccucgggggauuuaacaguuauggcauggauguguggggccaggggaccacgguaacuguuuccucu

SEQ ID NO: 28005 - RNA, 390 nt, Artificial Sequence
  derived and/or modified sequence opt3 from anti-influenza_Chain
caggugcaacugcagcaguggggcgccgggcuccuuaagcccagcgagacccuguccuugacaugcgcugucuacggagguucuuucucaguuaguggcuauuacuggagcuggaucagacagccuccagggaggggauuagaauggauuggcgagauaucccacggugggucuacuaacuauaauccgucgcugaaaucacgggugacgaucagcguagacaccacaaagaaccaauuuagucuacgccucuccucugugacugcagccgauaccgcggucuacuauugugcucgaggaacagaccccgauaccgaaguguacugccguguuggcaauugugccgcauucgacuauuggggccaggggagccuggugacugucuccuca

SEQ ID NO: 28006 - RNA, 390 nt, Artificial Sequence
  derived and/or modified sequence opt3 from anti-influenza_Chain
caggugcaacugcucgagagcggccccgggcuugucaagccuucccagacccuguuguuaacaugcacuguuucuggagccucaaucaguacggguggcaacuacuggagcuggauuagacagcacccagggaaagaccuggaauggauaggauauaucuucuacuccggcaccacaaaguauaauccgucuguggauaaccccucgcuaaaaucaaggguaacuaugagcguggacaccagugagaaucaguuuucccucaagcugucuagcgucacagcugcagauaccgccguguacuucugugcgcgggguuccccuaacucaggguaugacuggggaccacauuuugauuacuggggccaaggcacucuuguuacagugaguagc

SEQ ID NO: 28007 - RNA, 390 nt, Artificial Sequence
  derived and/or modified sequence opt3 from anti-influenza_Chain
gaggugcagcuggucgaaagcggcgggcaccucguucaacccggaagaucccuuaggcugucuugcgccgcuucagguuucaccuuugaggacuacgcaaugaacugggugcggcaggccccuggcaagggguuggaauggguaagugugaucagcugggauuccggacgcauuggcuaugcggacucugucaaaggucgauucacaauaucgcgugauaaugcuaagaacucaagcuacuuacagaugaauagucugagaccagaggacacugcccuauauuacugugugagggauaugcucgcauauuacuccgacaacucugggaaaaaguauaauguuuacggaauggauguguggggccagggcacgaccgucacagugagcucc

SEQ ID NO: 28008 - RNA, 390 nt, Artificial Sequence
  derived and/or modified sequence opt3 from anti-influenza_Chain
gaggugcagcuggucgaaagcggcgggggacucguucaacccgguagaucccuuaggcugucuugcgccgugucaggcuucaucuuugaggacuacgcuauuaacuggguacggcaggcaccugggaagggauuggaaugggugaguauaaucagcugggauuccggccgcauugguuaugccgacucuguccgagggcguuucaccaucucgagagauaaugcgaaaaacagcucauuuuuacagaugaauagucugaggccagaggacacagcuguguacuauuguguuaaggauaugcuagccuacuauuacgacggauccggcauucgguauaaccucuacggcauggaugugugggggcagggaacuacggucaccgugucuagc

SEQ ID NO: 28009 - RNA, 390 nt, Artificial Sequence
  derived and/or modified sequence opt3 from anti-influenza_Chain
gaggugcagcuggucgaaagcggcgggggacucguucaacccgguagaucccuuaggcugucuugcgccgugucaggcuucaucuuugaggacuacgcuauuaacuggguacggcaggcaccugggaaguguuuggaaugggugaguauaaucagcugggauuccggacgcauuggcuaugccgacucuguccgaggucguuucaccaucucgagagauaaugcgaaaaacagcucauuuuuacagaugaauagucugaggccagaggacacagcuguguacuauugcguuaaggauaugcuagccuacuauuacgacggguccggcauucgguauaaccucuacggaauggauguguggggccaggggacuacggucaccgugucuagc

SEQ ID NO: 28010 - RNA, 396 nt, Artificial Sequence
  derived and/or modified sequence opt3 from anti-influenza_Chain
cagaucacccugaaggagagcggccccacacucgugaaaccuacucaaacgcuuacccugacaugcgucuucuccggguuuucuuugucaauuacuggaguuagaguggguuggauaaggcagccaccgggcaaggccuuagaauggcuggcucuaaucaguugggacgaugagaaacacuacagccccucccuccagucucggcugaccauuacaaaggacaccucgaaaaaccagguagugcuuacuaugacaaaucuggauccugucgacaccgcaacguauuacugugcccgcucaacugaucgagggcauguguugcguuauuucggauggaugcucccaggcgacgcguuugauguuuggggucaagggaccauggugacagucagcagu

SEQ ID NO: 28011 - RNA, 396 nt, Artificial Sequence
  derived and/or modified sequence opt3 from anti-influenza_Chain
caggugcaacugcaggagagcggccccgggcucgucaagccuuccgaaacccuuucucugacaugcacuguuucaaguggaccaaugagcgacuacuauugguccuggaucagacagccgcccgguaaaggcuuggaguggauugggcacgugucuguaucgcauggaggcaggacgaagucaaacccuagcgugaugagucgggucaccauauccguggaaacaucuaaaaaucaguucagcuuaaagcugacuuccguuaccgccgcugauacagcaguguacuauugugcccgccuaaacuacuaugaccgaucagguuaccacaguccagaugggcccagcaauaacugguuugacccuuggggacaaggcacccucgucacugugucuucc

SEQ ID NO: 28012 - RNA, 396 nt, Artificial Sequence
  derived and/or modified sequence opt3 from anti-influenza_Chain
caggugcaacugguccagagcggcgccgagguuaagaaacccggggcuuccgugaagguaucuugcaaaaccucaggauacacauucacugcauauacgauccacugggugagacaggccccuggucagaggcucgaauggaugggcuggauuaacgcggggaauggacauaccaaguacagucaacgguuuaaaggccgcgucacaauaacucgagacaccagcgcucguacaaccuauauggagcuuagaucccugacuucugaagauacagccuuguacuucugugcaagggguccagagaccuauuacuaugacaagacgaacugguuaaauucgcacccggaugaauacuuucagcauugggggcacggaacucaggugaccguuucaagc

SEQ ID NO: 28013 - RNA, 399 nt, Artificial Sequence
  derived and/or modified sequence opt3 from anti-influenza_Chain
caggugcaacugguccagagcggcuccgagguuaagaaacccggggccucugugaagguaucaugcaaagcuaguggauacaccuucacaaacuaugacaucaauuggauuagacaggcaccuggucagggccucgaauggaugggguggauaaacccaaauagcggaacuacgggcuccgcccaaagguuucagggucgggugaccaucacagucgauacuucuauuaccacaguguacauggagcuuucgucacugcgcagcgacgauaccgcgaucuauuacugugcucgagggcgugaauuguuaagacugcagcacuuccuaacugacagucaguccgagaggcgggauugcuuugacccguggggacaaggcacacucguuaccgugucuagc

SEQ ID NO: 28014 - RNA, 402 nt, Artificial Sequence
  derived and/or modified sequence opt3 from anti-influenza_Chain
gaggugcagcuggucgaaagcggcgggggacucguuaagcccgguggcucccuuagacugucuugcgccgcuucaggguugaguuucuuaaacgcauggaugagcugggugaggcaagccccuggaaaaggccuggaguggguaggucggaucaaguccaauaccgacgggggaacaacugauuacgcggcuccagugaaaggccgcuuuacgauuucucgagacgauucgaagaacacccuauaucuccagaugucaagccugaaaacagaagacacugccgucuacuauuguaccacagauggcccguacagugacgauuuccguuccggguaugcagccagauacagguauuuuggaauggacguguggggucagggcaccacuguuacagugucuagc

SEQ ID NO: 28015 - RNA, 402 nt, Artificial Sequence
  derived and/or modified sequence opt3 from anti-influenza_Chain
gaggugcagcuggucgaaagcggcgggggacucguuaagcccgguggcucccuuagacugucuugcgccgcuucaggguucagcuuuuugaacgcauggaugaguugggugaggcaagccccuggaaaaggcuuagaguggguaggucggaucaaguccaauaccgacgggggaacaacugauuacgcggcuccagugaaaggccgcuucacgauuucucgagacgauucgaagaacacccuguaucuacagaugucaagccucaaaacagaagacacugccgucuacuauuguaccacagauggcccguacagugacgauuuucguuccggguaugcagccagauacagguauuucggaauggacguguggggucagggcaccacuguuacagugucuagc

SEQ ID NO: 28016 - RNA, 402 nt, Artificial Sequence
  derived and/or modified sequence opt3 from anti-influenza_Chain
gaggugcagcuggucgaaagcggcgggggacucguuaagcccgguggcucccuuagacugucuugcgccgcuucaggguugaccuucuuaaacgcauggaugaguugggugaggcaagccccuggaaaaggccuggaguggguaggucggaucaagagcaauacagacgggggaacuacggauuacgcggcuccagugaaaggccgcuuuaccauuucccgagacgauucuaagaacacacuauaucuccagaugucgucacugaaaacugaagacaccgccgucuacuauuguacaaccgauggcccguacagcgacgauuuccguaguggguaugcagccagauacagguauuuuggaauggacguguggggucagggcacuacaguuaccguguccucu

SEQ ID NO: 28017 - RNA, 402 nt, Artificial Sequence
  derived and/or modified sequence opt3 from anti-influenza_Chain
gaggugcagcuggucgaaagcggcgggggacucguuaagcccgguggcucccuuagacugucuugcgccgcuucaggguucaguuuuagcaacgcauggauguccugggugaggcaagccccuggaaaaggcuuggaguggguaggucggaucaagucuaauaccgacgggggaacaacugauuacgcggcuccagugaaaggccgcuucacgauuucgcgagacgauucaaagaacaccuuauaucugcagaugagcagucuaaaaacagaagacacugccgucuacuauuguaccacagauggcccguacuccgacgauuuucguucuggguaugcagccagauacagguauuucggaauggacguguggggucagggcaccacuguuacagugagcucc

SEQ ID NO: 28018 - RNA, 402 nt, Artificial Sequence
  derived and/or modified sequence opt3 from anti-influenza_Chain
gaggugcagcuggucgaaagcggcgggggacucguuaagcccgguggcucccuuagacugucuugcgccgcuucaggguugaccuucaguaacgcauggaugagcugggugaggcaagccccuggaaaaggcuuagaguggguaggucggaucaaguccaauacagacgggggaacuacggauuacgcggcuccagugaaaggccgcuuuaccauuucucgagacgauucgaagaacacacuguaucuacagaugucaagccucaaaacugaagacaccgccgucuacuauuguacaaccgauggcccguacagugacgauuuccguuccggguaugcagccagauacagguauuuuggaauggacguguggggucagggcacuacaguuaccgugucuagc

SEQ ID NO: 28019 - RNA, 402 nt, Artificial Sequence
  derived and/or modified sequence opt3 from anti-influenza_Chain
gaggugcagcuggucgaaagcggcgggggacucguuaagcccgguggcucccuuagacugucuugcgccgcuucaggguucaccuuuaguaacgcauggaugagcugggugaggcaagccccuggaaaaggcuuggaguggguaggucggaucaaguccaauacagacgggggaacuacggauuacgcggcuccagugaaaggccgcuucaccauuucucgagacgauucgaagaacacauuauaucugcagaugucaagccuaaaaacugaagacaccgccgucuacuauuguacaaccgauggcccguacagugacgauuuucguuccggguaugcagccagauacagguauuucggaauggacguguggggucagggcacuacaguuaccgugucuagc

SEQ ID NO: 28020 - RNA, 402 nt, Artificial Sequence
  derived and/or modified sequence opt3 from anti-influenza_Chain
gaggugcagcuggucguuagcggcgggggacucgugaagcccgguggcucccuuagacugucuugcgccgcuucaggguugaguuucuuaaacgcauggaugagcuggguaaggcaagccccuggaaaaggccuggaaugggugggucggaucaaguccaauaccgacgggggaacaacugauuacgcggcuccagucaaaggccgcuuuucuauuucgcgagacgauucaaagaacaugcuauuccuccacaugagcagucugcguacggaggacaccgccguguauuacugugcaacagauggcccguauuccgacgauuuuagaucuggguacgccgcuagguaucgguacuucggaauggacguuuggggucagggcacuaccgugacagucagcucc

SEQ ID NO: 28021 - RNA, 402 nt, Artificial Sequence
  derived and/or modified sequence opt3 from anti-influenza_Chain
gaggugcagcuggucguuagcggcgggggacucgugaagcccgguggcucccuuagacugucuugcgccgcuucaggguugaguuucuuaaacgcauggaugagcuggguaaggcaagccccuggaaaaugucuggaaugggugggccggaucaaguccaauaccgacggugggacaacugauuacgcggcuccagucaaaggacgcuuuucuauuucgcgagacgauucaaagaacaugcuauuccuccacaugagcagucugcguacggaggacaccgccguguauuacugcgcaacagauggcccguauuccgacgauuuuagaucuggcuacgccgcuagguaucgguacuucgggauggacguuuggggacaggguacuaccgugacagucagcucc

SEQ ID NO: 28022 - RNA, 402 nt, Artificial Sequence
  derived and/or modified sequence opt3 from anti-influenza_Chain
gaggugcagcuggucguuagcggcgggggacucgugaagcccgguggcucccuuagacugucuugcgccgcuucaggguugaguuucuuaaacgcauggaugagcuggguaaggcaagccccuggaaaaggccuggaaugggugggucggaucaaguccaauaccgacgggggaacaacugauuacgcggcuccagucaaaggccgcuuuucuauuucgcgagacgauucaaagaacaugcuauuccuccacaugagcagucugcguacggaggacaccgccguguauuacugugcaacagauggcccguauuccgacgauuuuagaucuggguacgccgcuagguaucgguacuucggaauggacguuugggguugcggcacuaccgugacagucagcucc

SEQ ID NO: 28023 - RNA, 402 nt, Artificial Sequence
  derived and/or modified sequence opt3 from anti-influenza_Chain
gaggugcagcuggucgaaagcggcgggggacucguuaagcccgguggcucccuuagacugucuugcgccgcuucaggguucaccuuuuugaacgcauggaugaguugggugaggcaagccccuggaaaaggcuuagaguggguaggucggaucaagagcaauacagacgggggaacuacggauuacgcggcuccagugaaaggccgcuucaccauuucccgagacgauucuaagaacacacuguaucuacagaugucgucacucaaaacugaagacaccgccgucuacuauuguacaaccgauggcccguacagcgacgauuuucguaguggguaugcagccagauacagguauuucggaauggacguguggggucagggcacuacaguuaccguguccucu

SEQ ID NO: 28024 - RNA, 402 nt, Artificial Sequence
  derived and/or modified sequence opt3 from anti-influenza_Chain
gaggugcagcuggucgaaagcggcgggggacucguuaagcccgguggcucccuuagacugucuugcgccgcuucaggguucaccuuuuugaacgcauggaugaguugggugaggcaagccccuggaaaauguuuagaguggguaggccggaucaagagcaauacagacggugggacuacggauuacgcggcuccagugaaaggacgcuucaccauuucccgagacgauucuaagaacacacuguaucuacagaugucgucacucaaaacugaagacaccgccgucuacuauugcacaaccgauggcccguacagcgacgauuuucguaguggcuaugcagccagauacagguauuucgggauggacguguggggacaggguacuacaguuaccguguccucu

SEQ ID NO: 28025 - RNA, 402 nt, Artificial Sequence
  derived and/or modified sequence opt3 from anti-influenza_Chain
gaggugcagcuggucgaaagcggcgggggacucguuaagcccgguggcucccuuagacugucuugcgccgcuucaggguucaccuuuuugaacgcauggaugaguugggugaggcaagccccuggaaaaggcuuagaguggguaggucggaucaagagcaauacagacgggggaacuacggauuacgcggcuccagugaaaggccgcuucaccauuucccgagacgauucuaagaacacacuguaucuacagaugucgucacucaaaacugaagacaccgccgucuacuauuguacaaccgauggcccguacagcgacgauuuucguaguggguaugcagccagauacagguauuucggaauggacgugugggguugcggcacuacaguuaccguguccucu

SEQ ID NO: 28026 - RNA, 414 nt, Artificial Sequence
  derived and/or modified sequence opt3 from anti-influenza_Chain
caggugcaacugcaggagagcggcgggggacucguccagcccggugaaucccuuagacugucuugcguuggcucagggaguagcuucggagaguccaccuugucuuacuaugccgugucguggguaaggcaggcuccuggcaaggguuuagaauggcugucaaucauuaacgcagggggaggcgacauagauuacgccgacagcguggagggccgguuuacaaucagucgcgauaauuccaaagaaacucuauaucuccaaaugacgaaccugcgagucgaggacaccgggguguacuauugugcgaagcacaugucuaugcagcagguugugagcgcuggaugggagcgugccgaucuugucggugacgcauucgauguguggggccaggggacaaugguaacuguuuccuca

SEQ ID NO: 28027 - RNA, 465 nt, Artificial Sequence
  derived and/or modified sequence opt3 from anti-influenza_Chain
cugagcagaaucaaccacuucgagaagauucagauaauccccaaauccucuuggucagaccaugaagccaguagcggcguguccucugcuugcccuuaccaagggaccccaucguuuuucaggaaugucguuuggcucauuaagaaaaacaauacauauccgacuaucaagcggucauacaacaauacgaaccaggaggaucuucugauuuuguggggaauccaccauagcaaugacgcagccgaacagaccaaauuauaucagaaccccacaacuuacauaaguguggguaccuccacacugaaucaacgccuaguaccuaagaucgcgacccgaucuaaggugaacggccagaaugggcguauggacuuuuucuggacuauucucaaaccaaacgaugcuaucaauuuugagagcaacggaaauuucauugcccccgaauaugcauacaagaucgucaaaaag

SEQ ID NO: 28028 - RNA, 564 nt, Artificial Sequence
  derived and/or modified sequence opt3 from anti-influenza_Chain
aacgugcccgaguggagcuacaucgucgaaaaggccaauccugcuaacgaccugugcuauccaggcaauuucaacgauuacgaggaacucaaacaccuucuguccagaauuaaucauuuugagaagauacagaucauuccgaaaucuucauggagugaccacgaagcaagcuccgggguuucuucggccugucccuaucaaggaaccccuucauucuuuaggaacgugguaugguugaucaagaaaaauaacacauacccaacuauuaagcggagcuauaauaacacgaaucaggaggauuuacugauccuaugggguauacaucacaguaacgacgcggcugagcagaccaagcucuaccagaaucccacaacuuauaucuccgugggcaccucuacacugaaccaacgccuugucccuaaaauugccacccgaagcaaggugaaugggcagaacggacguauggauuucuuuuggacuauccugaaaccaaacgacgcaauuaauuucgaauccaacggcaauuuuaucgcccccgaguacgcuuacaagauaguuaaaaag

SEQ ID NO: 28029 - RNA, 609 nt, Artificial Sequence
  derived and/or modified sequence opt3 from anti-influenza_Chain
augcugagaagccucgugcuuaacgagaagcugagggcccgggucuuggaacgcgcugaggaauuuuuacugaauaacaaagcagacgaggaaguuugguuucgagagcuagugcucugcauccugaccuccaauucuucauucauuagugccuacaagagcaugaacuauauacuugauaaaauccuguacauggacgagaaggaaauuuccaucuugcuccaggagucuggcuaucguuuuuacaaucugaaagcgaaguaucuguacagagcuaagaaccucuaugggaaaguaaagaaaacaauuaaggaaaucgccgauaaagaccaaaugcaggcaagggaguucauagccacucacaucuacggaauugguuacaaggaggcuucgcauuucuuacggaaugugggcuaucuggaucuugcaaucauugaccgccacaucuugagauucauaaacaaucuggggauucccaucaagcuaaaaucaaagagggaauaccuccuggccgagagccuucugcggaguauugcuaacaauuugaacguccaggugggacuccuggauuuauuuaucuucuuuaaacagacgaauaccaucguuaag

SEQ ID NO: 28030 - RNA, 615 nt, Artificial Sequence
  derived and/or modified sequence opt3 from anti-influenza_Chain
ggccuguucggggccaucgcuggauuuauugaggguggcuggaccgggaugguggacggaugguacggcuaucaccaucagaacgaacaagguagcggguacgcagccgaucucaaguccacacagaaugcgauagacgagaucacuaacaaagucaauucuguuauugaaaagaugaacacgcaguucaccgcugugggaaaagaguuuaaucaccuugaaaagagaaucgagaaccugaauaaaaagauugaugacggcuucuuggauaucuggacauauaacgccgaguuacugguacuacucgaaaaugagaggacucuggacuaccaugauucaaacgugaagaaucuuuaugaaaaaguccggagucagcugaagaacaaugcaaaagagauaggcaacgggugcuuugaguucuaccacaagugugacaauaccugcauggaaagcgugaaaaacggaacauaugauuaccccaaguacuccgaggaagccaaguugaaccgcgaggaaaucgacgguguuaaacucgagucuacccgaauuuaucaaauccuggcuauuuacucgacuguggcaucaagccugguccucgugguaaguuuaggcgcc

SEQ ID NO: 28031 - RNA, 639 nt, Artificial Sequence
  derived and/or modified sequence opt3 from anti-influenza_Chain
gagaucgugcugacccagagccccggcacacucucccuuucuccuggggaaagagccacucugucaugcagggcuagucaacgggucagcuccuacuuggcaugguaucagcagaagccaggacaggccccgcgcuuacugauuuacggugcgucuacgcgagcugccggcauacccgaccguuucucggggucaggaagcggcaccgauuuuacacuaacuaucaguagacucgagccugaagacuccgcaguuuauuacugucaacaguaugguaggaccccacugacauucgggggaggcaccaaaguggagauuaagcgggccgcugcacccucuguauuuaucuucccuccaagcgaugaacagcuuaaauccggcacugccucaguggucugccuguugaacaauuuuuacccccgcgaggcuaaggugcaguggaaaguugacaacgcccuccaaagugggaauagccaggagucugugacagaacaggauuccaaggacucaaccuauagccugaguucuacgcugacucucuccaaggcggauuacgagaaacacaaggucuacgcaugugaagugacccaucagggauuaagcucgccuguaacaaaaucuuucaacagaggugagugc

SEQ ID NO: 28032 - RNA, 639 nt, Artificial Sequence
  derived and/or modified sequence opt3 from anti-influenza_Chain
gacauccagaugacccaaagccccuccucucugucagccagucucggcgggaacgugacaauuacuugcaaggcuagccaggauauaaauaaauacaucgcaugguaucagcacaagccuggaaaagguccaagacuugucauucauuacacguccacccugcagccgggcauccccucuagguucucggggucaggaagcggcacagacuauaguuuuuccauuucuaacuuggagccugaagauaucgccacuuacuauuguuuacaauacgacauacuguauaccuucggugggggaacaaagcuagagaucaaacgggcggaugcugccccaaccguuagcauuuuucccccuuccucagaacagcucacaaguggcggcgcaagcgugguaugcuuccugaauaacuuuuacccaaaggacaucaaugugaaguggaaaauugaugggucugagcgccagaacggaguccuuaauuccuggacugaccaggauucaaaggacagcaccuacaguaugucuuccacgcugacuuugaccaaagaugaauaugagcgacacaacagcuacacaugugaggccacucauaagaccucgacaucucccaucgugaaauccuucaaucguaacgaaugc

SEQ ID NO: 28033 - RNA, 642 nt, Artificial Sequence
  derived and/or modified sequence opt3 from anti-influenza_Chain
gacauccagaugacccaaagccccuccucucugucagccagugugggcgauagagucacaauuacuugcagggcuagccaggggauauccucuuaccucgcaugguaucagcagaaaccuggaaaaguuccaacgcuucugaucuacgacgccucgaccuugcggucaggugugccgagccgcuucaguggcuccgggucugcgacagauuuuacuuuaaccauuagcucccugcaacccgaggacguagcuacauauuacugucagcgauauaacucagccccuccaaucaccuucggacagggcacucgucuagaaauuaagagagcagccgcucccaguguguuuaucuucccuccaagcgaugagcagcucaaaucugguacagcauccgucgugugccugcuuaauaacuuuuaccccagggaagccaagguucaauggaaaguggacaaugcucugcagucagggaacagccaggagagugucaccgaacaggauucuaaggacuccacguauagcuugucgucuacucucacccuguccaaggccgauuacgagaaacacaagguguacgcgugugagguaacacaucaaggacugucaaguccuguuacuaagagcuucaaucggggcgaaugc

SEQ ID NO: 28034 - RNA, 642 nt, Artificial Sequence
  derived and/or modified sequence opt3 from anti-influenza_Chain
gagaucgugcugacccagagccccggcacacucucccuuucuccuggggaaagagccacucugucaugcagggcuagucaaagcgucuccucuucguacuuggcaugguaucagcagaaaccaggacaggccccgcgguuacugauuuacggugcgucaagccgcgcuacgggcauacccgaccgauucaguggguccggaucuggcaccgauuuuacacuaacuaucagccgucucgagccugaagacuucgccguuuauuacugucaacaguaugguuccucaccaagaaccuuugggggaggcacaaaaguggagauuaagagggcagccgcucccaguguauucaucuuuccuccaagcgaugaacagcugaaaucuggcaccgcauccguggucugccuucugaacaauuucuacccccgggaggccaaggugcaguggaaaguugacaacgcuuugcaaucagggaauagccaggagagugugacugaacaggauucuaaggacuccacauauagccucucgucuacccugacgcuguccaaggccgauuacgagaaacacaaggucuacgcgugugaagugacucaucagggacucucaaguccuguaaccaagagcuuuaaccgcggugagugc

SEQ ID NO: 28035 - RNA, 642 nt, Artificial Sequence
  derived and/or modified sequence opt3 from anti-influenza_Chain
agcuacgugcugacccagcccccuuccgucucuguugccccaggcgagacagcuacugugacgugcgggggaaacaauaucgguucaaagaguguacacugguaucaacagaaaccgggccaggcacccguggucgugauuuacuaugacggggauagaccuagcggaauaccagaaagguucuccggcucuaacucgggugacaccgccacacucacuaucucacggguugaggcgggggaugaagcugacuacuauugucuugugugggauuacaccagcguccauuauguguuuggaacaggcaccaagguaacuguucugggccagcccaaagccaauccuacagugaccuuguucccacccaguuccgaggaauuacaagcaaacaaggccacgcuggucugccuaauuucugacuuuuacccuggggcugugacuguggcauggaaagccgauggaagcccagucaaggcugguguugagaccacaaagccguccaaacagucaaauaacaaguacgccgcgaguagcuaucucucucugacucccgagcaguggaaaucccaccgcucauacagcugucaggugacccaugaaggcaguacaguagagaagaccguggcaccuacggaaugcucu

SEQ ID NO: 28036 - RNA, 642 nt, Artificial Sequence
  derived and/or modified sequence opt3 from anti-influenza_Chain
gacauccagaugacccaaacaagcuccucucugucagccagucucggcgauagagugacuauuagcugcagggcuucccaggacauacggaacuaccuuaauugguaucagcagaagcccgaugggacggucaaacuguugaucuacuauaccucucgcuuacacucgggaguuccuucacgauucagcgacagugguuccggcacagauuacucucugacuauuagcaaccuagagcaagaagaccucgcaaccuauuuuugucagcagacauacacccugccauggacuuucgggggaggcacaaaacuugagaucaagcgugccgaugcggcuccgaccguguccauuuuucccccuucaagugaacagcugacgagcgguggggccucuguagugugcuucuugaauaacuuuuauccaaaggacaucaaugucaaauggaagauagauggauccgagagacaaaacggcgugcucaauucauggacugaccaggauagcaaggacaguaccuacucuauguccagcacacugacucugaccaaagaugaauacgagaggcauaacucguauacaugugaggcaacccacaagacgucuacuucccccaucguuaaaucauucaaucggaacgaaugc

SEQ ID NO: 28037 - RNA, 645 nt, Artificial Sequence
  derived and/or modified sequence opt3 from anti-influenza_Chain
gacggcgugaagccccugauccucagagauugcagcgucgccggguggcuucugggaaacccuaugugugacgaguucauuaauguuccagaaugguccuacauaguggagaaagcuaacccggcaaaugauuugugcuaucccgguaacuuuaaugacuacgaagaguuaaagcaucugcuaucuaggaucaaccacuucgagaaaauucagaucauuccuaagucaaguuggagcgaucacgaagccuccucuggcguaucgucagcguguccauaucaagggacccccagcuuuuuccggaauguggucuggcucaucaaaaagaacaauacauacccuacuauaaagcgcaguuauaacaauacgaaccaggaggaccugcuuauccuguggggcauucaucacuccaaugaugcugccgaacagaccaaauuguaccagaacccaacaacuuauaucucugugggaaccagcacacucaaucaacgacugguucccaagauugcaacccguuccaaagugaacggucagaacgggagaauggacuuuuucuggacuauccugaagccuaaugaugccauaaacuuugagucaaauggaaacuucauugcuccagaauacgcauacaaaaucgucaagaag

SEQ ID NO: 28038 - RNA, 645 nt, Artificial Sequence
  derived and/or modified sequence opt3 from anti-influenza_Chain
gacauccagaugacccaaagccccuccacacugucugccucagugggcgauagagucacuauuacgugcagggcuagucagaccauaaacaauuaccucgcaugguaucagcagaagccugggaaagccccaaaacuucugaucuacaaggcgagcuccuuggagucuggaguuccgucgcgguucucagguagcggcagugggacagaauuuacuuuaaccauuuccucucugcaacccgacgauuucgcuacauauuacugucaggaguauaacaaugacagcccucuaaccuuuggaggcgguacuaagguggaaaucaaacgcacaguagccgcaccauccguguucauuuuucccccuucagaugagcagcucaagagugggaccgccagcgucgugugccugcuuaacaauuucuacccacgagaagcuaagguucaguggaaaguggacaacgcacugcaaucuggaaauucccaggagucagucacggagcaggauagcaaggacaguacuuauucuuuguccagcacccucacacugucgaaagccgauuacgaaaagcacaaaguguacgcuugugagguaacucaucagggccugucuucccccguuaccaagucauuuaaccguggcgaaugc

SEQ ID NO: 28039 - RNA, 645 nt, Artificial Sequence
  derived and/or modified sequence opt3 from anti-influenza_Chain
agcgugcugacccagcccccuuccgccucuggcucaagagggcaaaguaucacaauuagcugcacuggauccacgucugacauagguucguacaacuaugucucaugguaccagcagcacccaggcaccgcuccgaagguuauccucuaugaggugagccagaggcccagugggguaccugaucgguucuccggaucuaaaagcggcaauacagcauuucuuacuguguccggucugcaagccgaagacgaggcggauuacuauugugcuucauacgccgggaacaauauuuaugucuucggaaguggcaccaaggugacaguuuugggccagccaaaagcaaaccccaccgugacuuuauuuccuccaagcucugaggaacugcaggccaauaaggcuacccuagucugccucaucuccgacuucuaccccggggcagugacaguagccuggaaagcugauucaagcccuguuaaggccggaguggaaacgacuaccccaaguaagcagucuaacaauaaauacgcggcauccagcuaucugucgcuuacaccggagcaauggaagucucauaaauccuacucaugucaggucacucacgaggguaguaccguggaaaagacaguggcccccaccgagugcagc

SEQ ID NO: 28040 - RNA, 645 nt, Artificial Sequence
  derived and/or modified sequence opt3 from anti-influenza_Chain
agcgcccugacccagcccccuuccgcuucuggcucaagagggcaaaguaucacaauuagcugcacuggauccacgucugacauagguucguacaacuaugugucaugguaccagcagcacccaggcaccgcaccgaaggucauccucuaugagguuagccagaggcccaguggggugccugaucgguucuccggaucuaaaagcggcaauacagccuuucuuacuguauccggucugcaagcggaagacgaggcugauuacuauugugccucauacgcagggaacaauauuuauguguucggaaguggcaccaaggucacaguguugggccagccaaaagccaaccccaccguuacuuuauuuccuccaagcucugaggaacugcaggcuaauaaggcaacccuagugugccucaucuccgacuucuaccccggggccgucacaguggcuuggaaagccgauucaagcccuguaaaggcgggaguugaaacgacuaccccaaguaagcagucuaacaauaaauacgcagccuccagcuaucugucgcuuacaccggagcaauggaagucucauaaauccuacucaugucaggugacucacgaggguaguaccgucgaaaagacaguggcucccaccgagugcagc

SEQ ID NO: 28041 - RNA, 648 nt, Artificial Sequence
  derived and/or modified sequence opt3 from anti-influenza_Chain
cagagcgugcugacccaacccccuuccgagucugucucaccaggccagacagccaguguuacuugcagcgggcacaagcucggagacaaauacguguccugguaucagcagaagccgggucaaucucccguacuucugaucuaccaggauaacagaaggccuucgggcauuccagaacgguucauagggucaaauagcggaaacacggcuaccuugacaaucaguggcacucaggcauuagacgaggccgauuauuacugucaggcgugggacuccucuaccgcuguguuuggugggggaacaaaacugaccguccuaggcgccgcagccggccaacccaaggcugcaccuagcgugacucucuucccacccuccucagaggaacugcaggccaauaaagcuacacuuguuugccugauuagugauuuuuauccuggggccgugaccgucgcguggaaggcagacagcucuccagugaaggccggaguagaaacgacuaccccguccaaacagucaaacaauaaguacgcugccagcaguuauuugucucucacacccgagcaguggaaaucccaucgcagcuacucgugucaaguuacucacgaggguucuaccguggaaaagacagucgcaccuaccgagugcucc

SEQ ID NO: 28042 - RNA, 648 nt, Artificial Sequence
  derived and/or modified sequence opt3 from anti-influenza_Chain
cagagcgcccugacccaacccgcuuccgugucuggcucaccugggcagaguaucacaauuagcugcacuggaacguccucugacgucgguucguacaaccucguuucaugguaucagcagcacccaggcaaggcaccgaaacuuaugauauacgaggugagcaagagacccagugggguauccaauagguucucuggaagcaaauccggcaacaccgccucacugacaaucagugguuugcaagcggaagaugaggcugacuauuacugucauuuauauguggggagcucuaauugggucuuuggaggcggcacuaagcuggccgugcuagggcagccuaaagcagccccauccguuacccucuuucccccuucaagcaaggaacugcaggcuaacaaggcaacacuugugugcccaauuagugauuucuaccccggagccgucaccguggcuuggaaagccgacucuuccccuguaaaggcggguguugagacuacaaccccaagcaaacagucgaauaacaaguaugcagccucuuccuaccugucauugacgccggaacaauggaaaagucacaagagcuacuccugucaggugacucaugagggcucuaccgucgagaagacaguggcucccacugaaugcagc

SEQ ID NO: 28043 - RNA, 648 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguugacuccaaccuggccugguaccagcagaagccagggcaggcgccgcgguuguuaguguauucugcuucgacgcgcgccaccgguauucccgcacgauucucaggaagcggcagugggacagaguuuacucuggccauauccucucuacaaagcgaagauuucgcuguauacuauugucagcacuacaccaauuggccuccacgucucacauuuggaggcgguuccaaaguggagaucaagagaaccgucgcagcccccucaguguucauuuuuccuccaagugacgaacagcugaaaagcgggacugcuucuguugugugccuucugaacaauuucuaucccagggaggccaagguccaguggaaaguggauaacgcguugcaauccggaaauucacaggagagcguaacagaacaggacaguaaggauucuaccuacucccucagcucgacgcugacucugucuaaggcagacuaugagaaacauaagguuuacgccugugaagugacccaccagggccucuccucaccugucacaaaaaguuuuaaccggggcgagugc

SEQ ID NO: 28044 - RNA, 648 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguuucccacaaccuggccugguaccagcagaagccagggcaggcgccgcgguuguuaguguauucugcuucgacgcgcgccaccgguauucccgcacgauucucaggaagcggcagugggacagaguuuacucuggccauauccucucuacaaagcgaagacuucgcuguauacuauugucagcauuacaccaauuauccuccacgucucacauuuggaggcgguuccaaaguggagaucaagagaaccgucgcagcccccucaguguucauuuuuccuccaagugaugaacagcugaaaagcgggacugcuucuguugugugccuucugaacaauuucuaccccagggaggccaagguccaguggaaaguggacaacgcguugcaauccggaaauucacaggagagcguaacagaacaggauaguaaggacucuaccuauucccucagcucgacgcugacucugucuaaggcagauuacgagaaacacaagguuuacgccugugaagugacccaucagggccucuccucaccugucacaaaaaguuuuaaccggggcgagugc

SEQ ID NO: 28045 - RNA, 648 nt, Artificial Sequence
  derived and/or modified sequence opt3 from anti-influenza_Chain
gagaucgugaugacccagagccccgccacacuguccgucucuccuggcgaaagagcuacucucucaugcagggcaagucaaagcguugacuccaaccuugccugguaccagcagaagccagggcaggcgccgcggcuguugguguauucugcuucgacgcgcgccaccgguauucccgcacgauucucaggaagcggcagugggacagaguuuacuuuagccauauccucucugcaaagcgaagauuucgcuguauacuauugucagcacuacaccaauuggccuccacgucuaacauuuggaggcgguuccaaaguggagaucaagagaaccgucgcagcccccucaguguucauuuuuccuccaagugacgaacagcucaaaagcgggacugcuucuguugugugccugcuuaacaauuucuaucccagggaggccaagguccaguggaaaguggauaacgcgcugcaauccggaaauucacaggagagcguaacagaacaggacaguaaggauucuaccuacuccuugagcucgacgcucacucugucuaaggcagacuaugagaaacauaagguuuacgccugugaagugacccaccagggccuguccucaccugucacaaaaaguuuuaaccggggcgagugc

SEQ ID NO: 28046 - RNA, 648 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguuuccucuaaccuggccugguaccagcagaaaccagggcaggcgccgcgguuguuaguguauucggcuucaacgcgcgccaccgguauucccgcacgauucagcggaaguggcuccgggacagaguuuacucuggccauaucuagccuacaauccgaagacuucgcuguauacuauugucagcacuacaccaauuggccuccacgucucacauuuggaggcgguucaaaaguggagaucaagagaaccgucgcagcccccaguguguucauuuuuccuccaagcgaugaacagcugaaaucugggacugcuuccguugugugccuucugaacaauuucuaucccagggaggccaagguccaguggaaaguggacaacgcguugcaaucaggaaauagccaggagaguguaacagaacaggauucuaaggacuccaccuacagccucucgucuacgcugacucuguccaaggcagauuaugagaaacauaagguuuacgccugugaagugacccaccagggccucucaaguccugucacaaagagcuuuaaccggggcgagugc

SEQ ID NO: 28047 - RNA, 648 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguugaccacaaccuggccugguaccagcagaagccagggcaggcgccgcgguuguuaguguauuccgcuucuacgcgcgccaccgguauucccgcacgauucucgggaucaggcagcgggacagaguuuacucuggccauaaguucccuacaaucugaagauuucgcuguauacuauugucagcauuacaccaauuggccuccacgucucacauuuggaggcgguagcaaaguggagaucaagagaaccgucgcagcccccuccguguucauuuuuccuccaucagacgaacagcugaaaagugggacugcuagcguugugugccuucugaacaauuucuaucccagggaggccaagguccaguggaaaguggauaacgcguugcaaucuggaaauucccaggagucaguaacagaacaggacagcaaggauaguaccuacucucucuccagcacgcugacucugucgaaggcagacuaugagaaacacaagguuuacgccugugaagugacccaucagggccucucuuccccugucacaaaaucauuuaaccggggcgagugc

SEQ ID NO: 28048 - RNA, 648 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguuucccacaaccuggccugguaccagcagaagccagggcaggcgccgcgguuguuaguguauucugcuucgacgcgcgccaccgguauucccgcacgauucucaggaagcggcagugggacagaguuuacucuggccauauccucucuacaaagcgaagacuucgcuguauacuauugucagcauuacaccaauuggccuccacgucucacauuuggaggcgguuccaaaguggagaucaagagaaccgucgcagcccccucaguguucauuuuuccuccaagugaugaacagcugaaaagcgggacugcuucuguugugugccuucugaacaauuucuaucccagggaggccaagguccaguggaaaguggacaacgcguugcaauccggaaauucacaggagagcguaacagaacaggauaguaaggacucuaccuacucccucagcucgacgcugacucugucuaaggcagauuaugagaaacacaagguuuacgccugugaagugacccaucagggccucuccucaccugucacaaaaaguuuuaaccggggcgagugc

SEQ ID NO: 28049 - RNA, 648 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguuucccacaaccuggccugguaccagcagaagccagggcaggcgccgcgguuguuaguguauucugcuucgacgcgcgccaccgguauucccgcacgauucucaggaagcggcagugggacagaguuuacucuggccauauccucucuacaaagcgaagacuucgcuguauacuauugucagcauuacaccaauuuuccuccacgucucacauucggaggcgguuccaaaguggagaucaagagaaccgucgcagcccccucaguguuuauuuucccuccaagugaugaacagcugaaaagcgggacugcuucuguugugugccuucugaacaauuuuuaucccagggaggccaagguccaguggaaaguggacaacgcguugcaauccggaaauucacaggagagcguaacagaacaggauaguaaggacucuaccuacucccucagcucgacgcugacucugucuaaggcagauuaugagaaacacaagguuuacgccugugaagugacccaucagggccucuccucaccugucacaaaaaguuucaaccggggcgagugc

SEQ ID NO: 28050 - RNA, 648 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguugacuccaaccuggccugguaccagcagaagccagggcaggcgccgcgguuguuaguguauucugcuucgacgcgcgccaccgguauucccgcacgauucucaggaagcggcagugggacagaguuuacucuggccauauccucucuacaaagcgaagauuucgcuguauacuauugucagcacuacaccaauuuuccuccacgucucacauucggaggcgguuccaaaguggagaucaagagaaccgucgcagcccccucaguguuuauuuucccuccaagugacgaacagcugaaaagcgggacugcuucuguugugugccuucugaacaauuuuuaucccagggaggccaagguccaguggaaaguggauaacgcguugcaauccggaaauucacaggagagcguaacagaacaggacaguaaggauucuaccuacucccucagcucgacgcugacucugucuaaggcagacuaugagaaacauaagguuuacgccugugaagugacccaccagggccucuccucaccugucacaaaaaguuucaaccggggcgagugc

SEQ ID NO: 28051 - RNA, 648 nt, Artificial Sequence
  derived and/or modified sequence opt3 from anti-influenza_Chain
gagaucgugcugacccagagccccgccacacucuccgucucuccuggcgaaagagcuacucuuucaugcagggcaagucaaagcguugacuccaaccuggccugguaccagcagaagccagggcaggcgccgcgguuguuaguguauucugcuucgacgcgcgccaccgguauucccgcacgauucucaggaagcggcagugggacagaguuuacucuggccauauccucucuacaaagcgaagauuucgcuguauacuauugucagcacuacaccaauuauccuccacgucucacauuuggaggcgguuccaaaguggagaucaagagaaccgucgcagcccccucaguguucauuuuuccuccaagugacgaacagcugaaaagcgggacugcuucuguugugugccuucugaacaauuucuaccccagggaggccaagguccaguggaaaguggauaacgcguugcaauccggaaauucacaggagagcguaacagaacaggacaguaaggauucuaccuauucccucagcucgacgcugacucugucuaaggcagacuacgagaaacauaagguuuacgccugugaagugacccaccagggccucuccucaccugucacaaaaaguuuuaaccggggcgagugc

SEQ ID NO: 28052 - RNA, 648 nt, Artificial Sequence
  derived and/or modified sequence opt3 from anti-influenza_Chain
gagaccacacugacucagagccccgccacgcucuccgugucuccuggcgaacgggcuacccuuucaugcagggcaagucaagucaucagccacaaccuggccugguaccagcagaagccagggcaggcgccgcgguuguuaauuuauggagcuuccacacgcgccucugguauacccgcacgauucucgggcucagggagcggaacugacuacacccugacaaucaccagucuacaauccgaggauuuugccguuuauuacugucagcauuauucuaauuggccuccacgucucacuuucggcggugggacaaaaguggaaauuaagagaaccguagcugcacccagcguguuuaucuucccuccauccgacgagcagcugaaaucaggaacggccagugucgugugccuucugaacaauuuuuaccccagggaagcuaagguucaguggaaaguggauaacgccuugcaaagcggcaauucucaggaguccgucacugagcaggacucaaaggauagcaccuauagucucucuuccacacugacucugagcaaggcggacuacgaaaaacacaagguguacgcaugugagguaacccaucagggccucucgucuccuguuacaaaauccuucaacagaggggaaugc

SEQ ID NO: 28053 - RNA, 648 nt, Artificial Sequence; identical to SEQ ID NO: 23934
  derived and/or modified sequence opt3 from anti-influenza_Chain

SEQ ID NO: 28054 - RNA, 648 nt, Artificial Sequence
  derived and/or modified sequence opt3 from anti-influenza_Chain
gagaucgugcugacccagagccccgccacacucuccgucucuccuggcgaacgggcuacucuuucaugcagggcaagucaaguuauuagccacaaccuggccugguaccagcagaagccagggcaggcgccgcgguuguuaauauauggagcuuccacgcgcgccucugguauccccgcacgauucucgggcucagggagcggaaccgacuacacacugacuauuaccagucuacaaccugaggauuuugccguguauuacugucagcauuauuccaauuggccaccccgucucacauucggcggugggaccaaaguagaaaucaagagaacuguggcugcaccuucugucagcauuuuuccacccuccgacgagcagcugaaaucaggaacagccagugugguuugccuucugaacaauuucuacccuagggaagcuaaggugcaguggaaagucgauaacgccuugcaaagcggcaauucucaggaguccgugaccgagcaggacucaaaggauagcacguauagucucucuuccacucugacccugagcaaggcggacuacgaaaaacacaagguauacgcaugugagguuacacaucagggccucucgucuccagugacuaaauccuuuaacagaggggaaugc

SEQ ID NO: 28055 - RNA, 648 nt, Artificial Sequence
  derived and/or modified sequence opt3 from anti-influenza_Chain
gagaucgugaugacccagagccccgccacacuguccgucucuccuggcgaacgggcuacucucucaugcagggcaagucaaguuauuagccacaaccuugccugguaccagcagaagccagggcaggcgccgcggcuguugauauauggagcuuccacgcgcgccucugguauccccgcacgauucucgggcucagggagcggaaccgacuacacauuaacuauuaccagucugcaauccgaggauuuugccguguauuacugucagcauuauucuaauuggccuccacgucuaacauucggcggugggaccaaaguagaaaucaagagaacuguggcugcacccagcgucuuuauuuucccuccauccgacgagcagcucaaaucaggaacagccagugugguuugccugcuuaacaauuuuuaccccagggaagcuaaggugcaguggaaagucgauaacgcccugcaaagcggcaauucucaggaguccgugaccgagcaggacucaaaggauagcacguauaguuugucuuccacucucacccugagcaaggcggacuacgaaaaacacaagguauacgcaugugagguuacacaucagggccugucgucuccugugacuaaauccuucaacagaggggaaugc

SEQ ID NO: 28056 - RNA, 648 nt, Artificial Sequence
  derived and/or modified sequence opt3 from anti-influenza_Chain
gagaucgugcugacccagagccccgccacacucuccgucucuccuggcgaacgggcuacucuuucaugcagggcaagucaaguuauuagccacaaccuggccugguaccagcagaagccagggcaggcgccgcgguuguuaauauauggagcuuccacgcgcgccucugguauccccgcacgauucucgggcucagggagcggaaccgacuacacacugacuauuaccagucuacaauccgaggauuuugccguguauuacugucagcauuauucuaauuucccuccacgucucacauuuggcggugggaccaaaguagaaaucaagagaacuguggcugcacccagcgucuucauuuuuccuccauccgacgagcagcugaaaucaggaacagccagugugguuugccuucugaacaauuucuaccccagggaagcuaaggugcaguggaaagucgauaacgccuugcaaagcggcaauucucaggaguccgugaccgagcaggacucaaaggauagcacguauagucucucuuccacucugacccugagcaaggcggacuacgaaaaacacaagguauacgcaugugagguuacacaucagggccucucgucuccugugacuaaauccuuuaacagaggggaaugc

SEQ ID NO: 28057 - RNA, 648 nt, Artificial Sequence
  derived and/or modified sequence opt3 from anti-influenza_Chain
gagaucgugcugacccagagccccgccacacucuccgucucuccuggcgaacgggcuacucuuucaugcagggcaagucaaguuauuagccacaaccuggccugguaccagcagaagccagggcaggcgccgcgguuguuaauauauggagcuuccacgcgcgccucugguauccccgcacgauucucgggcucagggagcggaaccgacuacacacugacuauuaccagucuacaauccgaggauuuugccguguauuacugucagcauuauucuaauuacccuccacgucucacauucggcggugggaccaaaguagaaaucaagagaacuguggcugcacccagcgucuuuauuuucccuccauccgacgagcagcugaaaucaggaacagccagugugguuugccuucugaacaauuuuuaucccagggaagcuaaggugcaguggaaagucgauaacgccuugcaaagcggcaauucucaggaguccgugaccgagcaggacucaaaggauagcacguacagucucucuuccacucugacccugagcaaggcggacuacgaaaaacacaagguauaugcaugugagguuacacaucagggccucucgucuccugugacuaaauccuucaacagaggggaaugc

SEQ ID NO: 28058 - RNA, 648 nt, Artificial Sequence
  derived and/or modified sequence opt3 from anti-influenza_Chain
gagaucgugcugacccagagccccgccacacucuccgucucuccuggcgaaagaguuacucuuucaugcagggcuagucaaagcguggcaaacaaucuggccugguaccagcagaagccagggcaguccccgcgguuguuaauuuauggagcgucuacgcgcgacaccgguauacccgcucgauucucgggcucagggagcggaacagaguuuacucugaccaucaguucccuacaaucugaagauuucgccguauacuauugucagcaguacaacaauuggccuccaauguauacauuuggccaggguaccaaacucgagauuaagcguacuguggcagcccccagcgucuucaucuuuccuccauccgacgaacaacugaaaucagggacagcuagugugguuugccuucugaacaauuucuaccccagagaggcaaaggugcaguggaaagucgauaacgccuugcagagcggaaauucucaggaguccgugaccgaacaagacucaaaggauagcacguauagucucucuuccacucugacccugagcaaggcugacuacgagaaacacaagguauacgccugugaaguuacacaucagggccucucgucuccugugacuaaauccuuuaacaggggcgagugc

SEQ ID NO: 28059 - RNA, 648 nt, Artificial Sequence
  derived and/or modified sequence opt3 from anti-influenza_Chain
gacaucgugaugacccagagccccuccacacugucugccucagucggcgauagaguuacuauuacgugcagggcuagucaaagcauagggaacuggcucgcaugguaccagcagaagccuggaaaagccccaaaacuucugaucuauaagguguccaccuuggagucugguguaccgucgcgguucucaggcagcgggaguggaacagaauuuacuuuaaccauuaauucccugcagcccgacgauuucgcgacauacuauugucaacgcuacaccucuaacagccagggcuuuacuuucggucaggggacaaagcuagagaucaaacgaaccguggcugccccuuccgucuuuauuuucccacccucagacgaacagcucaagaguggaacggcaagcgugguuugccugcuuaauaacuuuuauccucgugaggccaaggugcaauggaaagucgauaaugcucugcagucuggcaacucccaggaaucagugacugagcaggacagcaaggauaguaccuacucuuuguccagcacacucacucugucgaaagcagacuaugagaagcacaaaguauacgccugugaaguuacccaucaaggccugucuuccccagugacaaagucauucaauagaggggagugc

SEQ ID NO: 28060 - RNA, 648 nt, Artificial Sequence
  derived and/or modified sequence opt3 from anti-influenza_Chain
gacauccagcugacccaaagcccccucuccccuccagugacacuuggccagccggccucuauuucaugcagaaguagccagucccuguuguacacugauggguucacguauuuaucuugguaccaccagaggcccggacaaucgccucggcgccugauauauaagaucucaaaccgagacagcggugucccagaucguuuuaguggcuccgggucuggaaccgacuucacacuaaaaauuagcagaguugaggcugaagaugugggcguauacuauuguaugcaggcaacucauuggccccucaccuuuggugaggggacaaagguggaaaucaaaccuaaggccgcgccauccgucacccuguuucccccuucaagugaggaacuucaggcuaauaaagccacucuggugugcuugauuagcgacuucuacccaggagcaguuacaguggccuggaaggcugauucuuccccggucaaggcaggcguggagaccacgacucccucaaaacagagcaacaauaaguaugccgcuaguucuuaccucucccugaccccugagcaauggaaaagccacaagucguacucuugucagguaacacaugaaggcuccacuguugagaaaaccguggccccaacagaaugcuca

SEQ ID NO: 28061 - RNA, 648 nt, Artificial Sequence
  derived and/or modified sequence opt3 from anti-influenza_Chain
gagaucgugcugacccagagccccggcacacucucccuuucuccuggggaaagagccacucugucaugcagggcuagucaaagcguccgguccaacaauuuggcaugguaccagcacaagccaggacaggccccgcgcuuacugauuuucggugcgucuucgcgagcuacgggcauacccgaccguuuuucagggagcggaaguggcaccgauuucacacuaacuaucuccagacucgagccugaagacuuugccguuuauuacugucagcaauaugguucuagcccagcacugaccuucgggggaggcacaaaaguggagauuaagaggaccguagccgcucccuccguguuuaucuucccuccaucagaugaacagcuuaaaaguggcacugcaagcgucgugugccuguugaacaauuuuuacccccgggaggccaagguucaguggaaaguggacaacgcucuccagucuggaaauucccaagagucagucacagaacaggauagcaaggacaguaccuauucucuguccagcacgcugacucucucgaaggccgauuacgagaaacauaagguguaugcgugugaaguaacccaccagggguuaucuuccccuguuacaaaaucauucaaccgcggugagugc

SEQ ID NO: 28062 - RNA, 648 nt, Artificial Sequence
  derived and/or modified sequence opt3 from anti-influenza_Chain
cagagcgugcugacccaacccccuuccgccucuggcucaagagggcagaguaucacaauuagcugcacuggauccacgucugacauagguucguacaacuaugucucaugguaccagcagcacccaggcaccgcuccgaagguuauccucuaugaggugagccaaaggcccagugggguaccugaucgguucuccggaucuaaaagcggcaauacagcauuucuuacuguguccggucugcagaccgacgaugaagccgacuacuauugugcgucauacgcugggaacaauauuuaugucuucggaaguggcacaaaggugaccguuuugggccagccaaaagccaaccccacugugacauuauuuccuccaagcucugaggaacugcaggcaaauaaggccacccuagucugccucaucuccgauuucuaccccggggcugugacgguagcauggaaagccgacucaagcccuguuaaggcuggaguggagacuaccacaccaaguaagcaaucuaacaauaaauacgccgcguccagcuaucugucgcuuacuccggaacaguggaagucucauaaauccuacucaugucaggucacccacgaggguaguacaguggagaagaccguggcacccacggaaugcagc

SEQ ID NO: 28063 - RNA, 651 nt, Artificial Sequence
  derived and/or modified sequence opt3 from anti-influenza_Chain
cagcccgugcugacccaaccuccaagcgccuccggcucuccggggcagagagucacaaucucaugcaguggaagcuccucuaacauugguucguacacuguuaauugguaucagcagcuccccggcacggcuccuaaacuucugauauacucauugaaccaaaggccaagcggggugcccgaccgguucaguggauccaagucuggcaccagcgcauccuuagccaucucaggucugcagagugaggaugaagcgguauauuacugugcugccugggacgauagccuaucugcacacguggucuuugggggaggcacaaagcucacugugcugggccagccuaaagccgcuccauccguuacccuuuuucccccuucaagcgaggaacugcaggcaaauaaggccacauuggugugccucauuagugacuucuauccaggggcugucaccguggccuggaaagcggauucuuccccgguaaaggcaggaguugagacuacaacccccagcaagcaaucgaacaauaaauacgccgcuucuuccuaucugucacugacgccugaacaguggaagagucaucgcagcuacuccugucaggugacucacgaggguucuaccgucgagaaaacaguggccccaacugaaugcagc

SEQ ID NO: 28064 - RNA, 651 nt, Artificial Sequence
  derived and/or modified sequence opt3 from anti-influenza_Chain
cagcccgugcugacccaaccuccaagcgccuccggcacaccggggcagagagucacuaucucuugcucaggaaguagcuccaacauugguucuaauacgguuucgugguaccaacaggugcccggcaccgcuccuaagcuccuuauauaugggaacaaugagaggccaucaggaguacccgaccgguucagcggcaguaaauccgcaacaucugccagccuggcgaucuccgguuugcagucagaagaugaggcugacuacuauugugccgcaugggaugacaguuuaaacggguuuuggguguucggaggcggcacuaagcugaccguccuagggcagccuaaagccgcuccaagcgugacacucuuucccccuucuuccgaggaacugcaggcaaauaaggccacccuuguuugccugauuucagauuucuacccaggagcugugacugucgccuggaaagcggacagcaguccggugaaggccgguguagaaacaaccacgcccucuaagcaguccaacaauaaauaugcagcuagcucguacuugucucucacuccugagcaauggaagucccacaaaucauauaguugucagguuacccaugagggcagcacaguggaaaagacugucgccccaaccgagugcucc

SEQ ID NO: 28065 - RNA, 651 nt, Artificial Sequence
  derived and/or modified sequence opt3 from anti-influenza_Chain
agcuacgugcugacccagcccccuuccgucucuggcacaccagggcaaagaguuaucauuucaugcaguggauauagcuccaacauagguucuaauacugugaacugguaccagcaguucccgggcacggcccccaggcuccuuaucuaugcuaauaaccagcggccuccagggguacccgaccgcuuuucgggaucaaagagcggcaccagugcaucccuggccauuucugguuugcaaagcgaugacgaguccgauuacuauugugcggcuugggacgauucauuaaaugggcacuggguguucggaggcggcacaaaacugacuguccuagggcagccuaaggccgcaccaagugugacccucuuucccccuagcucugaggaacugcaggccaacaaagcuacacuuguuugccugaucuccgacuucuacccaggagcagugaccgucgccuggaaggcugauucaagcccggugaaagccgguguagaaacuacaacccccaguaagcagucuaauaacaaguaugcggcauccagcuacuugucgcucacgccugagcaauggaaaucucaucgauccuacucaugucagguuacucacgaaggcaguaccguggagaagacagucgccccaacugagugcagc

SEQ ID NO: 28066 - RNA, 654 nt, Artificial Sequence
  derived and/or modified sequence opt3 from anti-influenza_Chain
agcuacgugcugacccagcccccuuccgucucuguugccccaggccaaacagcuagaaucacuugcgggggaaacaauauugguucaaagagugugcacugguaucagcagaaaccgggccaggcacccguacucguggucuacgacgauagcgacaggccuuccgggauaccagagcgguucucuggaucgaacucaggcaauacggccacccuuacaaucagccgcguggaagcgggugaugaggcugacuauuacugucaaguuugggauaguuccucugaccaugccguguuugggggaggcacucagcugaccgucuugggcgcagccgcugggcagcccaaggcagccccuagcgugacauuauucccacccuccucagaggaacugcaggcuaacaaagccacccuaguaugccucauuagugauuuuuauccuggagcgguuacuguggcauggaaggccgacagcucuccagucaaagcugguguggaaacaaccacgccguccaagcaaucaaauaacaaguacgccgcaagcaguuaucugucucuuacucccgagcaguggaaaucccaccgaagcuacucgugucaggugacccaugagggcucuacagucgaaaagacuguugcuccuaccgagugcucc

SEQ ID NO: 28067 - RNA, 654 nt, Artificial Sequence
  derived and/or modified sequence opt3 from anti-influenza_Chain
cagagcguggucacccaacccccuuccguuucuguggccccaggccagacagcuagaaucacuugcgggggaaacaauauugguucaaagaguguacacugguaccagcagaaaccgggccaagcacccgugcuggucguguaugacgauagcgacaggccuuccgggauaccagagcgguucucuggaucgaacucaggcaauacggccacccucacaaucagccgcguugaagcgggugaugaggcugacuacuauugucaggugugggauaguuccucugaccauuacgucuuugggacuggaaccaaggugacaguacuuggcgccgcagccggccagcccaaagcugcaccuagcguuacccuguucccacccuccucagaagaguugcaggccaacaaggcuacuuuagugugccugauuagugauuuuuauccuggggccgucacaguggcguggaaagcagacagcucuccagugaaggccggagucgaaaccacgacuccguccaagcaaucaaauaacaaauacgcugccagcaguuaucuaucucucacccccgagcaguggaagucccaccgaagcuacucgugucagguuacacaugaggguucuacuguggagaaaaccguagcaccuacagaaugcucc

SEQ ID NO: 28068 - RNA, 654 nt, Artificial Sequence
  derived and/or modified sequence opt3 from anti-influenza_Chain
cugagcagaaucaaccacuucgagaagauucagauaauccccaaguccucuuggucagaccaugaagccaguagcggcguguccucugcuugcccuuaccaagggaccccaucguuuuucaggaaugucguuuggcucauuaagaaaaacaauacauauccgacuaucaagcggucauacaacaauacgaaccaggaggaucuucugauuuuguggggaauccaccauagcaaugacgcagccgaacagaccaaauuauaucagaaccccacaacuuacauaaguguggguaccuccacacugaaucaacgccuaguaccuaagaucgcgacccgaucuaaggugaacggccagaaugggcguauggacuuuuucuggacuauucucaaaccaaacgaugcuaucaauuuugagagcaacggaaauuucauugcccccgaauaugcauacaagaucgucaaaaagggcgauuccgccauagugaaaucagagguugaguaugguaacuguaacacaaagugccagaccccuauuggggcuaucaauaguagcaugccauuucacaacauucauccccugacgaucggagaauguccuaaguacgugaaaucuaauaaacuuguccuggcaacuggcuugagaaacuccccacuc

SEQ ID NO: 28069 - RNA, 657 nt, Artificial Sequence
  derived and/or modified sequence opt3 from anti-influenza_Chain
agcuccgagcugacccagcccccuucugccucaggcacaccagggcaaagagugacuaucaguugcagcggauccacgucuaacauugguuacaauccggucucgugguaucagcagguucccggcaccgcuccuaagcuccuuauauacucaaacacagaaaggccaagcggggugcccgaccgguucaguggauccaaaucuggcacuagcgcaucccuggccaucucagguuugcagagugaggaugaagcggacuauuacugugcugccugggaugacaccuuaaaugggccuguauuuggaggcggcacaaaggugaccguccuggggcaacgcacuguggcagccccaagcguuuucauuuuucccccuucugaugagcagcuaaaauccggaacagcuucaguggucugccuccugaacaauuucuauccacgagaagcaaaggugcaguggaaaguagacaacgcccuucagagcgguaauagucaagagucuguuaccgagcaggauuccaaggacagcacguacucgcugucuuccacuuugacccucucaaaggcugauuaugaaaaacacaagguguacgccugugaggucacacaucagggccugaguagcccggugacuaaauccuuuaaccguggggaaugc

SEQ ID NO: 28070 - RNA, 657 nt, Artificial Sequence; identical to SEQ ID NO: 23950
  derived and/or modified sequence opt3 from anti-influenza_Chain

SEQ ID NO: 28071 - RNA, 660 nt, Artificial Sequence
  derived and/or modified sequence opt3 from anti-influenza_Chain
agcuacgugcugacccagcccccuuccgccucuggcacaccagggcaaagagucacuaucucaugcaguggaagcacguucaacauugguuccaaugcuguugacugguauaggcagcucccgggcaccgcacccaaacuucugauauacucuaacaaucagcggccuucgggggugccagaucgcuuuucaggaagccgaaguggcacauccgccucuuuggcgaucagcgguuuacaguccgaggacgaagcugauuauuacugugccgcaugggacgauauucugaacguacccguguucgggggaggcacuaagcuaaccguccucggcgccgcugcagggcaaccuaaggccgcuccaucagugacacuguuucccccuaguagcgaggaacuucaggccaauaaagcgacccugguuugcuugaucucugacuucuauccaggagcagugacugucgccuggaaggcugauuccucaccggugaaagccgguguagagacaaccacgcccagcaagcagaguaacaauaaguacgcagcuucuuccuaucucagccugacuccugaacaguggaaaucgcaccguucuuacuccugucaaguuacccaugagggcucaacaguggagaagacugucgccccaaccgaaugcagu

SEQ ID NO: 28072 - RNA, 660 nt, Artificial Sequence
  derived and/or modified sequence opt3 from anti-influenza_Chain
cagagcgcccugacccaacccgcugcaguguccggcucuccugggcagucaaucacaauuaguugcacuggaacgagcuccgacgucgguggcuacaacuauguuucuugguaccagcagcacccagggaaggccccgaaacucaugauauaugaggugucgaauagacccucaggaguaagcaacagguucaguggcuccaagucugguaauaccgcgagccuuacaaucuccgggcugcaagcugaagaugaggccgacuacuauuguucaaguuacacuucuagcuccaccuauguguuuggaacaggcaccaaagucacuguguugggcgcagccgcugggcagccuaaggcagccccaucaguuacauuauuucccccuagcagugaggaacugcaggcuaacaaagccacccuagugugccucauuucugauuucuacccaggagcggucacgguggcauggaaggccgacuccagccccguaaaggcugguguugaaacuaccacaccuucgaaacagucuaauaacaaguacgccgcauccucauaucugagucuuacuccagagcaauggaaaagccaucgguccuacucuugucaggugacccacgagggcagcacagucgaaaagaccguggcuccgacggagugcuca

SEQ ID NO: 28073 - RNA, 660 nt, Artificial Sequence
  derived and/or modified sequence opt3 from anti-influenza_Chain
agcuacgugcugacccagcccccuuccgucucuggcacaccagggcaaagaguuacuaucucaugcaguggaagcagguccaacgugggugacaauucuguauauugguaccagcacgugccggagauggcccccaagcuccuugucuauaaaaacacgcagcggccuucgggcgugccagcucgcuucucagggagcaagaguggaaccuccgcaucucuggccauuauaggcuugcagagcggugaugaagcggacuacuauuguguugcuugggaugacuccguggauggguacgucuuuggaucaggcacaaaagugacuguauuaggcgccgcagccgggcaacccaaggcugcaccuaguguuacccuguucccacccagcucugaggaacuacaggccaauaaagcuacacucgugugccugaucuccgacuuuuauccuggagccgucaccguggcguggaaggcagauucaagcccagugaaggccggugucgagacuacaaccccgaguaaacagucuaacaauaaguacgcugccuccagcuaccuuucgcugacgcccgaacaguggaaaucucaucgauccuauucaugucaaguuacucacgagggcaguaccguggagaagacaguagcaccuacugaaugcagc

SEQ ID NO: 28074 - RNA, 660 nt, Artificial Sequence
  derived and/or modified sequence opt3 from anti-influenza_Chain
agcuacgugcugacccagcccccuuccgccucuggcacaccagggcaaagagucacuaucucaugcaguggaagcuccucuaacauugguucgaauuauguuuacugguaucagcagcucccgggcacggcucccaaguugcugauauacagggacgggcagcggccuucaggagugccagaucgcuucagcggcaguaaauccgguaccucugcaagccuugccaucuccggguuacgaucagacgaugaggcggacuauuacugugcuacaugggaugacaaccugaguggacccguauuuggcggcgggacuaagcuaaccgugcucggagccgcagccggucaaccuaaagcugcaccaagcgucacacuguuucccccuucuuccgaggaacuucaggccaauaaggcuacccuggugugcuugauuucagauuucuauccaggcgccguuacuguggcguggaaagcagacagcaguccggucaaggccgggguggaaacaaccacgcccucuaagcaguccaacaauaaauacgcugccagcucguaccucucucugacuccugagcaguggaagucccaccguucauauaguugucaaguaacccaugaaggaagcacaguugagaaaacuguggcaccaaccgagugcucc

SEQ ID NO: 28075 - RNA, 660 nt, Artificial Sequence
  derived and/or modified sequence opt3 from anti-influenza_Chain
cagagcgcccugacccaacccgcuuccgugucuggcucaccugggcagaguaucacaauuagcugcacuggaacguccucugacgucgguggcuacaacuauguuucgugguaccagcagcacccagggaaggcaccgaaacucaugauauaugaggugucaaauagacccagcggaguaaguaacagguucuccggcucuaagagcgguaauaccgccucccuuacaaucucagggcugcaagcggaagaugaggcugacuacuauuguaguagcuacacuucuuccucaaccuugguguuuggaacaggcaccaaagucacuguguuaggcgccgcagccgggcagccuaaggcugcaccaagcguuacacuguuucccccuaguucugaggaacuacaggccaacaaagcuacccucgugugccugauuuccgauuucuauccaggagccgucacgguggcguggaaggcagacagcucgcccguaaaggccgguguugaaacuaccacaccuucuaaacaguccaauaacaaguacgcugccucaaguuaccuuagccugacuccagagcaauggaaaucccaucggucuuauagcugucaggugacccacgagggcucaacagucgaaaagaccguggcaccgacggagugcagu

SEQ ID NO: 28076 - RNA, 660 nt, Artificial Sequence
  derived and/or modified sequence opt3 from anti-influenza_Chain
accgugcugacacagcccccuagcgucuccggcgccccagggcaaagaguuacuaucucuugcacgggaucaaguagcaacauuggugcuggcuacgacgugcacugguaucagcagcucccggggaccgcacccaagcuccugauauacggaaauuccaacaggccuucuggcguaccagaucgguucucggguucaaaaagcgggacaagugccacuuugggaaucaccggcuuacagacaggcgacgaggcggauuauuacugugggaccugggacuccucucugagcgcuuauguguuuggaacugguacaaaggucaccgugcuaggcgccgcagccgggcaacccaaagcugcaccuuccguuacgcuuuucccacccucaagugaggaacugcaggccaauaaggcuacucuugugugccugauuagcgauuuuuacccuggagccgucaccguggcguggaaagcagacucuuccccaguaaaggccggcguugaaacaacuaccccgucaaagcagagcaacaauaaauaugcugccaguucuuacuugucccucacacccgagcaguggaaaagccaucgcucguacucuugucaagugacccacgaagguuccacggucgagaagacuguggcaccuacagagugcuca

SEQ ID NO: 28077 - RNA, 663 nt, Artificial Sequence
  derived and/or modified sequence opt3 from anti-influenza_Chain
cagagcgugcugacccaacccccuuccgucucugccgcuccaggccagaagguuacaaucucaugcagugggagcuccucuaacauuggaaaugacuacgugucgugguaucagcagcucccggguacugcacccaaacuucugauauacgauaacaauaagagaccuucaggcaucccagacagguucagcgggaguaaauccggaacgucugccaccuugggcauuacagguuuacaaacuggggaugaggcgaacuauuacugugcuaccugggaccggcgccccacagccuauguaguguuuggaggcggcaccaagcugacuguccuaggggcagccgcuggacagccuaaagcagccccaagcgugacacucuuucccccuuccucagaggaacugcaggcuaauaaggccacccuuguuugccugaucagugauuucuacccaggugcggugacggucgcauggaaggccgacagcucuccggugaaagcuggcguagaaacuaccacacccuccaagcagucaaacaauaaauaugccgcaagcaguuacuugucucucacuccugagcaauggaagucccaccgaagcuacucgugucagguuacccaugaagggucuacaguggagaaaaccgucgcuccaacggagugcucc

SEQ ID NO: 28078 - RNA, 675 nt, Artificial Sequence
  derived and/or modified sequence opt3 from anti-influenza_Chain
auggugggcuucacccccgucgcccuggcugcacucgccgcgacaggggcucuugccuuuccugcaggaaacgccacugagcuggaaaagagacagacgaccccaaauagcgaggguuggcacgacggcuacuauuacuccugguggucugaugggggagcucaagcaacauauacuaacuuggaaggcgguaccuacgagaucucauggggagacgggggcaauuuaguuggcgggaaaggauggaacccgggucugaaugccagggcuauucauuucgaaggcguguaucagcccaacgggaauaguuaccuagccguauauggauggacacggaacccucucguggaguacuacauagucgagaauuuuggcaccuaugauccaagcuccggugcgacugaccuggggacaguggaaugcgauggaucuaucuaccgccuuggcaagaccacgcgaguuaacgcacccucgauugacggcacucagaccuucgaucaguauuggucagugcgucaagacaaaagaacaagcgggacuguccagaccggaugucacuuugaugccugggcuagggccggucugaaugugaacggcgaccauuacuaucagaucguagcaacagagggguacuucaguuccggauaugcucggauuaccguugccgaugugggc

SEQ ID NO: 28079 - RNA, 687 nt, Artificial Sequence
  derived and/or modified sequence opt3 from anti-influenza_Chain
agaagcgacaagacccacacaugucccccuugcccagccccggagcugcucggcgggcccuccguguuccuuuuuccuccaaaacccaaggauacucugaugaucucuaggacgccugaaguuaccugcgucgugguagacgugucacaugaggauccagaagucaaauucaacugguacguggacggaguugaggugcacaaugcuaagacaaaaccccgggaagaacaguauaacaguacuuaccgcgucgugagcguauugaccguuuuacaucaggauuggcugaaugguaaggaguauaaguguaaaguguccaacaaggcacuaccugccccaauugagaaaacaauaucuaaggcgaaaggccagccgcgagagccccaggucuacacccucccuccaucgcgugaagagaugacuaagaaucaggugucacugacaugccuugugaagggguuuuaucccagcgacaucgcugucgagugggaaaguaacggacaaccugagaauaacuacaaaaccacgccacccguucuggauuccgacggcucuuucuuuuuguauagcaagcucacuguggauaaauccagauggcagcaggguaauguauucucauguagugugaugcacgaagcccugcauaaccacuacacccaaaagagccugucucucuccccggggaaa

SEQ ID NO: 28080 - RNA, 696 nt, Artificial Sequence
  derived and/or modified sequence opt3 from anti-influenza_Chain
cacgcccaggacauccuggagaagacccauaacggcaaacucugcgaucuugacggggugaagccccugauuuugagagauuguagcgucgcuggaugguuacuggguaauccuaugugcgacgaguucauaaacguuccagaaugguccuacaucguggaaaaagcaaauccggccaacgaucuauguuaucccggcaauuuuaacgacuacgaggaacucaagcaucugcuuucuaggauuaaucacuucgagaaaauccaaauuaucccuaagucaaguuggagcgaucacgaggcguccucugggguaucgucagcuugcccauaucagggaacacccagcuuuuuccggaacguggucuggcugauaaagaaaaauaacacuuacccuacgaucaagcgcaguuauaauaacaccaaucaggaagacuugcucauucuguggggcauccaucacuccaacgaugccgcagagcagacaaaacuguaccaaaauccaacuaccuauauuucuguggguacaagcacccucaaccagcgauuaguucccaagaucgccacucguuccaaagugaacgggcagaauggaagaauggacuuuuucuggacaauacugaagccuaacgaugcuauuaauuuugaaucaaacggcaauuucaucgcaccagaguacgccuacaagauugucaaaaag

SEQ ID NO: 28081 - RNA, 699 nt, Artificial Sequence
  derived and/or modified sequence opt3 from anti-influenza_Chain
augagacccagcauccaguuccugggccuccuucuguuuugguugcacgggggacaaugcgacauucagaugacccaguccccuucuucauuaagugccagccuggguggcaacgugacaauaacuuguaaggcuucccaggauaucaauaaauacauugcaugguaucaacauaagccagggaaaggaccgaggcuagucauccacuacacgucuacccuccagcccggcauuccuucgcgguucucagguagcgggaguggaacagacuauuccuuuucuaucagcaaccuggagccagaagauauagccacuuacuauugccuucaguacgacauccuguauaccuucggcggcgggacaaaguuggagauuaaacgcgcggaugcugcccccaccguuuccaucuuuccuccaucaagugaacagcucacuagcggaggugcaucugugguauguuuccugaauaacuuuuaccccaaggacauuaaugugaaguggaaaaucgauggcuccgagcgacaaaacgggguccucaauucauggacagaccaggauagcaaggacaguaccuacucuauguccagcacgcugacuuuaaccaaagaugaauaugagcgucauaacucguacacaugcgaggccacucacaagaccucuacauccccuauagugaaaucauucaauagaaacgaaugu

SEQ ID NO: 28082 - RNA, 702 nt, Artificial Sequence
  derived and/or modified sequence opt3 from anti-influenza_Chain
augaugagcuccgcccaguuccugggccuccuucuguugugcuuucaagggaccagaugugacauccagaugacacagacuucuucaaguuuaagcgcuucccugggagauagggugacgauuucuugccgggcaucgcaggacauacgcaacuaccuaaauugguaucaacagaaacccgaugguaccgucaaacuccugaucuacuauacaucacgacuucacagcggcguuccuagucguuucuccgacucugggagcggaacugauuacucccugaccauuucaaacuuggagcaggaagaccucgccacauauuuuugucagcaaaccuacacucugccauggacauucggcggugggaccaagcuggagaucaaaagagcggaugcugccccgacggugaguauuuuucccccuagcucugaacagcucacuuccggaggcgcaucaguagugugcuucuuaaauaacuuuuauccaaaggacaucaaugucaaauggaagauagauggcagcgagaggcagaacggggugcugaauaguuggaccgaccaggauucuaaggacuccacauacagcaugucgucuacucuuaccuugacaaaagaugaauacgagcggcauaacuccuauaccugugaggccacgcacaagacuucaacaagucccaucguuaagagcuucaaucgcaacgaaugc

SEQ ID NO: 28083 - RNA, 702 nt, Artificial Sequence
  derived and/or modified sequence opt3 from anti-influenza_Chain
auggaggcccccgcucagcuccuguuccuucuguuguuauggcugccugacaccacaggcgaaaucgugcuaacucaaagcccagcaacgcucucccugucuccgggggagagagccacccuuucaugcagggcgagugaaaacauuuggaauaaccuggcuugguaccagcagaagcccggacaggccccucgguugcucauaagcggugcauccacaggcgccacuggggucccaucucgcuuucgaggaucgggcucacguaccgaguucacacugaccaucagcagucugcaauccgaagauuuugcuauuuauuucugucagcaguacaauucuuggcccagaacuuuugguccugggacaaaaguugagaucaagaggaccguggcagccccaagcguauucauuuuucccccuuccgacgagcagcucaaaucaggaacggcuaguguggucugcuuacugaacaauuucuauccacgggaagccaaggugcaauggaaaguugauaacgcgcuucagagcggcaauucucaggaguccgugacugaacaggacucaaaggauagcaccuacaguuugucuuccacacugacucuaagcaaggcagacuaugagaaacacaaggucuacgccugugaggugacccaucaaggccucucgucuccgguaacaaaauccuuuaaccgcggggaaugc

SEQ ID NO: 28084 - RNA, 705 nt, Artificial Sequence
  derived and/or modified sequence opt3 from anti-influenza_Chain
auggagacccccgcccagcuccuguuccuucuguuguuauggcugccugacacaacuggcgaaaucgugcuaacgcaaagcccagggacccucucccugucuccgggagagagagcuacacuuucaugcagggcaagucagagccuguccucuucgucauuggucugguaccagcagaagcccggucaagccccucggcuccugauuuauggcgcgagcagucgcgcuacugggauaccagaucgauuuuccggaucuggcagcgguaccgacuucacacugaccaucucccgucucgaacccgaggauuuugccguuuacuauugucagcaguacgggaacucaccuuauacuuucggacagggcacacaaguggaaauuaaaagaaccguagcagccccaaguguguuuaucuuucccccuagcgacgagcaguuaaagucuggcacggcuuccgucgugugccugcuuaauaacuucuacccaagggaggcaaaaguucaguggaagguggauaaugccuugcagucagggaacagccaagaaagugucacugagcaggacucuaaagauuccaccuauagccugucgucuacacuaacucucuccaaggcugacuacgaaaagcacaaaguguacgccugugagguaacccaucagggacugucaaguccgguuacaaagagcuucaaucggggugagugc

SEQ ID NO: 28085 - RNA, 705 nt, Artificial Sequence
  derived and/or modified sequence opt3 from anti-influenza_Chain
auggagacccccgcccagcuccuguuccuucuguuguuauggcugccugacacaacuggcgaaacggugcuaacccaaagcccagggacacucucccugucuccgggagagagagcuacucuuucaugcagggcaagucagagcgucuccaucucuuaccuggccugguaucagcggaagcccggucaggcgccucgcuugcucauuuacggcgcuucgcgacgugccaccgggauaccagauagauuuucaggaagcggcagugguacagacuucacccugacuaucuccaggcuggaacccgaggauuuugcaguuuauuacugucaacaguaugggucuagcccuuacacauucggacagggcaccaaacucgaaauuaagcggacgguggccgcuccauccguauuuaucuuucccccuucagacgagcaguuaaaaaguggcacugcaagcguggucugccugcuuaacaauuucuauccacgcgaggccaaggugcaauggaaaguugauaacgcuuugcagucuggaaauucccaggaaucagugaccgagcaggacagcaaggauaguacauacucucuguccagcacucuaacccucucgaaggccgacuacgaaaaacacaaggucuaugcgugugaggugacacaucaagggcugucuuccccgguaaccaaaucauucaacagaggugagugc

SEQ ID NO: 28086 - RNA, 705 nt, Artificial Sequence
  derived and/or modified sequence opt3 from anti-influenza_Chain
auggccuggaugaugcugcuccuuacccuguugauccacugcacaggcagcugggcucaguccguguuaacucaacccccuucugucucagcagccccagggcagaagguuacgauuaguuguagcggauccucuucgaacauagguaaaaauuacgugucaugguaucagcagcugccgggcaccgcgcccaagcuacucaucuacgacaacgauaaaagaccuagcgggauuccagacagguucaguggauccaagucuggcacaagcgcuacucuggguaucaccgggcuucaaacaggagaugaggccgacuaucauugcggcgcaugggauuccucacugaauggcgggguauuuggagguggcaccaaagugacugucuuggggcagcccaaggccgcuccuagugugacacucuucccacccagcucugaggaacugcaggcaaacaaggccacccugguuugucucauuuccgacuuuuacccuggagcugugacggucgccuggaaagcggauucaagcccagugaaggcaggcguagaaacuaccacaccgaguaaacagucuaauaacaaguaugccgcuuccagcuacuuaucgcugacucccgagcaauggaaaucucaccgguccuauucaugccagguuacccaugaagguaguacaguggagaagaccgucgccccuacggaguguagc

SEQ ID NO: 28087 - RNA, 714 nt, Artificial Sequence
  derived and/or modified sequence opt3 from anti-influenza_Chain
augaugaagaaaaagagcugguucacccugaugaucacaggcgugauuucccucuuuuucucugucucagccuuugcugggaacguuuucugggagccccuuaguuacuuuaauagcuccacuuggcagaaagcagacggauauucuaacggucaaauguucaauugcacguggagagccaacaaugugaacuuuaccaaugauggcaagcugaaauugucguuaacaucuccugcgaacaauaaguucgacuguggggaauacaggagcacuaacaauuauggauacggccuguaugagguaaguaugaagccagcuaaaaacaccgguauaguguccucauuuuucacauacaccgggccgagccacggaacucagugggaugaaaucgacauugaguuucuaggcaaggauacaaccaaaguccaguucaauuauuacacgaacggcguugggggacaugaaaagaucauuaaucucgguuuugacgccuccacuucauuccacaccuacgcauucgauuggcagcccggcuauaucaaaugguacguggacggggugcugaagcauacagccacuaccaacauaccuaguacaccaggaaagaucaugaugaaccuuuggaauggcaccggugucgauagcuggcuggggucuuauaacggagcuaaucccuuguacgcagaguaugacugggugaaauacacguccaac

SEQ ID NO: 28088 - RNA, 729 nt, Artificial Sequence
  derived and/or modified sequence opt3 from anti-influenza_Chain
caggugcaacugguccagagcggcgccgagguuaagaaacccggguccucugugaagguaucaugcaaagcuaguggagguaccuucagcuccuacgcaaucucuugggugagacaggccccuggccaggggcucgaauggaugggaggcauuauggguauguuugggacaacuaacuaugcgcaaaaguuccagggaagggucacgauaaccgcugacgaguuuacaucggccgcauacauggaacuucggucacugcgcagcgaggauacugccguguauuacugugcucgaaguuccggcuauuacccagaauauuuccaggacuggggccaggggaccuugguuacagugucuagcggaaccgguggcuccgggggaacuggcucagguacagggggaaguacccaaagcgucuuaacgcagccgcccucugaguccgugucaccuggccagacugcaagcguaaccugcaguggccacaaacugggggauaaguacguuucuugguaccagcaaaagccaggacagucccccgugcuacucaucuaucaggacaaucguagaccuagcgguauuccagagagguuuaucggcucgaacucugggaauacagccacucugaccauuuccggaacacaagcucuugaugaagccgacuacuauugucaggcgugggauucaaguaccgcagucuucggcggugggacgaaacugacuguguugggc

SEQ ID NO: 28089 - RNA, 729 nt, Artificial Sequence
  derived and/or modified sequence opt3 from anti-influenza_Chain
caggugcaacugguccagagcggcgccgagguuaagaaacccggguccucugugaagguaucaugcaaagcuaguggagguccuuucagaaacuuugcaaucaauugggugaggcaggccccaggccaggggcucgaauggaugggaggcauuauagcggucuucgguaccacaaaguacgcucacaaauuucaagggcgggugacuaucacggccgacgauagcaccaacacagcauauauggagcuuggaucccugaagucugaagacacugccguuuacuauugugcucgcggcccgcauuacuauucgucauacauggauguguggggcgaggggaccacagucaccgugagcaguggaacugguggcuccgggggaacaggcucugguaccgggggaagcacggacauucaguugacucagucccccucaaguuuaagcgcaucuguaggcgaucgaguuaccaucacaugccgugccucccagggcauuucaacuuaucuggcuugguaccaacagaagccugggaaagugccaaagcuacucaucuacgccgcgagcacccugcagaguggaguccccucuagauucuccgguagcggcucggggacagacuuuacccuuacgauaucuucccugcagccugaagauguggcaacuuauuacugucaaaaauauaauucagccccaaguuucggacccggcacaaagguggacaucaaaagg

SEQ ID NO: 28090 - RNA, 729 nt, Artificial Sequence
  derived and/or modified sequence opt3 from anti-influenza_Chain
augagcuacagagugaagaggaugcugaugcuccuugucaccggccuguucuuguccuuaucuacauuugccgcuucagcaagugcccagacuggggguagcuucuaugagcccuuuaacaauuacaacacgggacuguggcaaaaagcggacggcuauuccaaugggaacauguucaauugcaccuggcgggcuaacaauguuucuaugacaucgcuaggagaaaugcgccucucacugacuagcccuaguuacaacaaguuugauuguggcgagaaucgauccgugcagaccuaugguuacgggcuuuaugaaguaaacaugaaaccagccaagaaugugggaaucgucucuagcuucuuuacauacaccggcccgacugacggcacacccugggaugagauugacauagaguuccuggggaaagauaccacgaaggugcaguuuaacuacuauacuaauggaguugguaaccacgaaaagaucgugaauuugggcuucgacgcagccaacuccuaccauaccuaugcuuuugauuggcagccuaacucaauuaaaugguacgucgacgggcaacucaagcacacagcaacuacccagaucccacagacacccggaaaaauuaugaugaaucuguggaacggcgccgguguggaugaguggcuggggaguuauaauggaguaaccccucucagccguucuuuacauuggguuagauacacgaagagg

SEQ ID NO: 28091 - RNA, 735 nt, Artificial Sequence
  derived and/or modified sequence opt3 from anti-influenza_Chain
caggugcaacugcagcagagcggcgccgaggucaagaaacccggguccucuguuaaggugucaugcaaaguaaguggagugaucuucagcgguuccgcuauuucuugggucagacaggcaccuggccaagggcucgaauggaugggaggcauaucgccacuuuuugguaccacaaacuacgcccagaaguuccaggggagggugacuaucacggcggaccagucaaccaauacaacuuauauggagguuaacagccugcgguacgaagauaccgcuguguauuuuugugcccgcggaccgaaauacuauagugaguacauggacgucuggggcaagggcacaaccgugacuguauccucugggacaggagguagcggcgggaccggauccggcacgggugggucaacugauauucaaaugacccagagucccagcucuuuguccgcaucaguuggagaccgagugacaaucacuugccgugccagccagggcauuaguucuuauuuagcuugguaccagcaaaagccuggcaaagucccaacccugcuaaucuacgaugcauccacacucagaagcggggugcccucgagguucucuggauccgguucagccaccgacuuuacgcugacuauaaguagccuucagccugaagauguggcuacauauuacugucagcgguauaauuccgccccacccaucaccuucggccaagggacucgccuggagauuaagaga

SEQ ID NO: 28092 - RNA, 735 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguaccuucagcuccuacggcaucucuugggugagacaagcaccugggcagggacucgaauggaugggcgacauuauagguauguuugggucgacaaacuaugcccagaauuuccagggaaggcuuacuaucacggcggaugagucaaccagcacagcuuacauggaacugaguuccuugcggucugaggacacugccgucuauuacugugcacgcagcuccggcuauuacccagccuauuuaccgcacuggggccaagggacccuggugacaguuucaaguggaaccgguggcagcgggggaacuggcucugguacagggggauccaccgagauugugcuaacgcagucacccggcacucucagccugaguccuggcgaacgagcuacccuuucuugccgugcaucccagagcgucucgucuuccuaccuggccugguaccagcaaaagccagggcaggcucccagauugcucaucuauggagccucaaguagggcgacagguauuccugaucgguuuagcggcuccgggucuggaacugacuucacccugacaaucagccgccuggagccagaagauuuugcaguguacuauugucagcaguacggcucaagucccagaaccuucggugggggcacgaaaguagagauaaagagg

SEQ ID NO: 28093 - RNA, 735 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguaccuucagcuccuacgcaaucucuugggugagacaagccccuggccaggggcucgaauggaugggaggcauuauagguauguuugggacagcgaacuaugcucagaaguuccagggaagggucacuaucacggccgacgaguuuaccucgacagcauacauggaacuuucaagccugcggagugaggauacugccguguauuacugugcucgcggcaauuauuacuaugaguccucuuuggacuacuggggccaagggaccuuaguuacagugagcuccggaaccgguggcucagggggaacuggcagugguacagggggaagcacccagucugucgugacgcagccaccguccguaucaguugcacccggccagacugcccgaauuaccugcggcgggaacaauaucggaagcaaaagugugcacugguaccaacagaagccuggucaggcuccaguccuggugguguaugaugacucugaucgucccuccggcauuccugaaagauucagcgggucgaacucuggaaauacagccacucuaaccaucuccagggucgaggcgggcgacgaagcagauuacuauugucagguuugggacucaaguagcgaucauuacguguuugguacagggaccaagguaacggugcucggc

SEQ ID NO: 28094 - RNA, 735 nt, Artificial Sequence
  derived and/or modified sequence opt3 from anti-influenza_Chain
gaggugcagcugguccaaagcggcgccgaaguuaagaaacccggggcuuccgugaagguaucuugcaaagcaucaggauacaccuucacagguuauuacguguauugggucagacaggccccuggccaggggcucgaguggaugggauggaucagugcguacaacggcaauacuaacuaugcucagaaguuucaagguagggugacgauuaccgccgacaaaagcacauccacugcauacauggaacuuucuucgcugcggucagaggauaccgccguuuauuacugugcucgcagccgaaguuuggacgugugggggcagggaacaaccgucacuguguccucuggcacaggcgggagcggagguaccggcuccgggacgggaggcucaacugauguaguuaugacccagaguccagacagcuuagcagugucucugggugaacgugccacaauaaauugcaaguccucacagagcguccuauacaguucuaacaauaagaacuaucucgcuugguaccaacagaaaccggggcagcccccuaagcugcuuaucuauugggccuccacuagagagagcggagugccagauagguucucgggcucuggcuccgggaccgacuuuacacugaccauuucaaguuugcaggcggaggauguggcagucuacuauugucaacaguacuauagcacgccccucacuuucggagguggcacaaaaguugacaucaagcgg

SEQ ID NO: 28095 - RNA, 735 nt, Artificial Sequence
  derived and/or modified sequence opt3 from anti-influenza_Chain
gaggugcagcuggucgaaaccggcgccgagguuaagaaacccgggagcuccgugaagguaccuugcaaaucuucaggaaguccauucagaagcaacgcuguguccugggucaggcaagcaccgggucagggccucgaauggguugggggaauccuuggcguguuugguucucccucguacgcccagaaguuccaggggcgggugacaauuacugcggacgagucaacgaauaccguccacauggaacugcgcggauugcgaagcgaggauacagcuguguauuacugugcccguggcccuacuuauuacuauaguuacauggacguauggggcaaagggaccacaguuaccguguccucuggaacugguggcagcgggggaacaggcuccgguaccgggggaucaacgaguuaugucuuaacucaaccacccagcgagucuguggcaccuggccagaccgccagaauaacaugcggcgggaacaauaucggaaggaacuccgugcauugguaccagcagaagccaggucaagcucccguccugguuguguacgaugacucagaucggccuagcggcauuccagaacgcuuuagugggucuaaguccggaaauacugcaacccuaaucauuagcagaguagaggugggcgacgaagccgauuauuacugucaggucuggcacucgucuuccgaccauuauguguucgguacagggaccaaaguuacggugcucggc

SEQ ID NO: 28096 - RNA, 735 nt, Artificial Sequence
  derived and/or modified sequence opt3 from anti-influenza_Chain
cagaugcaacuggugcagagcggcgccgaggucaagaaacccggguccucuguuaaggugucaugcaaagcuaguggagguaccuucagcuccuacgcaaucucuuggguaagacaggccccuggccaggggcucgaauggaugggaggcauuuuugguauguucgggacagcgaacuaugcucaaaaguuucagggaagggugacuauaacggccgacgaguucaccucggcagccuacauggaacuuucaagccugggcagugaggauacagcuauguauuacugugcacgguccucuggcuauuacccacaguauuuucaggacugggggcaaggaacuuuggucaccgugagcuccgguacaggcgggucaggaggcaccgguagugggacuggaggcagcacagaaaucguuaugacccagucuccgggcacguuaucccugucacccgggcagcgcgccacucuaagcugccgagcuagucagucuguguccagcucguaccucgccugguaccaacagaaaccuggacaggcgccacgucugcuuauguauggugcaucuuccagagccaccggcauucccgauagguucucagggaguggaagcggcacagacuuuacucugaccaucucccgguuggagccugaggauuucgcugucuacuauugucaacaguacgguucuagcucacucacauuugggggcggaaccaagcuggaaauuaagcgc

SEQ ID NO: 28097 - RNA, 735 nt, Artificial Sequence
  derived and/or modified sequence opt3 from anti-influenza_Chain
caggugcaacugguccagagcggcgccgagguuaagaaacccggguccucugugaagguaucaugcaaagcuaguggagugaccuucagcuacuaugcaauguccugggucagacaggccccuggucagggccucgaauggaugggagggaucucuccaauguuuggcacaacuacguacgcgcaaaaguuccaggguagggugaccauuacagcugacgauucgacuucaaccgccuauauggagguucggagccuucgcagugaagacacagcaguguacuauugugcccgauccucuaacuacuaugauagcgucuacgacuacugggggcagggaacccuggugacuguauccucaggcacaggcgggaguggagguaccggcagcgggacgggaggcucuacucaguccguugugacccaaccgcccucagagagcgucgcuccuggucagacagcacguauaacuugcgggggacacaauaucggcaguaacucugugcauugguaucagcagaaaccaggccaagcccccguguuggucguuuacgauaauuccgacagaccuagcgggauuccagaaagguuuucgggaucuaacuccgguaauaccgcuacauuaaccaucucacggguggaggccggcgaugaggcggacuauuacugucagguaugggggaguagcuccgaucacuauguguucggaacgggcacuaaggucacagugcugggu

SEQ ID NO: 28098 - RNA, 738 nt, Artificial Sequence
  derived and/or modified sequence opt3 from anti-influenza_Chain
caggugcaacugguccagagcggcgggggacucguuaagcccgguggcucccuuagacugucuugcgccgcuucaggguucaccuuuaguagcuacuccaugaacugggugaggcaggcaccuggaaaaggcuuggaguggguaucuucgaucucaagcaguuccucuuauauuuacuauguggacagcgucaagggucgguucacaauaucccgcgauaaugccaaaaacucauuauaccugcagaugaauagucuacgagcggaagacacugcuguguauuacugugcccgugggggaggcagcuauggcgcauacgagggguuugauuacuggggacaagguacgcucguuaccgugucuuccggcacagggggaucaggcgguacugggagcggaaccggcggcaguacagaaaucguccugacccagucuccagggacucuuucccugagcccgggagagagagccacauugucgugcagggcuucucagcggguguccucauaucucgcaugguaccagcaaaagcccggucaggccccucgccugcugauuuauggcgcuaguaccagagccgcggggaucccagacagguucagcggauccggcucugguacggauuuuacucucaccauuagccgguuagaacccgaggacucagcaguauacuauugucagcaguacgggcgcacaccucugacuuucggcggaggcaccaaaguugagaucaagcga

SEQ ID NO: 28099 - RNA, 738 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguccuuucagaagcuacgcaaucuccugggugaggcaagccccaggccaggggccggaauggaugggaggcauuauacccaucuuugguaccacaaaguaugcgccuaaauuccaggggcgggucacuauuacggcugacgauuuugccggaaccguguacauggagcucucuucgcuucgcucagaagacacagcaauguauuacugugccaagcacaugggcuaucagguucgagagacuauggauguguggggcaaggggaccacagucaccgugagcaguggaacugguggcuccgggggaacaggcucugguaccgggggaagcacguccuacguacugacucaaccacccucaguuaguguggcuccuggccagaccgcacguaucacaugcggcgggaacaauauuggaagcaaaucuguccauugguaucagcagaagccaggucaagcccccguguugguggucuacgacgauuccgacagaccuucaggcaucccagagagguucagcgggaguaacucuggaaauacugcuaccuuaacaauaucccggguugaagccggcgaugaggcggacuacuauugucaggugugggauagcucgucugaccacgcaguauuuggugggggcacccagcugacggugcuagga

SEQ ID NO: 28100 - RNA, 738 nt, Artificial Sequence
  derived and/or modified sequence opt3 from anti-influenza_Chain
gaggugcagcuggucgaaaccggcgccgagguuaagaaacccggggcuagcgugaagguauccugcaaagcaucuggauacacauucacuucauauuacaugcacugggugagacaagccccuggucagggccucgaauggaugggguggaucaacccaaauaguggaggcacgaacuaugcgcagaaguuucaggguagggucaccaugacacgggacacuagcauuuccaccgcuuacauggagcuuucucgccugcgaucggaugacacagccguguauuacugugcacgugaagggaaauggggaccgcaagccgcuuucgauauauggggccagggcaccaugguuacugugucaagcgggacaggagguaguggcgggaccggauccggcacgggugggucuacugagaucgucaugacccagagccccggaacauuguccuuaucaccuggcgagagagcaacucugaguugcagggccagccagucuguguccucaagcuaucuagcuugguaccaacagaagccaggccaggcgccccggcuccugauuuacgacgccaguucucgcgcaaccgauaucccugacagauuuuccgggagcggaucggguacagauuucacccuuacgauuucuaggcuggaaccagaggacuuugccguauauuacugucagcaauauggcuccucauuguggacuuucgggcagggaacaaagguugaaaucaaacgg

SEQ ID NO: 28101 - RNA, 738 nt, Artificial Sequence
  derived and/or modified sequence opt3 from anti-influenza_Chain
gaggugcagcuggucgaaagcggcgggggacucguucaacccgguggcucccuuagacugucuugcgccgcuucaggguucaccuuuaguaucuacgcaaugagcugggugaggcaggccccuggaaagggcuuggaguggguauccgcgauuucuucgucaggugacagcacauauuacgcugauagugugaaagggcgguucacuauaucccgcgacaacgcccgaaauacguuauaucugcagaugaacucucuacgugcagaagauaccgccgucuacuauugugcuagagcauacggauauacauuugacccauggggccagggcacucucgugaccguuagcuccgggacaggagguucaggcgggaccggaaguggcacuggugggagcacagagaucgugcugacccaaucuccgcuuucccugcccgucacgccuggagaaccagccucaauuagcugcaggaguucucaguccuugcuccacagcaauggcuacaacuaccuggauugguaucugcagaagcccggccagucgccucaacucuuaaucuaccuggggucuaaucgggcuuccggagugccagaccgcuucucagguaguggcagcgggacugauuuuacccuuaaaauuuccagaguagaggccgaggacguuggaguguauuacuguaugcaggcguugcagacaccccugacuuucggcggugggaccaaggucgaaaucaaaagg

SEQ ID NO: 28102 - RNA, 738 nt, Artificial Sequence
  derived and/or modified sequence opt3 from anti-influenza_Chain
gaggugcagcuggucgaaaccggcgccgagguuaagaaacccgggagcuccgugaagguaucuugcaaagcaucaggagguacauucagaacucacgcaaucaguugggugaggcaagccccuggccaggggcucgaauggaugggaggcauuauagcgaucuuugguacggcuaacuacgcccagaaguuccaggggcggauuaccaucacagcagacgagagcacuuccaccgccuauauggaacuuucuucgcugcgcucagaggauacagcugucuacuuuugugcacgaggaagcggcuaucauauuaguaccccauucgacaauuggggccaagggacuuuggugacaguuuccucuggaaccgguggcagcgggggaacgggcuccgguacugggggaucaaccaguuacguguuaacacagccgcccagcgucucuguggccccuggccagacugcucguauaaccugcggcgggaacaauaucggauccaaagguguacacugguaucagcaaaagccaggccaggcccccguucugguggucuacgaugacucagauagaccuagcgggaucccagagagguuuaguggaucuaacuccggcaauacagcgacccuaacgauuagccggguggaagcuggugacgaggccgauuauuacugucaggugugggacucgucuuccgaucaugucguuuucgggggcggaacuaagcucacagugcugggc

SEQ ID NO: 28103 - RNA, 738 nt, Artificial Sequence
  derived and/or modified sequence opt3 from anti-influenza_Chain
gaggugcagcugguccaaagcggcgccgaaguuaagaaacccggguccucugugaagguaucaugcaaagcuaguggagguaucuucagaagcaacuccauuucuugggugaggcaggcaccuggccaggggcucgaguggaugggaggcauauuugcccuuuucgguaccacagacuacgcgcagaaguuucaagggcgggucacuaucacggcugaugaaucgucaaccacaguguaucuggaguugagcaguuuaacuuccgaagacaccgccguuuacuauugugcacgcggaucuggcuacacaacccgaaauuauuucgauuacuggggccaggggacucuggugacagucagcuccggaaccgguggcucagggggaacgggcagugguacugggggaagcaccgagauugugcuaacacagucuccaggcacucucucccugucaccgggcgagcgugccacccuuagcugcagagcuagucagucuguauccagcaacuaucuggggugguaccaacagaaacccggacaggcaccuagguugcucaucuacggugccucgucucgggcuuccggcauuccagaccgcuuuucagggggaggcagugguacagauuucacccugacgaucagcagacuggaacccgaggacuuugccguuuauuacugucagcaauauggguccucuccucucacuuucggcggaggcacaaagguggaaauaaagagg

SEQ ID NO: 28104 - RNA, 738 nt, Artificial Sequence
  derived and/or modified sequence opt3 from anti-influenza_Chain
gaggugcagcuggucgaaagcggcgccgagguuaagaagcccggguccucugugaagguaucaugcaaagcuaguggagguaucuucaacagcuacgcaauuuccugggugagacaagccccuggccaggggcucgaauggaugggaggcauaaucgcgauuuuucacaccccaaaguaugcucagaaauuccaggguagggucacaaucacugccgacgagucuacgaauaccgcauacauggaacuucggucgcugaagucagaggauacagccuuguauuacugugcucgcgggagcacuuaugacuuuaguuccggauuagauuacuggggccaaggcacccuggugacaguuucuagcgggaccggagguuccggcgggacuggaucaggcacaggugggaguacccaggcaggacuaacgcagccgcccagcgugucugucgccccuggccagacugcucgaauuaccugcggcgggaacaauaucggauccaagucagugcauugguaucaacagaaaccaggucaggcccccguacucguuguguacgacgauagcgaccguccuaguggcauaccagagagauucucuggguccaacagcggaaauacagcgacucugaccaucucgagggucgaagcaggcgaugaggccgacuacuauugucaggugugggauucuuccucagaccacguggucuuuggugggggcacaaaacuuaccguucuggga

SEQ ID NO: 28105 - RNA, 741 nt, Artificial Sequence
  derived and/or modified sequence opt3 from anti-influenza_Chain
cagaugcaacuggugcagagcggcgccgaggucaagaaacccggguccucuguuaaggugucaugcaaagcuaguggagguaccuucagcuccuacgcaaucacauggguaagacaggccccuggccaggggcucgaauggaugggaggcauuauagguauguuugggucuacuaacuaugcgcaaaauuuccagggaagggugacgaucaccgcugacgagucgacaucaacugccuacauggaacuuagcagucugcgguccgaggauaccgcagucuauuacugugcccgcucuacaggcuauuacccagcuuauuugcaccauuggggccaggggaccuuagugacuguuagcuccggaacagguggcucagggggaaccggcagugguacugggggaagcacgcagucugcacugacccaaccgcgauccgugucaggcagccccggccagagugucacaauuucuugcacugggaccuccagcgacgugggagguuacaacuacguaucgugguaucagcagcacccuggcaaggccccaaaacuaaugaucuacgauguuucuaagcgucccuccggggugccugacagauuuucaggaaguaagagcggcaauacagcuucccucaccauuucuggucugcaagccgaagaugaggcggacuauuacuguagcucauauacgaguuccagcacucaugucuucgggacaggcaccaaagugacugugcuugga

SEQ ID NO: 28106 - RNA, 744 nt, Artificial Sequence
  derived and/or modified sequence opt3 from anti-influenza_Chain
gaggugcagcuggucgaaagcggcgccgagguuaagaagcccggguccucugugaagguaucaugcaaagcuaguggagguccuuucagaagcuacgcaaucuccugggugaggcaagccccaggccaggggccggaauggaugggaggcauuauacccaucuuugguaccacaaaguaugcgccuaaauuccaggggcgggucacuauuacggcugacgauuuugccggaaccguguacauggagcucucuucgcuucgcucagaagacacagcaauguauuacugugccaagcacaugggcuaucagguucgagagacuauggauguguggggcaaggggaccacagucaccgugagcaguggaacugguggcuccgggggaacaggcucugguaccgggggaagcacguccuacguacugacucaaccacccucagcuaguggcaccccuggccagcguguuacaaucagcugcucuggguccacuuucaacauuggaucaaaugcaguggacugguauagacaguugccagguaccgcccccaaauuacugaucuacagcaacaaucagaggccuaguggcgucccagaucgguuuucugggucccgcagcggaacaucggcuucucuagccauauccggccuccaaucagaggacgaagcggauuacuauugugcagccugggacgauauccugaacgugccgguguucggugggggcaccaaacuuacgguccuggga

SEQ ID NO: 28107 - RNA, 744 nt, Artificial Sequence
  derived and/or modified sequence opt3 from anti-influenza_Chain
caggugcaacugguccagagcggcgccgagguuaagaaacccggguccucugugaagguaucaugcaaagcuaguggagguccuuucagaagcuacgcaaucuccugggugaggcaggccccaggccaggggccggaauggaugggaggcauuauacccaucuuugguaccacaaaguaugcgccuaaauuccaagggcgggucacuauuacggcugacgauuuugccggaaccguguacauggagcucucuucgcuucgcucagaagacacagcaauguauuacugugccaagcacaugggcuaucagguucgagagacuauggauguguggggcaaggggaccacagucaccgugagcaguggaacugguggcuccgggggaacaggcucugguaccgggggaagcacgcaguccgcucugacucagccagcagccguaucaggcagucccggccaaagcaucaccauuucuugcacagggacuuccucagacguuggagguuacaacuaugugagcugguaccagcagcauccuggcaaagcuccaaaguugaugaucuacgaagucaguaaucgucccucugggguguccaacagauucagcggaucgaaaucuggcaauaccgccuccuuaacaauaucaggucugcaggcggaggaugaggcagacuauuacuguaguagcuauaccuccucuagcacguacguguuugggacuggcacaaaggucaccguucuagga

SEQ ID NO: 28108 - RNA, 744 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguccuuucagaagcuacgcaaucuccugggugaggcaagccccaggccaggggccggaauggaugggaggcauuauacccaucuuugguaccacaaaguaugcgccuaaauuccaggggcgggucacuauuacggcugacgauuuugccggaaccguguacauggagcucucuucgcuucgcucagaagacacagcaauguauuacugugccaagcacaugggcuaucagguucgagagacuauggauguguggggcaaggggaccacagucaccgugagcaguggaacugguggcuccgggggaacaggcucugguaccgggggaagcacguccuacguacugacucaaccacccucaguuaguggcaccccuggccagcgugugacaaucagcugcucuggguccagaucaaacgucggagacaauagcguguauugguaccagcaugugccagagauggcucccaaauuguuagucuacaagaacacucagaggccuagugguguuccagcacgguucucuggcuccaaaagcgggaccucggccucucuggcuauuaucggacuacaauccggcgaugaagccgacuauuacuguguggcgugggaugacucaguagaugguuauguguuugggaguggcacaaaggucaccgugcucgga

SEQ ID NO: 28109 - RNA, 744 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguccuuucagaagcuacgcaaucuccugggugaggcaagccccaggccaggggccggaauggaugggaggcauuauacccaucuuugguaccacaaaguaugcgccuaaauuccaggggcgggucacuauuacggcugacgauuuugccggaaccguguacauggagcucucuucgcuucgcucagaagacacagcaauguauuacugugccaagcacaugggcuaucagguucgagagacuauggauguguggggcaaggggaccacagucaccgugagcaguggaacugguggcuccgggggaacaggcucugguaccgggggaagcacguccuacguacugacucaaccacccucagcuaguggcaccccuggccagcguguuacaaucagcugcucuggguccucaagcaacauuggaaguaauuauguguacugguaccagcaguugccagguacugcacccaaauuacugaucuauagagacggccaaaggccuucuggggucccagaucgguucuccggaagcaagucgggcaccucugccucccuagcuauaucaggucuccgcagugacgaugaggccgacuacuauugugcgacaugggaugacaaccugagcgggccgguguuuggcggaggcaccaaacuuacggugcugggg

SEQ ID NO: 28110 - RNA, 744 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguaccuucagcuuuuacuccaugucuugggugagacaagcaccuggccaggggcucgaauggaugggaggcaucauuccaauguucgguacaacuaacuaugcccagaaguuucaggggagggucacgauaaccgcgguggagucgacaucaacugcuuacauggaaguuagcagucuucgguccgaggacaccgccguguauuacugugcacgcggagauaaaggcaucuauuacuauuacauggacgucuggggcaaggggacaaccgugacuguaucuagcggaacagguggcuccgggggaaccggcucagguacugggggaaguacgcaaagcgcccugacccagccggcuucuguuuccggcucacccggccagagcauuacaaucaguugcacugggaccucuuccgaugugggagguuacaauuaugucagcugguaccagcaacacccuggcaaggcaccaaaauugaugauuuaugaggugucgaaccgacccucugggguguccaaucguuucucaggaaguaagagcggcaacacagccuccuuaaccaucucuggucugcaggcugaagacgaggccgauuacuauuguagcucauacacgaguuccagcacucuagucuuugggacaggcaccaaaguuacugugcucgga

SEQ ID NO: 28111 - RNA, 744 nt, Artificial Sequence
  derived and/or modified sequence opt3 from anti-influenza_Chain
augagccuguucggcgacaccaucgccuaccuccuuucccugauugaggauggggaaggaaaggcugaguuggcagaaaaauuacacugcugguuugguggcaaggaguucgaccuggauucugcccuagaauggaucaaaaacaagagaugucucacagacauacagaaagcgcugauuggggcuucaaucugcuuucuuaagcccaaggaucaagagaggaaacggcgcuucauuacugagccucugaguggaaugggcacgaccgccacaaagaaaaaggguuugauccucgcagaacgaaaaaugcguagaugugugagcuuucaugaggccuucgaaauagcugaggggcacgaguccucugcacugcuguauugccucauggucauguacuuaaauccagaaaacuauucgaugcagguuaagcugggaacucuuugugccuugugcgagaagcaggcuucacauagccacagggcccauagucgggcggcacgcuccucugugccgggcguaagaagggaaaugcagauggugagcgccaugaauaccgcuaaaacaaugaacggcauggggaagggagaggacguccaaaaacuggccgaggaacuacagaauaacaucggugugcuccggucccugggcgcaucacagaagaauggggagggaauugcuaaagauguuauggaagugcuuaagcagaguagcaugggcaacucugcccugguccgcaaauacuug

SEQ ID NO: 28112 - RNA, 747 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguccuuucagaagcuacgcaaucuccugggugaggcaagccccaggccaggggccggaauggaugggaggcauuauacccaucuuugguaccacaaaguaugcgccuaaauuccaggggcgggucacuauuacggcugacgauuuugccggaaccguguacauggagcucucuucgcuucgcucagaagacacagcaauguauuacugugccaagcacaugggcuaucagguucgagagacuauggauguguggggcaaggggaccacagucaccgugagcaguggaacugguggcuccgggggaacaggcucugguaccgggggaagcacgcaauccguacugacucagccacccucaguuagugcugcaccuggccagaaagugaccaucagcugcucuggcuccucaagcaacauugggaaugacuacgucaguugguaucagcaauugccaggaacagcccccaaguuacugaucuacgauaacaauaaacguccuucugguauaccagacagauucuccggcagcaagucggggacuucugcuacccuaggaaucacaggccuccagaccggugaugaggccaacuacuauugugcgacgugggacaggcggccgacugcauacgugguguuugggggcggaacaaaacugaccguccuuggc

SEQ ID NO: 28113 - RNA, 750 nt, Artificial Sequence
  derived and/or modified sequence opt3 from anti-influenza_Chain
caggugcaacugguccagagcggcgccgagguuaagaaacccggguccucugugagaguaucaugcaaggcuaguggaagcaucuucaggaacuacgcaauguccugggugcggcaggccccuggucagggccucgaauggaugggagggauuauagcgaucuuuggcaccccaaaauaugcucaaaaguuccagggucgcgucacaauuacugccgacgagucuacgucgaccguguacauggaacuuucagggcugcgaagcgaggauacagcaauguauuacugugcccguaucccgcacuauaauuuuggaaguggcuccuacuucgacuauuggggccaggggacuuugguuaccgugucuagcggaacagguggcuccgggggaaccggcucagguacugggggaaguacaaccgucuuaacgcagcccccuagcgugucuggcgcuccaggccaaagaguaacuauuuccugcaccgggucaagcaguaacaucggagcagguuacgauguucauugguaccagcagcugcccggcacagccccuaaacuacucauauauggaaauucuaacaggccauccggggugcccgaccgguuuagcggcucgaagucugguacuuccgcuacccuggggaucacaggccuucagaccggagaugaagccgacuacuauuguggcacgugggauucaagucugagcgcguacgucuucgggacuggaacaaaggugaccguguugggu

SEQ ID NO: 28114 - RNA, 756 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggacacaucuucagcgguuacgcaauuuccugggugagacaagccccuggccaggggcucgaauggaugggaggcauaaucccaauuuuugguaccacaaacuaugcgcagaaguuccaggggagggucacuaucacggcugaccaaucuaccucgacagccuacauggaucuuucaaaucugcggagcgaggacacugcaguguauuacugugcccgcguuaaagauggauauugcaccuugacaaguuguccggugggcugguacuuugacuuauggggccgagggacccuggucacuguguccucuggaacagguggcagcgggggaaccggcuccgguacugggggaucaacggaaauuguaaugacccagagucccggcacacuaagccucucuccuggcgagcgugcuacucuguccugcagagcaucacagagcguuaguucuuccuaucuugccugguaccagcaaaagccagggcaggcucccaggcuguugaucuucggagccagcucgcgggcgaccgguauaccugaucgcuuuucuggcuccgggucaggaacagacuucacccucacgaucaguagacuggagccagaagauuuugcaguguacuauugucagcaguacggcagcucccugacuuucggugggggcacaaagcucgagauuaaaagg

SEQ ID NO: 28115 - RNA, 768 nt, Artificial Sequence
  derived and/or modified sequence opt3 from anti-influenza_Chain
caggugcaacugguccagagcggcgccgagguuaagaaacccggguccucugugaagguaucaugcaaagcuaguggagguuucuuuagcuccuacgcaaucucuugggugagacaggccccuggccaggggcucgaauggaugggaggcgucauuccaauauucaggaccgcgaacuaugcucaaaauuuucagggucgggugacaaucacugccgacgaguucacgucguacauggaacuuucaagccugcgcagugaugacaccgcaguuuauuacugugcccgauugaacuaucacgauuccgggacauacuauaaugcuccgcguggaugguuugaccccuggggccagggcacuuuagugaccgucucuagcgggacaggagguuccggcgggaccggaucaggcacuggugggaguacagauauucagaugacccaaagcccugacucucuggcagugucccuaggagagaaggccacgaucaacugcaaaucaagccagaguauucucaauucuuccaacaauaagaacuaccuggcuugguaccagcagaagccaggccaacccccuaaacuucugaucuauugggccagcacuagagaaucgggcguaccagauagguucucuggguccggaucagguaccgacuuuacauugacuauaaguagccuccaggcggaggauguugcaguguacuauugucagcaauacuauuccucucccccuaccuucggccaggggacaaaggucgagaucaaacgg

SEQ ID NO: 28116 - RNA, 768 nt, Artificial Sequence; identical to SEQ ID NO: 28115
  derived and/or modified sequence opt3 from anti-influenza_Chain

SEQ ID NO: 28117 - RNA, 771 nt, Artificial Sequence
  derived and/or modified sequence opt3 from anti-influenza_Chain
aucugcauuggcuaccacgccaacaauagcaccgaacagguggacacaauaauggaaaagaacgucacuguuacgcaugcucaagauauccuggagaaaacccacaaugggaagcucugugaccuugauggagugaaaccccugauuuugagagacugcuccguagcagguugguuacugggcaacccuaugugugaugaguucaucaaugugccagaguggucuuauauugucgaaaaggccaacccggcgaaugaccuaugcuaccccgggaacuuuaaugauuaugaggagcucaaacaucugcuuucaaggaucaaccacuucgaaaagauacagaucauuccuaagaguagcugguccgaccaugaggcuucuucgggagugucaagcgccuguccauaccagggcacacccuccuuuuuccggaauguuguguggcugaucaaaaagaacaauacuuauccuaccauuaaacgcaguuacaacaauacaaaccaggaagauuugcucauccugugggguauacaccacucuaacgacgcagccgagcaaaccaagcuguaucagaauccaacuacauacauuagcgucgggaccuccacgcucaaccagcgauuagugcccaaaaucgcuacucguucaaagguaaauggacagaacggcagaauggacuuuuucuggaccauucugaagccuaaugaugcaaucaacuuugagaguaauggcaacuucaucgccccagaauacgcuuauaaaauuguuaagaaa

SEQ ID NO: 28118 - RNA, 771 nt, Artificial Sequence; identical to SEQ ID NO: 28117
  derived and/or modified sequence opt3 from anti-influenza_Chain

SEQ ID NO: 28119 - RNA, 777 nt, Artificial Sequence
  derived and/or modified sequence opt3 from anti-influenza_Chain
augguuaagagcaaauaccuggucuucaucuccguguuuucucuccuuuucggcguguuuguagugggguucucacaccagggagucaaggccgaggaagagagacccauggguaccgcuuuuuaugaaaguuucgacgcauuugaugacgagagguggagcaaagccggcguguggacaaacgggcaaauguucaaugcgacuugguacccugaacagguuacggcugauggacugaugcgguugaccauugccaagaaaacaacuuccgcacgcaacuauaaggccggcgaguuacgaaccaaugacuuuuaccauuauggucuguucgaggugucuaugaagccagcuaaagucgaagggacagugucgucauuuuucaccuacacuggagagugggauugggacggcgauccgugggacgaaauagauaucgaguuucuaggcaaggacacaacccguauucaguucaacuauuucacgaaugggguaggagguaacgaguuuuacuacgaucucggcuucgacgcaagcgaaaguuuuaauacuuaugccuucgaguggagagaagauuccaucaccugguacguuaacggggaggcugugcacacagccacugaaaauauuccccagaccccucagaaaaucaugaugaaccuguggccaggagucggcguggacgguuggacagggguguuugacggagauaauacccccgucuauucuuacuaugacuggguuagguacacgccucuucaaaacuaucagauacaucag

SEQ ID NO: 28120 - RNA, 777 nt, Artificial Sequence; identical to SEQ ID NO: 28119
  derived and/or modified sequence opt3 from anti-influenza_Chain

SEQ ID NO: 28121 - RNA, 783 nt, Artificial Sequence
  derived and/or modified sequence opt3 from anti-influenza_Chain
gacauccagaugacccaaagccccuccucugugucagccagugucggcgauagaguuacaauuacuugcagggcuagccaggacauauccacguggcuggcaugguaccagcagaagccugggaaagccccaaagcuccuuaucuaugcggcuucuucgcugcaaucaggagugccgagccgguucagugguuccggcucugggaccgauuuuacauugacuauuagcuccuuacagcccgaggacuucgccaccuacuuuugucagcaggcaaacucauucccuccaacauuuggaugcggcaccaaacuggaaaucaagggugggggaggcaguggcgggggagguagcggcgggggaggcucuggugggggaggcuccgagguacagcuaguggucucaggcgggggacucgugaaacccgguggcagccugcgccuuaguugugccgcuucugggcuguccuucuugaaugcauggaugagcuggguucgacaagccccuggaaagugccucgaaugggugggccguauuaagucgaacacugauggugggacaaccgacuaugcugccccagucaaaggcagauuuucuaucuccagggaugacucaaagaauaugcuguuccugcacaugaguagccuccggacggaggauacugcgguguacuauugugcaaccgacggacccuacuccgaugacuuucgcucuggcuaugccgcuagauacagguacuucgggauggauguauggggacaggguacaacuguuaccgugagcuca

SEQ ID NO: 28122 - RNA, 783 nt, Artificial Sequence; identical to SEQ ID NO: 28121
  derived and/or modified sequence opt3 from anti-influenza_Chain

SEQ ID NO: 28123 - RNA, 789 nt, Artificial Sequence
  derived and/or modified sequence opt3 from anti-influenza_Chain
augggcuucgugcuguuuagccagcuccccuccuuccuucuggucucuaccuuguuacuguuucuaguuaucucacacaguugcagagcccaaaacgggggaagcuacccuuauaaguccggugaguacaggacaaaaucuuucuuuggcuauggguacuaugaagugcggaugaaggcugccaaaaauguaggaauugugucgucauucuuuacuuacacgggcccaagcgacaacaauccgugggaugagauagacaucgaguuccucgguaaggauaccacaaaaguccaguuuaacugguauaagaauggggugggaggcaacgaauaccugcauaaucuuggcuucgacgcaagucaggauuuucacacuuacggguucgaauggcgccccgacuauauugauuuuuacguugacggaaagaaaguguaucgagguacccguaacaucccugucacaccaggcaagauuaugaugaaucuguggcccgggaucggaguggaugagugguugggcagauacgacgguaggaccccucuccaggcggaguaugaauacguaaaauauuacccaaacgggcgguccaagcugguugugaauacucccuucgucgcuguguucucuaacuuugauagcucccaaugggagaaagccgacugggcaaauggaucaguguucaacugugucuggaagccuagucagguuacauuuagcaauggcaagaugauacugacccucgaucgcgaauacguggaccaucaccaucaccaccauaaagacgaguua

SEQ ID NO: 28124 - RNA, 789 nt, Artificial Sequence; identical to SEQ ID NO: 28123
  derived and/or modified sequence opt3 from anti-influenza_Chain

SEQ ID NO: 28125 - RNA, 840 nt, Artificial Sequence
  derived and/or modified sequence opt3 from anti-influenza_Chain
auggcccaggugggcagaggggcuagcccccuguccagggcacgggucccuccacucccgcacccccuugacggagagcaucugccucacgauccagccgguggcgggcauggaaaggcgucuucacaagacgcucccguuggccaguugccuggucacuuagcccgcccagcauucuuucauuaccugaaaaacaguuuccuagugugcagccucaccacaguauuugcccuggcuguggcaacuuucgccggguaugcucuugcccgauuucguuuccccggagcggaacuguuuggcggcuccgucuuggugacgcagguuaucccugggauucucuuccugauaccaaucuacauuauguauaucuacgugcagaauugggucagaucugcacugggacucgaggugagguuaguagguucguauggcgggcugguuuuuaccuacacagccuucuuugugccgcuuucaauuuggaucuugcggggauucuuugcuagcauacccaaggaacuggaggaagccgcaauggucgauggcgcuacuccuuuccaagccuuccaccgcgugauccuaccacucgcgcugcccggucuugccgcaaccgcuguguauauuuuucugacagccugggacgagcucuuguucgcucagguccugaccacugaggccacagcaaccguuccuguggggaucagaaacuuuguaggaaauuaccagaacagguacgauuuagugauggccgcugcgacggucgcaacucugccagugcucguucuuuucuuuuucgugcagcggcaacugauucagggcuugaccgccggcgcugucaaaggg

SEQ ID NO: 28126 - RNA, 840 nt, Artificial Sequence; identical to SEQ ID NO: 28125
  derived and/or modified sequence opt3 from anti-influenza_Chain

SEQ ID NO: 28127 - RNA, 843 nt, Artificial Sequence
  derived and/or modified sequence opt3 from anti-influenza_Chain
auggccgacaacaugaccacaacucagaucgaggugggccccggggcuacgaaugcaaccauuaacuucgaagccggaauacuggagugcuacgaaagauuuagcuggcaaagggcgcucgauuauccuggucaggaccggcuucaccgccugaagcgaaaauuggagucccguaucaagacacauaauaaaucugaaccagagaacaagagaaugucauuagaggaaaggaaagcuauuggcgucaagaugaugaagguucugcuauucauggauccgagugccgggaucgagggauuugaacccuacugugugaaaaauccuagcacuuccaagugcccaaacuaugacuggaccgauuaucccccuacaccaggcaaauaccucgacgauauugaggaggaacccgagaauguagaccacccuaucgaagugguccugcgggauaugaacaauaaggacgcacgccagaaaauaaaggaugaggugaacacccagaaggaagguaaauucagacuuacuaucaagagggacauucggaauguucugucuuugcgcgugcucgucaacgggacauuucugaaacauccaaauggagauaagucgcugucaacccuccaccgauuaaacgccuacgaccaaaauggcggccugguggcuaaacuuguagcaacggacgauagaacuguugaggacgagaaggaugggcauaggaucuugaacagccuguucgaacgguuugacgagggacacaguaaaccgauucgugccgcugaaaccgccguggguguccuaucccaguucggccaggagcaccgccucucucccgaagagggggauaac

SEQ ID NO: 28128 - RNA, 843 nt, Artificial Sequence; identical to SEQ ID NO: 28127
  derived and/or modified sequence opt3 from anti-influenza_Chain

SEQ ID NO: 28129 - RNA, 858 nt, Artificial Sequence
  derived and/or modified sequence opt3 from anti-influenza_Chain
augugcaccaugccccugaugaagcucaaaaagaugaugagaaggacagccuuccuucugagcguguugaucggcuguuccauguuagggucugaccggucagauaaagcuccucacugggagcuggucuggagugacgaauuugauuacagcggacuaccagacccggagaagugggauuaugacguugguggccauggguggggaaaccaggaacuccaauacuauacucgcgcacgaauugagaaugcccgugugggcggugggguacugauaaucgaagcgagacacgagcccuacgagggaagggaauauacguccgcucggcuugugacccgcggcaaagccucuuggacauacggcagauucgagauuagggcacggcugccuucggggcgcggaacuuggccagccaucuggauguugcccgaucgacagaccuaugguucagcuuacuggccugacaacggcgaaauugauaucauggagcaugucggguuuaauccagacgugguucacggaacagugcauaccaaggcauacaaccaccuccugggcacucagagaggugggagcauaaggguccccacagcccggaccgauuuccacguguaugcuaucgaguggacgccugaagagauucguugguuuguagacgauagucuguacuaucgcuucccaaaugaaagacucacugacccggaggccgacuggaggcauuggcccuuugaucagccuuuccacuuaaucaugaacauugcgguuggaggcgcauggggcgggcaacagggaguggacccagaagccuuucccgcucagcuggucguggauuacgugcgggucuaucgauggguugag

SEQ ID NO: 28130 - RNA, 858 nt, Artificial Sequence; identical to SEQ ID NO: 28129
  derived and/or modified sequence opt3 from anti-influenza_Chain

SEQ ID NO: 28131 - RNA, 900 nt, Artificial Sequence
  derived and/or modified sequence opt3 from anti-influenza_Chain
aacgugcccgaguggagcuacaucgucgaaaaggccaauccugcuaacgaccugugcuauccaggcaauuucaacgauuacgaggaacucaaacaccuucuguccagaauuaaucauuuugagaagauacagggguauaucccggaagcacccagggacggacaagccuacguucggaaagauggugaguggguguuguuaucuaccuuccugcgcucagacaagacacacacuuguccuccaugccccgcgccugagcuacucggcgggccaaguguauuucuguuucccccuaaaccaaaggauacgcuuaugauuagccgaaccccggaagugacaugugucgugguugacgugucccaugaggaucccgaagucaaguuuaacugguauguggacggaguagagguucacaaugcuaaaacuaagccucgugaggaacaguacaacucuaccuauagaguggucucggugcugacaguguugcaucaggauuggcucaauggcaaagaguacaagugcaaagucucaaacaaggcccugccagcacccaucgaaaagaccauuagcaaagccaagggucagccuagggagccacaaguuuacacucugcccccgagucgggaagagaugaccaaaaaucaggugucccucacauguuuaguaaagggguucuauccuucugacaucgcuguggagugggaaagcaacggacagcccgagaauaacuacaaaacgacuccaccuguccuggauuccgacggcucauuuuuccuuuauaguaaguugaccguggauaaaagccgcuggcagcaaggcaauguuuucucuugcuccgugaugcacgaagcacugcacaaccauuacacacagaagucacuaagccucagucccgggaag

SEQ ID NO: 28132 - RNA, 900 nt, Artificial Sequence; identical to SEQ ID NO: 28131
  derived and/or modified sequence opt3 from anti-influenza_Chain

SEQ ID NO: 28133 - RNA, 927 nt, Artificial Sequence
  derived and/or modified sequence opt3 from anti-influenza_Chain
auggugaacagaagggaccugaucaaguggagcgccgucgcucucggcgcaggggccggacuugcgggucccgcuccugccgcacacgccgcugaucuggagugggaacaguacccaguuccggcagcccccggcgggaaucgguccuggcaauuguuaccuucucauucagacgauuucaacuauaccggaaaaccacagacauuucgcggccgauggcuggaccagcacaaggaugguuggagugggcccgcuaauagccuauacuccgcccgucauucuuggguggcggacggaaaccucauuguagagggcagaagggcaccugauggccggguguauugcggguacgucacuucgcgcacgccaguggaauauccccuguacaccgagguucuuaugagagugucaggacugaaauugagcaguaauuucuggcuccuguccagggacgaugucaacgaaauagacgugaucgaguguuaugguaaugagucucugcacggcaagcauaugaacacagccuaccacauuuuucagcggaauccuuucacugaacucgcucgcagccaaaaaggguacuuugccgauggauccuauggcuacaacggugagaccgggcagguauucggagacggcgcaggccagccauuacugcgaaauggguuucacagauauggaguucauuggaucucagcuacagaguucgauuuuuacuucaacgguaggcuugugcggcguuugaaucgcaguaacgaccugagagacccgaggagccgguuuuucgaucagcccaugcaccuaauucucaauaccgaaucucaucaauggcgagucgaccgcggcaucgagccuacugaugccgaacuggcggacccauccauaaacaacaucuauuacagaugggugaggacauaucaggccgug

SEQ ID NO: 28134 - RNA, 927 nt, Artificial Sequence; identical to SEQ ID NO: 28133
  derived and/or modified sequence opt3 from anti-influenza_Chain

SEQ ID NO: 28135 - RNA, 960 nt, Artificial Sequence
  derived and/or modified sequence opt3 from anti-influenza_Chain
aucugcauuggcuaccacgccaacaauagcaccgaacagguggacacaauaauggaaaagaacgucacuguuacgcaugcucaagauauccuggagaaaacccacaaugggaagcucugugaccuugauggagugaaaccccugauuuugagagacugcuccguagcagguugguuacugggcaacccuaugugugaugaguucaucaaugugccagaguggucuuauauugucgaaaaggccaacccggcgaaugaccuaugcuaccccgggaacuuuaaugauuaugaggagcucaaacaucugcuuucaaggaucaaccacuucgaaaagauacagaucauuccuaagaguagcugguccgaccaugaggcuucuucgggagugucaagcgccuguccauaccagggcacacccuccuuuuuccggaauguuguguggcugaucaaaaagaacaauacuuauccuaccauuaaacgcaguuacaacaauacaaaccaggaagauuugcucauccugugggguauacaccacucuaacgacgcagccgagcaaaccaagcuguaucagaauccaacuacauacauuagcgucgggaccuccacgcucaaccagcgauuagugcccaaaaucgcuacucguucaaagguaaauggacagaacggcagaauggacuuuuucuggaccauucugaagccuaaugaugcaaucaacuuugagaguaauggcaacuucaucgccccagaauacgcuuauaaaauuguuaagaaaggggauagcgccauagugaagucugaggucgaauacggaaauugcaacacaaaaugucaaacuccgaucggugcgauuaauuccucaaugcccuuucauaacauccacccucuuaccauaggcgagugcccaaaguaugugaaaagcaauaaguuggugcuggcaacagggcuaaggaacaguccccuc

SEQ ID NO: 28136 - RNA, 960 nt, Artificial Sequence; identical to SEQ ID NO: 28135
  derived and/or modified sequence opt3 from anti-influenza_Chain

SEQ ID NO: 28137 - RNA, 960 nt, Artificial Sequence; identical to SEQ ID NO: 28135
  derived and/or modified sequence opt3 from anti-influenza_Chain

SEQ ID NO: 28138 - RNA, 978 nt, Artificial Sequence
  derived and/or modified sequence opt3 from anti-influenza_Chain
acccugugcaucggcuaccacgccaacaauagcacagacacuguggauacgguccucgagaagaacguuaccgugacacauuccguaaaucuucuggaagacaaacacaacgggaaguuguguaaauuaagaggaguggcuccccugcaucuagguaagugcaauauugcaggcuggauacucgggaacccugagugugaaucucugucaacugccaguagcugguccuauaucgucgagaccucuucgucagauaauggaacaugcuacccaggcgacuucauugauuaugaggaacuuagggagcagcugagcaguguguccucuuuugaacgguucgagaucuuuccgaaaaccagcuccuggcccaaccacgacucaaauaaggguguuacugcggcuuguccucaugccggggcaaagaguuucuacaaaaacuugauuuggcucgugaagaaaggaaauagcuauccaaagcugucuaaauccuacaucaacgauaagggcaaggaaguccuggugcucuggggcauacaccaccccucaacaagcgccgaccaacagaguuuauaucagaaugcugaugcauacguauuuguugggaccucucgcuacuccaaaaaguucaaaccugagaucgccauucgaccaaaggugcgugaccaggagggaagaaugaacuauuacuggacgcuggucgaacccggugauaaaaucacuuuugaggcuaccggcaaucuuguggugccuagguaugccuucgcgauggaacgggacgcagggagcggaauuaucauaucggauacaccaguccaugacugcaacacuaccugucaaacaccgaagggcgccauuaacaccucuuugcccuuucagaauauccacccuauuacgaucgguaaaugcccaaaguacguuaaguccacuaaacugcgccuagcuacagggcucagaaacgugcccucaauccagaguagg

SEQ ID NO: 28139 - RNA, 978 nt, Artificial Sequence; identical to SEQ ID NO: 28138
  derived and/or modified sequence opt3 from anti-influenza_Chain

SEQ ID NO: 28140 - RNA, 960 nt, Artificial Sequence; identical to SEQ ID NO: 28135
  derived and/or modified sequence opt3 from anti-influenza_Chain

SEQ ID NO: 28141 - RNA, 990 nt, Artificial Sequence
  derived and/or modified sequence opt3 from anti-influenza_Chain
augugcagcuccauccccucucugagagagguguucgccaacgacuuuaggauuggcgcugcagucaauccuguuacccucgaagcccagcaaucacuucugauacggcacgugaacaguuugacagcggagaaucauaugaaguucgaacacuuacagccagaggaagggcgcuuuacuuucgauaucgcuauuaaaagcuccacgucuccguuuucgucacauggaguacgaggucacacccugguguggcauaaccagacacccagcugggucuuccaggacagucaaggccacuuuguggggcgugauguucuacucgagagaaugaagucccacaucucuacugugguccagagguacaaaggaaagguguauuguugggacguaauuaaugaggccguugcagaugaaggcagcgaguggcugcgguccucaaccuggcgccagaucauaggugacgauuucauccagcaagccuuucuuuacgcucaugaagcagacccugaggcccuguuguucuauaacgauuacaaugagugcuuuccagagaaaagagaaaagauuuauacacucgugaagagucugagggacaaagggauccccauucacggaaucggcaugcaggcucauuggagccugaaccggccuacccucgaugaaauacgcgccgcgauugagcgauacgcaucuuuaggcgucauccugcacauuacugaacuugacaucuccauguucgaguuugaugaccacagaaaggacuuggccgcuccaacaaaugagaugguggaaaggcaggccgagcgguaugaacagaucuucucacuguucaaagaguaccgugaugugauucaaaacgucaccuuuugggggauagcagacgaucauacguggcuagaccacuuccccguucagggacgcaagaauuggccucuccuguuugaugaacagcauaacccaaaaccggcuuucuggagagugguaaauauc

SEQ ID NO: 28142 - RNA, 990 nt, Artificial Sequence; identical to SEQ ID NO: 28141
  derived and/or modified sequence opt3 from anti-influenza_Chain

SEQ ID NO: 28143 - RNA, 1002 nt, Artificial Sequence
  derived and/or modified sequence opt3 from anti-influenza_Chain
augaagaacagagugaucagccugcucauggccucccuucuguuggucuuaucuguuauuguggcucccuucuacaaagcagaggccgcgaccguagugaauacaccuuuugucgcuguguucucaaacuuugacaguagccagugggaaaaggccgauugggcaaauggcuccguuuucaacugcguguggaaaccaucucaagucacuuuuucgaaugggaagaugauacugacgcuagacagggaguauggagguucauacccguauaaaagcggcgaauaccggaccaagaguuucuuuggguauggauacuaugaggugcgcaugaaggccgcuaaaaacguaggcaucguuuccucuuucuuuacauacacuggucccagcgauaauaacccuugggacgaaauugauaucgaguuccucgggaaggacaccacaaaagugcaguuuaauugguacaagaacggagucggcggcaaugaguaucugcacaaccuuggguucgaugcaucccaggacuuucauaccuacggauucgaauggcgaccagauuauauugacuucuacguggaugguaaaaagguguaucguggcacuagaaauauccccgucacaccugggaagauaaugaugaaccuguggccaggaaucggcguugacgagugguuggguagguacgaugggcggacgccccuccaggccgaauaugaguacgugaaauacuauccuaauggaguaccacaagacaacccgacccccacuccuaccauugcuccaucaacacccacuaacccuaaucugccacugaagggcgacgugaacggcgaugggcacgucaauaguagcgacuacucucucuuuaaacgcuauuuacugagagugaucgauagguuccccguuggagaccaguccguggccgaugucaaccgggacggucgcauugauucaaccgaccuuacaauguugaagcgauaccugaucagagcgauaccgagccua

SEQ ID NO: 28144 - RNA, 1002 nt, Artificial Sequence; identical to SEQ ID NO: 28143
  derived and/or modified sequence opt3 from anti-influenza_Chain

SEQ ID NO: 28145 - RNA, 1041 nt, Artificial Sequence
  derived and/or modified sequence opt3 from anti-influenza_Chain
aucugcauuggcuaccacgccaacaauagcaccgaacagguggacacaauaauggaaaagaacgucacuguuacgcaugcucaagauauccuggagaaaacccacaaugggaagcucugugaccuugauggagugaaaccccugauuuugagagacugcuccguagcagguugguuacugggcaacccuaugugugaugaguucaucaaugugccagaguggucuuauauugucgaaaaggccaacccggcgaaugaccuaugcuaccccgggaacuuuaaugauuaugaggagcucaaacaucugcuuucaaggaucaaccacuucgaaaagauacagaucauuccuaagaguagcugguccgaccaugaggcuucuucgggagugucaagcgccuguccauaccagggcacacccuccuuuuuccggaauguuguguggcugaucaaaaagaacaauacuuauccuaccauuaaacgcaguuacaacaauacaaaccaggaagauuugcucauccugugggguauacaccacucuaacgacgcagccgagcaaaccaagcuguaucagaauccaacuacauacauuagcgucgggaccuccacgcucaaccagcgauuagugcccaaaaucgcuacucguucaaagguaaauggacagaacggcagaauggacuuuuucuggaccauucugaagccuaaugaugcaaucaacuuugagaguaauggcaacuucaucgccccagaauacgcuuauaaaauuguuaagaaaggggauagcgccauagugaagucugaggucgaauacggaaauugcaacacaaaaugucaaacuccgaucggugcgauuaauuccucaaugcccuuucauaacauccacccucuuaccauaggcgagugcccaaaguaugugaaaagcaauaaguuggugcuggcaacagggcuaaggaacaguccccucggauacauuccugaagccccacgggacggccaggcuuauguccgcaaggacggugaguggguucugcuuucuaccuuccug

SEQ ID NO: 28146 - RNA, 1041 nt, Artificial Sequence; identical to SEQ ID NO: 28145
  derived and/or modified sequence opt3 from anti-influenza_Chain

SEQ ID NO: 28147 - RNA, 1047 nt, Artificial Sequence
  derived and/or modified sequence opt3 from anti-influenza_Chain
augaacaucaagaaaaccgccgucaagagcgcucuggcaguggccgcggcugccgcagcccucacaacuaauguuuccgcuaaagacuucucuggcgcagagcuuuacacgcuggaagaggugcaguaugggaaguuugaagccagaaugaaaauggcugccgcgucaggaaccguaaguagcauguucuuguaccaaaacgguuccgagauugcagauggcaggcccuggguggaagucgacauagagguguuagggaagaauccuggaucuuuucagucgaacaucauuacaggcaaggccggugcucagaaaacuucagagaagcaccaugccguuagcccagcagcugaucaggccuuccacaccuaugggcuggaauggacaccgaauuacgugcgguggaccgucgacggacaagaggugcgcaaaacugaaggcggccagguaaguaaccuaacagggacccagggacuccgauuuaaucugugguccucugagagcgcggccuggguuggucaguucgaugaguccaaacuuccccuguuucaauucaucaacugggugaaggucuauaaguacacgccuggccagggggaaggaggcucagacuuuacuuuggauuggaccgacaauuucgauacauuugacgguagucguugggggaagggagauuggacuuucgacggcaacagaguggaucucaccgacaaaaauauuuauagcagggacggcaugcugauccuggcacucacacggaaggggcaggagucuuuuaacggacaggugccacgcgaugacgaacccgcuccucaauccucaagcagugccccagcuucuuccagcucgguccccgccucuuccucaaguguuccugcaagcuccucuagcgccuucgugccaccgucaaguuccagcgcuaccaaugcgauacaugguaugagaacgacucccgcaguagccaaagagcacaggaacuuagugaaugcuaagggcgccaaagucaacccuaacgggcauaagcgguaccgcgugaauuucgaacac

SEQ ID NO: 28148 - RNA, 1047 nt, Artificial Sequence
  derived and/or modified sequence opt3 from anti-influenza_Chain
gaggugcagcuggucgaaagcggcgggggaguugugcaacccgguagaucccucaggcuuucuugcgccgcuucaggcuucgcauuucacaaccgggccaugcauuggguacgccaggcgccugggaagggacuggaguggguggcuuugaucuacuucgacggcaguaaacaguauuacgccgauagcgucaagggucgauuuaccauuucccgugacaauucuaaaaacacaguguucuuacagaugaacucgcugagaccagaagauacugcaguuuauuacugugccgugccggggcccauauuuggaaucuucccuccauggucauauuuugaccacuggggccaaggcauucuagucacggugagcagugcuuccaccaaggggcccucuguauucccucucgcaccaagcuccaaaucaacaaguggagguacugccgcucugggcugccuuguuaaggauuacuuucccgagccugugaccgucagcuggaacucuggggcccugacauccggagugcauaccuucccagcgguguugcagucaagcggccucuauagucugucuuccgucguuacugugccgagcucgucucuggguacacagaccuacaucuguaauguaaaucacaagcccuccaauacgaaaguggacaagaaagucgaaccuaagucaugcgauaaaacucauaccuguccacccugcccugcaccagagcucuuagggggacccaguguguuucuguucccgccuaagcccaaggacacacuuaugauuagcaggacuccagagguuaccuguguggucguggauguaucccacgaagacccugagguuaaauuuaacugguacguggauggcgucgaagugcacaaugccaagacaaaaccccgggaggagcaguauaacucuaccuaccgcgucgugagcguuuugacggugcugcaucaagacuggcuaaauggcaaggaauauaaaugcaagguaucaaacaaagcucucccagcccccaucgagaagacuauaaguaaggcaaaaggg

SEQ ID NO: 28149 - RNA, 1047 nt, Artificial Sequence; identical to SEQ ID NO: 28148
  derived and/or modified sequence opt3 from anti-influenza_Chain

SEQ ID NO: 28150 - RNA, 1047 nt, Artificial Sequence; identical to SEQ ID NO: 28147
  derived and/or modified sequence opt3 from anti-influenza_Chain

SEQ ID NO: 28151 - RNA, 1161 nt, Artificial Sequence
  derived and/or modified sequence opt3 from anti-influenza_Chain
augaacaaguuccugaauaaaaaguggagccucauccuuaccaugggcgggauuuuucugauggccacauuguccuuaauauucgcuacugguaaaaaggcauuuaacgaccagacgucugccgaggauauccccucacuggcggaagccuucagagacuacuuuccuauuggagccgcaaucgagccaggcuauaccacagggcaaauugccgaacuauacaaaaagcacgugaauaugcucgucgcugagaacgcaaugaagccggccagucugcagcccacugaaggaaauuuccagugggcugaugccgacaggaucguucaguuugcgaaagagaacggcauggagcuucgguuccauacccugguguggcacaaucaaacaccuaccgguuuuagcuuggauaaggaagggaaaccaaugguagaggaaacugacccccagaagcgcgaggagaaccgaaaacuccugcugcagcgucucgaaaauuauauaagagcaguggucuuaagguacaaggaugacaucaaguccugggaugugguuaacgaggugauugaaccuaaugacccaggaggcaugcggaacucucccugguaucagaucacaggcaccgaguacauugaagucgccuuccgcgcuacgagagaggccgggggaucggauaucaaacuguauauaaaugacuacaacacugaugacccugugaagagggacauucuuuacgaguugguuaaaaaucugcuagaaaaggguguaccaaucgauggcguggggcaucaaacccacauugacaucuauaacccgcccgucgagcggaucauugaaucaaucaaaaaguuugcaggacucggccuggauaacauaauuacagagcuugacaugagcaucuacaguuggaaugaucgcuccgacuauggugauucuauaccugacuacauucugacuuugcaggcuaaacgauaucaggaacucuucgaugcccugaaggagaacaaggacaucgugagcgcgguggucuuuugggggaucuccgauaaauacucaugguuaaauggauucccaguuaagagaaccaacgcuccccuccuguucgacaggaauuuuaugccuaaaccagcauucugggcuauuguggaccccagucggcuucgugag

SEQ ID NO: 28152 - RNA, 1161 nt, Artificial Sequence; identical to SEQ ID NO: 28151
  derived and/or modified sequence opt3 from anti-influenza_Chain

SEQ ID NO: 28153 - RNA, 1221 nt, Artificial Sequence
  derived and/or modified sequence opt3 from anti-influenza_Chain
augagaaacguggucaggaagccccugaccaucggccucgcccuuacacuguuguuaccuauggggaugacugcuacgagcgccaaaaaugcagacuccuacgcgaagaaaccacacauuucugcucugaacgccccgcagcuagaucaacgguauaagaaugaguucaccauaggagcagccguugaacccuaccagcuccagaacgagaaagacgugcagaugcugaagcgccauuuuaauucaaucguagcugaaaacgugaugaagccuauuaguauccaaccagaggaagguaaauucaauuuugagcaggcagaucgaauugucaaguucgccaaagcuaacggcauggacauccguuuucacacacuuguguggcauagccagguuccccagugguucuuucuggauaaggaggggaaaccuauggugaaugaaacugacccagucaagagagagcaaaacaagcaguugcuccugaaaaggcuggaaacccacauaaagacaaucguggagcgguauaaagaugacauuaaguacugggauguaguuaaugagguggucggagacgauggcaaacuccgcaacucccccugguaucagaucgccgguauugacuacaucaagguggcguuccaggcagccagaaaauaugggggagauaauauaaaguuauacaugaacgacuacaauaccgaaguggagccuaagaggacugcucuguauaaccuugucaaacaauugaaggaagagggcguuccaauugacggcaucgggcaucagucucacauucagaucggauggccgucggaagccgagaucgagaaaacaauuaacauguuugcagcucugggucuagauaaucaaauaaccgaacucgacgugucaauguacggcuggcccccucgggccuauccaacguacgaugcgauccccaagcagaaauuccuggaccaggccgcacgcuaugaucgacuuuuuaagcuguacgagaaguugagcgacaaaauuaguaacguaacuuucugggggaucgcugauaaucacaccuggcucgacuccagagccgauguguauuacgacgcuaacggaaaugucgugguugauccuaacgccccauacgcaaagguggaaaaaggcaaggguaaagacgcccccuuugucuucgggccggacuauaaggugaagccugcuuacugggcgauaauugaucauaaa

SEQ ID NO: 28154 - RNA, 1221 nt, Artificial Sequence; identical to SEQ ID NO: 28153
  derived and/or modified sequence opt3 from anti-influenza_Chain

SEQ ID NO: 28155 - RNA, 1233 nt, Artificial Sequence
  derived and/or modified sequence opt3 from anti-influenza_Chain
cugagcagaaucaaccacuucgagaagauucagauaauccccaaauccucuuggucagaccaugaagccaguagcggcguguccucugcuugcccuuaccaagggaccccaucguuuuucaggaaugucguuuggcucauuaagaaaaacaauacauauccgacuaucaagcggucauacaacaauacgaaccaggaggaucuucugauuuuguggggaauccaccauagcaaugacgcagccgaacagaccaaauuauaucagaaccccacaacuuacauaaguguggguaccuccacacugaaucaacgccuaguaccuaagaucgcgacccgaucuaaggugaacggccagaaugggcguauggacuuuuucuggacuauucucaaaccaaacgaugcuaucaauuuugagagcaacggaaauuucauugcccccgaauaugcauacaagaucgucaaaaagggcuauauaccugaggccccaagagauggucaggcuuacgugaggaaagacggggaguggguucugcuuuccacauuucugcggucagauaagacccacacgugucccccuugcccagcaccggaauugcucggaggccccaguguguuccuguuuccuccaaagcccaaagacacucugaugauuagccgcaccccugaggucacaugugugguaguugaugugucucaugaagacccagaggucaaguucaacugguacguggauggcguggagguccacaacgccaaaacuaagcccagagaggaacaguauaauuccaccuacaggguugugucaguacucacaguguuacaccaagacuggcugaacgggaaagaauauaagugcaaagucagcaauaaggcccuuccggcuccuaucgagaagaccauuaguaaagcgaagggacagccccgggaaccacagguguacacguugccucccucucgcgaggagaugacuaaaaaccagguuucccugacaugucuagugaaggguuuuuauccaagcgauaucgcagucgaaugggagucgaauggccaacccgaaaacaauuacaaaaccacuccuccagugcucgacucugacggguccuucuuucuguauucaaaacuuacaguagauaagagucgauggcagcagggaaacguuuucagcugcuccgugaugcaugaggcccugcacaaucauuacacccaaaagucuuugagccucucaccgggcaag

SEQ ID NO: 28156 - RNA, 1233 nt, Artificial Sequence; identical to SEQ ID NO: 28155
  derived and/or modified sequence opt3 from anti-influenza_Chain

SEQ ID NO: 28157 - RNA, 1293 nt, Artificial Sequence
  derived and/or modified sequence opt3 from anti-influenza_Chain
auggacgaucacgccgagaaguuccuguggggcguggcuaccagcgcauaccagaucgaaggggccacacaagaggacggaagaggucccuccauuugggaugcguuugcuaggcggccuggcgccauacgcgacgggucuacuggagaaccagcaugcgaucauuaucgacguuacgaggaagacaucgcccucaugcagucacuuggcgucagagcuuauagguucaguguugcauggccgcggauucugcccgagggucgcgggagaaucaacccuaaaggauuggccuuuuacgauagguuaguggaccggcugcuagcuagcggcauuacgccauuccucacccuguaucacugggaucuuccccuggccuuggaggaacgcggcggguggcgauccagagagacagcguuugcauucgccgaauacgcugaggccguagcaagggcucucgccgaccgggugccauuuuucgcgacucugaaugagccuugguguucugccuuucugggacauuggaccggugaacacgcacccggccuccguaacuuagaggcugcccugcgcgcugcccaucaccuuuugcuggggcacggacuagcagucgaagcccucagagcugcgggcgcaaggcggguggguaucguucugaauuucgccccugcuuauggggaggauccagaagccguggacgucgcagaucgauaccauaaccgcuacuuucuugacccgauacugggaaagggcuaucccgagucgccuuucagagacccacccccugugccaaucuugucaagggaucucgagcugguagcccggcccuuagacuuucugggcguuaauuacuaugcuccggugcgcgucgccccugggacaggaacccuccccgugagauaccuuccaccugaaggucccgcaacugcgaugggcugggagguguauccagaagggcugcaccauuugcuaaaaaggcugggacgugagguccccuggccucucuacguuacagaaaacggcgcugccuauccagaucuguggaccggugaggcagugguagaggacccggaacggguggccuaccuugaggcucacgucgaagccgcacugcgagcuagagaggaagggguggauuugaggggcuacuucguuuggagccucauggacaauuucgagugggccuuuggauauacgcgccgguucggccuguacuauguggauuuucccagucagagaaggauuccuaagcgcuccgcguuaugguaccgagagcggaucgcccgugcucagacu

SEQ ID NO: 28158 - RNA, 1293 nt, Artificial Sequence
  derived and/or modified sequence opt3 from anti-influenza_Chain
augaccgagaacgccgaaaaguuccuguggggcguggcuacaagcgcauaccagaucgagggggccacucaagaagacggaagaggucccuccauuugggaugcguuugcucagaggccuggcgccauacgggacgggucuacgggagagccagcaugcgaucacuaucgccgauacgaagaggacaucgcccucaugcagucacuuggcguccgugcuuauagauucaguguugcauggccgaggauucugcccgagggucgggggcgcaucaauccuaaaggauuggccuuuuacgauagauuaguggacaggcugcuagcuagcggcauuaccccauuccucacacuguaucauugggaucuuccccuggccuuggaagagagaggcggguggcgcucccgagaaacugcguuugcauucgccgaguacgcugaggccguagcaagagcucucgccgacagggugccauuuuucgcgacccugaacgaaccuugguguucugccuuucugggacacuggacaggugagcaugcacccggccuccggaauuuagaagcugcccugcgugcugcccaccaucuuuugcuggggcacggacuagcagucgaggcccuccgcgcugcgggcgcaagaaggguggguaucguucugaacuucgccccugcuuauggggaagauccagaggccguggacgucgcagaucgguaccacaaucgauuuuuccuugacccgauacugggaaagggcuaccccgagucgccuuuucgcgauccacccccugugccaaucuugucaagagaccucgaacugguagccaggcccuuagacuuccugggcguuaacuauuacgcuccggugcgggucgccccugggaccggaacucuccccgugcgcuaucuuccaccugagggucccgcaacagcgaugggcugggaaguguacccagaggggcuguaucauuugcuaaaaagacugggaagggaaguccccuggccucucuacguuaccgagaauggcgcugccuauccagaucuguggacgggugaggcagugguagaagacccggagcguguggccuaccuugaagcucacgucgaggccgcacugcgggcucgagaagaggggguggauuugagaggcuacuucguuuggagccucauggacaacuuugagugggccuucggauauacuaggcgcuuuggccuguacuauguggauuuccccagucagcggcggauuccuaagagguccgcguuaugguaccgcgaacgaaucgcccgggcucaaacc

SEQ ID NO: 28159 - RNA, 1293 nt, Artificial Sequence
  derived and/or modified sequence opt3 from anti-influenza_Chain
auggccgagaacgcugaaaaguuccuguggggcguggcaaccagcgccuaccagaucgagggggcgacacaagaagacggaagaggucccuccauuugggauacuuuugcuaggcggccuggcgccauacgcgacgggucuacgggagagccagcaugcgaucacuaucaucgauacgaagaggacaucgcccucaugcagucacuuggcgucgguguuuaucguuucaguguggcuuggccgaggauucugcccgaggggaggggacggaucaauccuaaaggcuuggcauuuuacgaucgcuuaguagacagacugcuagccgcuggcauuaccccauuccucacacuguaucacugggaucuuccccaggcccuggaagacagagggggauggcggagccgcgagacugcguuugcauucgccgaauacgcugaggccguggcacgagcuuuggccgauagagucccauuuuucgcgacccucaacgagccuugguguuccgccuuucugggucauuggacaggcgaacacgcacccgggcugaggaaucucgaggcugccuuacgggcugcccaucacuuacuuuugggacacggccuggcaguggaagcccuacgugcugcgggugcaaagcgcguugggaucgugcucaacuucgccccugucuauggagaggacccagaagcuguggauguagccgacagauaccauaauagguacuuucuggauccgauacuuggccggggcuaucccgagucuccuuuccaggacccacccccuaccccaaaccugucgcgagacuuggagcucguugcacgcccccuggauuuucugggggugaauuacuaugccccggucagaguggcuccuggaacugguccccugccagugagguaccucccucccgaaggcccagucacagccauggggugggagguuuaucccgaaggacuuuaccaccuguugaaacggcuaggccgcgaggugccuuggccacuguauaucaccgaaaacggugcagcguacccggaccucuggacgggggaggcuguaguggaggaucccgaaagagucgccuaccuggaggcacauguggaagccgcucuuagggcccgugaggaaggcguugaccugcggggauauuucguguggucauugauggauaauuucgagugggcauuuggcuacacucgaagauucgggcucuauuacgucgacuuuccuagccaaaggcgcauuccaaagcggagugcucugugguauagagagaggaucgcccgcgcgcaguua

SEQ ID NO: 28160 - RNA, 1293 nt, Artificial Sequence; identical to SEQ ID NO: 28157
  derived and/or modified sequence opt3 from anti-influenza_Chain

SEQ ID NO: 28161 - RNA, 1293 nt, Artificial Sequence; identical to SEQ ID NO: 28158
  derived and/or modified sequence opt3 from anti-influenza_Chain

SEQ ID NO: 28162 - RNA, 1293 nt, Artificial Sequence; identical to SEQ ID NO: 28159
  derived and/or modified sequence opt3 from anti-influenza_Chain

SEQ ID NO: 28163 - RNA, 1296 nt, Artificial Sequence
  derived and/or modified sequence opt3 from anti-influenza_Chain
auguucaagcccaacuaccacuuuuucccuaucaccggcuggaugaaugacccaaacgggcugauauuuuggaaaggaaaguaucauauguucuaccaguauaauccgagaaaacccgagugggguaacauuugcuggggccacgccgugagcgaugaccucguccauuggaggcaccuuccuguugcucuguacccagaugacgaaacacaugggguguuuuccggaucugcaguagagaaggauggcaaaauguucuugguguauacuuacuaucgggaccccacgcacaauaagggugaaaaggagacccaaugugucgccaugucagaaaacggguuagauuuugugaaauacgacggaaauccuguuaucaguaagccacccgaggagggcacacacgcguuccgcgauccuaaagugaaccgaagcaauggcgaauggcguaugguccugggguccggaaaggacgagaaaauugguagagugcuacucuacacuucugaugaccuguuucauuggaaguaugaaggcguaaucuucgaggaugagaccacaaaggaaauugagugcccagaccuuguuaggaucggggaaaaagacauacugaucuacucgauuaccucaacuaacagcguguuguuuaguaugggagagcucaaggaaggcaaacugaaugucgagaagcggggucugcucgaucacgggacagacuucuaugcugcccagaccuuuuucggaacggaucgcgugguggucaucggcugguuacaguccuggcugagaacuggccuuuacccgaccaaaagggagggguggaacggaguuaugucuuugccccgggaacuguauguggagaauaacgaacuaaagguaaaaccuguggacgagcuccuggcacuucgcaagcgaaaggucuucgaaacagccaaaagcgguacuuuucuguuggaugugaaggaaaauuccuacgagauuguuugugaguucucaggcgagaucgaacucagaauggggaacgagagugaagagguggucauaaccaaaagcagggacgagcugauuguggauacaacccggucuggaguauccggcggugaaguucguaagucaacgguggaggacgaagcuacuaaccgcaucagagcauuuuuagauagcugcagugucgaguucuuuuucaaugacucuauugccuuuuccuucaggauccauccagagaacguguauaauauccugagcgucaaaucgaaccaggugaagcucgaaguuuuugagcuugaaaauauuuggcug

SEQ ID NO: 28164 - RNA, 1296 nt, Artificial Sequence; identical to SEQ ID NO: 28163
  derived and/or modified sequence opt3 from anti-influenza_Chain

SEQ ID NO: 28165 - RNA, 1323 nt, Artificial Sequence
  derived and/or modified sequence opt3 from anti-influenza_Chain
gaggugaagcuggucgaaagcggcgggggacucguucagcccgguggcucccuuagacugucuugcgccaccucaggguucacauuuagugacuacuauaugagcugggugaggcaauccccuggaaaagccuuggagugguuaggcuucacucggucucgcguacuggguuacacgaccgauuauucggcaucagugaaggggcgauuuacaaucagccgugacaacagucaguccauucuauaccuccagaugaacucucugagaggagaagauagcgccacuuauuacugugcgagggaccggccaauggauuauuggggccagggcaccuccgucacagugucaagugcuaaaaccacuccgcccagcguuuacccucuugccccagggucugcagcccaaacaaauuccauggugacccugggaugcuuggucaaggguuacuuccccgagccugugacgguaacuuggaacucaggcagccucaguucugggguucacaccuuuccagcugugcugcaguccgaccuguauacacucagcucgucugucacugugcccuccucaaccuggccuagugaaacagugaccuguaaugucgcacauccagccagcuccacgaaaguugauaagaagauagugccgcgcgacugcggauguaaacccugcaucuguacuguaccugaggugucuagcgucuucauuuuuccacccaagccuaaagauguguuaacaaucacccugacuccaaagguuacaugcguggucguggacauuucaaaagaugaccccgagguacaguucaguugguuuguugaugacguggaaguccacaccgcucagacgcaaccgagagaggaacaguucaauuccaccuuuaggagcgugucugagcuuccuaucaugcaucaggacugguugaacggcaaggaguucaagugucgggucaauucagccgcguuucccgcaccaauagagaaaacaaucaguaagacuaaaggucgcccuaaggcuccccagguguacaccauuccacccccuaaagaacaaauggcuaaggauaaaguuagccugacaugcaugaucacugacuucuucccagaagauauuaccguggaguggcaguggaacgggcagccggccgaaaauuauaagaacacacaacccaucauggacaccgauggauccuacuuuguauauucuaagcuaaauguccagaaaucgaacugggaggcaggcaauacuuucacguguagcgugcuccacgagggccugcauaaccaccacacagaaaagucccuuucacauaguccugggaaa

SEQ ID NO: 28166 - RNA, 1323 nt, Artificial Sequence; identical to SEQ ID NO: 28165
  derived and/or modified sequence opt3 from anti-influenza_Chain

SEQ ID NO: 28167 - RNA, 1329 nt, Artificial Sequence
  derived and/or modified sequence opt3 from anti-influenza_Chain
gaggugcagcugcagcagagcggccccgaacucgucaagccuggggccuccguuaaaaugucuugcaaggcuucaggauacaccuucacaaguuaugugaugcacuggguaaaacagaagccaggucagggccuugaguggaucggguacauuaacccguauaaugacggaacuagauacaacgaaaaauuuagggugaaggcaacgcugaccagcgauaaguccucuucgacagccuauauggaguugaguagcuuaacuucagaagacuccgcggucuacuauugugcucggcgcggccugauaaccacacccacccuagauuacuggggucaagggacuacacucaccgugucuagcgccaaaacgacuccuccauccguuuacccccuggcaccuggaucagccgcucagaccaauaguauggugacacuuggcugccuggucaagggcuauuucccagagcccgugacuguaaccuggaacagcgggucuuuguccucaggaguucauacauuuccugcagugcuccagagcgaccuguacacccugaguucuuccgucacggugccaagcucgacuuggccgucugagacagugaccuguaaugucgcccaccccgcuuccucaacuaaaguugauaagaaaaucgugccucgagacugcgguuguaagccaugcauuuguacaguacccgaagugaguagcgucuucaucuuuccuccaaagcccaaagaugugcucaccauuacguuaaccccgaagguuacaugcguggucguggacaucuccaaagaugacccugagguacaguucucuuggguugaugacguggaaguccauacugcccaaacccagccccgugaggagcaguuuaacagcacauucagaucagugagugaacugccaauaaugcaccaggauuggcuuaauggcaaggaguuuaaauguagggucaacuccgcggcauucccugcccccaucgaaaagacuauuagcaaaaccaaggggcggccaaaggcuccccaaguguauacaaucccuccaccgaaagagcagauggccaaggacaaaguuucuuugaccugcaugauuacugacuuuuuccccgaagauaucacgguggaguggcaguggaauggacaaccugcagagaacuacaagaauacacagccaauaauggacaccgauggcucauauuuuguauacaguaaacugaacguccaaaagagcaauugggaagcugguaacacuuucaccuguuccgugcuacaugaggggcuccacaaucaccauacagaaaagucucugucgcacagccccggaaaa

SEQ ID NO: 28168 - RNA, 1329 nt, Artificial Sequence; identical to SEQ ID NO: 28167
  derived and/or modified sequence opt3 from anti-influenza_Chain

SEQ ID NO: 28169 - RNA, 1332 nt, Artificial Sequence
  derived and/or modified sequence opt3 from anti-influenza_Chain
aacgugcccgaguggagcuacaucgucgaaaaggccaauccugcuaacgaccugugcuauccaggcaauuucaacgauuacgaggaacucaaacaccuucuguccagaauuaaucauuuugagaagauacagaucauuccgaaaucuucauggagugaccacgaagcaagcuccgggguuucuucggccugucccuaucaaggaaccccuucauucuuuaggaacgugguaugguugaucaagaaaaauaacacauacccaacuauuaagcggagcuauaauaacacgaaucaggaggauuuacugauccuaugggguauacaucacaguaacgacgcggcugagcagaccaagcucuaccagaaucccacaacuuauaucuccgugggcaccucuacacugaaccaacgccuugucccuaaaauugccacccgaagcaaggugaaugggcagaacggacguauggauuucuuuuggacuauccugaaaccaaacgacgcaauuaauuucgaauccaacggcaauuuuaucgcccccgaguacgcuuacaagauaguuaaaaaggguuauauuccugaagcaccaagagaugggcaggccuacgugaggaaggacggagagugggucuugcucucaacauuccugcggagugauaaaacccauacgugcccgcccuguccugcuccagagcugcucggcggccccagcguguuuuuauucccuccaaagcccaaagacacucugaugaucucucgcaccccggaaguaacaugcguuguggucgaugugucccacgaggacccugaagugaaguuuaacugguaugucgaugggguugaggugcacaaugccaaaacuaagcccagagaggaacaguacaacucaaccuauaggguagugagcguccuuacaguguugcaucaagacuggcugaauggaaaagaguacaaguguaagguuaguaacaaagcgcuaccagcaccuauugaaaagaccaucucuaaagccaagggucagccccgggagccacagguguauacgcugcccccuucccgcgaagagaugacuaaaaaucaggucagccucacaugccuugugaagggcuucuacccaucggacaucgcuguagaaugggagucuaacgggcaaccggagaauaacuacaagaccacucccccuguucuggauuccgacggaucauuuuucuuguauaguaaacucacaguggauaagagccgauggcagcagggcaaugucuucuccuguucugugaugcacgaagcccugcauaaccacuacacccaaaagagcuuaucacugaguccagguaaa

SEQ ID NO: 28170 - RNA, 1332 nt, Artificial Sequence; identical to SEQ ID NO: 28169
  derived and/or modified sequence opt3 from anti-influenza_Chain

SEQ ID NO: 28171 - RNA, 1341 nt, Artificial Sequence
  derived and/or modified sequence opt3 from anti-influenza_Chain
caggugcaacugcaggagagcggccccgggcucgucaagccuuccgaaacccuuucucugacaugcacuguuucaggagguuugaucggcacggggaguuacuauuggggauggauuagacagaccccaggcaaagguauggaguggauagggagcaucuccuacucuggaucgacauauuaccacccgucauuaaagagcagggugacuauuagugacgauaccuccaaaaaccagcuguuccuaaagcuccggucuguaacagccgcugacaccgcacaauauuacugugcccgcuauaauuggggcauccgauacuuugauuucuggggccgugggacucuggugacagucagcuccgcgucaaccaaaggacccaguguguuuccucuugcuccaugcagcagaucuacguccgaaucaacugccgcacuggguuguuugguuaaggacuacuuccccgagccugugaccgucagcuggaacaguggcgcccucacaucuggggugcauacuuuuccagcuguacugcaguccagcggacuguauucgcucucuuccguugugaccguccccucaaguagcuuaggcacaaagaccuacacgugcaauguggaucacaaaccuuccaacacuaagguggacaaaacaagggaaucuaaguaugguccaccgugucccagcugcccugcaccagaguuccuugggggacccucagucuuucuguucccuccaaaacccaaggauaccuugaugauuagucggacuccggagguuacaugugugguaguggacgucucccaggaagauccugaggugcaguuuaauugguacguugacggcguggaaguccauaacgccaagaccaaaccccgcgaggagcaauucaauagcacguauagagugguaucuguucugaccgugcuacaccaggauuggcucaacggcaaggaauacaaaugcaaggucucaaauaaagggcugccaaguagcaucgagaagacaauauccaaagcuaagggacagccuagggaaccccagguguauacucuuccacccgcccaagaggaaaugaccaagaaccaggucucucugacauguuuggugaaagguuuuuacccuucggacaucgcgguugagugggagagcaauggccagccagaaaacaauuacaagacuaccccgcccgugcucgauuccgacgggucauucuuucuguauagucgguuaacaguagacaaaucucgcuggcaagagggaaacgucuucagcugcuccgugaugcaugaagcacugcacaaucacuacacccagaagucacucagccuuucucugggcaaa

SEQ ID NO: 28172 - RNA, 1341 nt, Artificial Sequence; identical to SEQ ID NO: 28171
  derived and/or modified sequence opt3 from anti-influenza_Chain

SEQ ID NO: 28173 - RNA, 1344 nt, Artificial Sequence
  derived and/or modified sequence opt3 from anti-influenza_Chain
gaggugcagcugcaagaaagcggccccgggcucgucaagccuucccagacccuuucucugacaugcaacguuucaggagguaguaucacuggcgacuacaaauggagcuggauuagacagccaccggggaagggauuggaguggauaggccacauccauuccacggguaccacauauuacaaucccucuuuaaggucgcggauuacuaucucaauggauaccagcaaaaacaaucugagucuacgccucacauccgugaccgccgcugacacugcaguauauuacugugccucucacacacugaccagcgggcauuauccucgagauuucgacuuuuggggacagggcacgcuugugacugucuccucagcgaguaccaagggcccaagcguguucccccuggcuccuugcucucguuccacaucagaaagcacugccgcauuggggugucucguuaaagauuacuuuccagagcccgugaccgucaguuggaacucuggagcccugacauccggugugcacaccuucccugcuguacugcaaagcucgggccucuauucuuuauccucaguugugacggucacaaguagcaauuuugggacucagaccuacacuugcaacguggaccauaagccauccaauacaaagguggauaaaaccgucgaaagaaaguguugcguugaguguccgcccugcccugcaccacccguggccggaccuucuguauuccuguuuccacccaaaccgaaggacacgcuuaugauuagcaggaccccugaggugacaugugucgugguugaugugucacacgaagaccccgagguccaguucaacugguacguggauggcauggaaguacacaaugcuaaaacuaagccacgggaggagcaguuuaacaguaccuuccgcguuguguccgucuugacagugguccaucaagacuggcugaaugguaaggaauauaaaugcaaggugagcaacaaagggcuaccugcccccaucgagaagacuauaucuaaaaccaagggacagccaagagaaccccagguuuacacacucccuccaucaagggaggaaaugaccaaaaaucaggugagucugacuugucuuguaaagggcuuuuauccgagcgauaucgcggucgagugggaguccaacggccaacccgaaaauaacuacaagacgacaccuccaaugcuggacucugacgggucguucuuuuuguauagcaaacucaccguggauaagucccgguggcagcagggaaacguuuucucaugcagugugaugcacgaggcacugcauaaucacuacacucaaaaaucuuuaagccuguccgguaag

SEQ ID NO: 28174 - RNA, 1350 nt, Artificial Sequence
  derived and/or modified sequence opt3 from anti-influenza_Chain
caggugcaacugcagcagagcggcgccgaggucaagaaacccggguccucuguuaaggugucaugcaaaguaaguggagugaucuucagcgguuccgcuauuucuugggucagacaggcaccuggccaagggcucgaauggaugggaggcauaucgccacuuuuugguaccacaaacuacgcccagaaguuccaggggagggugacuaucacggcggaccagucaaccaauacaacuuauauggagguuaacagccugcgguacgaagauaccgcuguguauuuuugugcccgcggaccgaaauacuauagugaguacauggacgucuggggcaagggcacaaccgugacuguauccucugcaagcacaaaggggcccuccguuuucccuuuggccccaucaaguaaaagcaccucuggagguacggcugcauuaggcugccuggugaaggauuauuuucccgaaccugucacuguguccuggaacucaggggcccuaaccagcggagugcacacauucccagcuguccuccaaaguucuggccuguacucccuuagcucgguugugacuguacccucuuccucacuggguacccagacauacauuuguaaugugaaucauaaaccuaguaacaccaaggucgacaaacgaguggagccaaagagcugcgauaagacgcacacuuguccgcccugcccugccccagaguugcucgggggacccuccguuuuucuguucccuccaaaacccaaggacacacugaugaucucucguaccccggaagugacuugugucgugguagauguuagccaugaggacccugaagugaaauuuaauugguaugucgauggcguggagguccacaacgcgaagacaaaacccagagaggaacaguacaauucaaccuauagggugguuagugugcucacgguauuacaucaggacuggcugaacggcaaggaguacaaaugcaaggucuccaauaaggcacuuccagccccuauugaaaagaccaucagcaaggcuaaagggcaaccccgggagccacagguguauacauugcccccuucucgcgaagagaugacuaagaaccagguuucacugaccugucuagugaaaggauucuacccaagugauauagccgucgagugggaaagcaauggucaaccggagaacaauuauaagacaacucccccugugcucgacuccgauggcucguuuuuccuguacucuaaacuuaccguagacaaaagcagauggcagcaggggaacguguuuuccugcucaguuaugcacgaagcacugcacaaccauuacacacagaagaguuugucucucagcccaggaaaa

SEQ ID NO: 28175 - RNA, 1350 nt, Artificial Sequence
  derived and/or modified sequence opt3 from anti-influenza_Chain
caggugcaacugguccagagcggcgccgagguuaagaaacccggguccucugugaagguaucaugcaaagcuaguggagguaccuucagcuccuacgcaaucucuugggugagacaggccccuggccaggggcucgaauggaugggaggcauuauggguauguuugggacaacuaacuaugcgcaaaaguuccagggaagggucacgauaaccgcugacgaguuuacaucggccgcauacauggaacuucggucacugcgcagcgaggauacugccguguauuacugugcucgaaguuccggcuauuacccagaauauuuccaggacuggggccaggggaccuugguuacagugucuagcgcauccaccaaaggaccgucagucuuucccuuagccccuaguagcaagucuacuuccgguggcacagcugcccuggggugccuagugaaggauuacuucccagagcccguaaccguuucauggaauagcggagcgcucacgaguggcgugcacacuuuuccugcaguccugcaaucuuccggucuuuacagccugucgucuguggugaccgucccauccucaaguuuggggacacagacuuauaucuguaacguuaaucauaaacccagcaacaccaagguggacaaacguguagagccuaaguccugcgauaaaacacacaccuguccaccgugccccgccccugaacuccugggaggcccaucuguguuccuguuucccccuaagccaaaggacacgcucaugauuagcagaacucccgaggucacaugugugguuguggaugucucacaugaagacccggaggugaaauucaauugguacguagauggcguugaggugcacaacgcuaagaccaaaccuagggaggaacaguauaauaguacuuaccgggucguguccgucuuaacagugcugcaucaggacuggcuuaacgggaaggaauauaaaugcaagguuagcaauaaagccuugcccgcaccaaucgagaagaccauuucuaaggcuaaaggacaaccucgcgaaccccagguguacacgcugccacccucaagagaggagaugaccaagaaccagguaagucuaacaugucucgucaaagguuuuuauccuagcgauaucgccguggaaugggaguccaauggccaaccagaaaacaauuacaagacuaccccgcccguucuggacucugaugggucguucuuucuuuacagcaaacugacaguggacaaguccagguggcagcagggaaacgucuucucaugcagugugaugcacgaggcguugcacaaucauuauacucagaagucucucagccuguccccuggcaaa

SEQ ID NO: 28176 - RNA, 1350 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguaccuucagcuccuacggcaucucuugggugagacaagcaccugggcagggacucgaauggaugggcgacauuauagguauguuugggucgacaaacuaugcccagaauuuccagggaaggcuuacuaucacggcggaugagucaaccagcacagcuuacauggaacugaguuccuugcggucugaggacacugccgucuauuacugugcacgcagcuccggcuauuacccagccuauuuaccgcacuggggccaagggacccuggugacaguuucaagugcuagcaccaagggacccucuguguuuccucuagcaccauccucaaaaagcaccagugguggcacagccgcucucgggugccuggucaaggauuacuuccccgagccugugaccguaucuuggaacuccggagcccuuacgagcggcguucauacuuuuccagcggugcugcagucgucugguuuguacucccucucaagugucgugaccgugcccagcuccucucuggggacacagacuuauauuuguaaugucaaccacaagccuagcaauaccaaaguugacaagcgaguggaaccaaaaucaugcgauaagacacauaccuguccgcccugcccugcaccagagcugcucggaggccccaguguauucuuauuuccuccaaaacccaaggacacgcugaugaucucccguacuccggaagugacaugugucgugguugaugugagccacgaggacccugaggucaaguucaacugguacguggauggcguagaaguucauaaugccaaaaccaagcccagagaggaacaguauaacucuacuuacaggguggucucagugcuuacagucuugcaccaagacuggcugaaugggaaagaguauaagugcaaagugaguaacaaggcucuaccagccccuauugagaaaaccaucagcaaggcaaagggacagccccgggaaccacagguuuacacgcugcccccuucccgcgaggaaaugaccaaaaaucaggugucucucacaugucuuguaaaggguuuuuauccaucggauauagcugucgagugggaaagcaacggccaaccggagaauaacuacaaaacuacucccccugugcuggacuccgaugggucauucuuuuuguacaguaagcucacaguugacaaaucuagauggcagcagggaaauguguucagcugcuccgucaugcacgaagcccugcauaaccacuauacucaaaagucauuaagccugucuccaggcaag

SEQ ID NO: 28177 - RNA, 1350 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguaccuucagcuccuacgcaaucucuugggugagacaagccccuggccaggggcucgaauggaugggaggcauuauagguauguuugggacagcgaacuaugcucagaaguuccagggaagggucacuaucacggccgacgaguuuaccucgacagcauacauggaacuuucaagccugcggagugaggauacugccguguauuacugugcucgcggcaauuauuacuaugaguccucuuuggacuacuggggccaagggaccuuaguuacagugagcuccgcaucaaccaaaggaccaagugucuucccgcuggcccccagcucuaaguccacuucagguggcacagcugcccuagggugccucgugaaggauuacuuuccugaaccaguaaccguuagcuggaacaguggagcgcugacgucuggcgugcacacuuuccccgcaguccuucaguccagcggucuguauucguugucuuccguggugaccgucccuucaaguagccucgggacacagacuuacauuuguaauguuaaccauaaaccauccaauaccaagguggacaaacgaguagagcccaagucuugcgauaaaacacacaccuguccuccaugcccggcccccgaacugcugggaggcccuagcguguuucucuucccacccaagccuaaggacacguuaaugaucucacguacuccagaggucacaugugugguuguggaugucagucaugaggaccccgaagugaaauuuaacugguauguagauggcguugaggugcacaaugcuaagaccaaaccgagagaggaacaguacaacuccacuuauagggucgugagcguccugacagugcuucaucaagacugguugaaugggaaggaauacaaaugcaagguuucuaacaaagcccugccugcacccauugagaagaccaucucaaaggcuaaaggacagccacgggagccucagguguauacgcuacccccaagucgcgaagagaugaccaagaaucagguaagccucacaugucuggucaaagguuucuaccccuccgauauagccguggaaugggagucuaacggccaaccugaaaauaacuacaagacuaccccaccgguucuugacucggaugggagcuuuuuccuguauuccaaauugacaguggacaagucaagauggcagcagggaaaugucuuuaguugcucugugaugcacgaggcgcuccacaaccauuacacucaaaagagccuguccuuaucacccggcaaa

SEQ ID NO: 28178 - RNA, 1350 nt, Artificial Sequence
  derived and/or modified sequence opt3 from anti-influenza_Chain
gaggugcagcugguccaaagcggcgccgaaguuaagaaacccggguccucuaugaaggugucaugcaaagcuaguggaagcaucuucuccaacuacgguauuucuuggguaagacaggcaccuggccaggggcucgaguggaugggaggcauaaucccaauuuuuggugccgcgaauuaugcucagaaguuccaagggagggugaccaucacagccgacgaaucgacuucaacggucuacauggaggugcggagccuucgcagugaagauaccgcaguuuauuacugugcccgacgucagcagcuguauaaaggauacuaucaccauuggggccagggcacauuggugacugucuccucugcuagcaccaaggggccguccguguuucccuuagcaccuucaaguaagagcacaucuggagguaccgccgcucugggcugccuaguaaaagacuacuucccagagcccguuacuguguccuggaacucaggggcccucacaagcggaguccacaccuuuccugcggugcugcaaaguucuggccuuuacucccugagcucgguggucacgguuccaucuuccucauuggguacucagaccuauauuuguaaugugaaccauaagcccaguaauacaaaaguagauaagaaaguggagccuaagagcugcgacaagacucacaccuguccaccgugccccgcaccugaacuccucgggggaccauccgucuuccuguuucccccuaaaccaaaggauacacugaugaucucuagaacccccgaggugacguguguuguggucgacgugagccaugaagauccggagguaaaauucaacugguacguugacggcguggagguccacaaugccaagacuaaaccuagggaggaacaguauaacucaacauaccggguggucaguguguuaaccguucugcaccaggauuggcuuaauggcaaggaauauaaaugcaagguguccaacaaggcuuugcccgccccaauagagaaaacuaucagcaaggcaaaagggcaaccucgcgaaccccagguauacacacugccacccucuagagaggagaugaccaagaaucaggucucacuaacgugucucgugaaaggauuuuauccuagugacauugcuguugaaugggagagcaacggucaaccagaaaauaacuacaagaccacaccgcccgugcuggauuccgacggcucuuucuuucuuuacucgaagcugacugucgauaaauccagguggcagcaggggaauguguucagcugcucaguaaugcaugaggccuugcacaaccauuauacccagaagagucucucucugagcccuggaaaa

SEQ ID NO: 28179 - RNA, 1350 nt, Artificial Sequence
  derived and/or modified sequence opt3 from anti-influenza_Chain
caggugcaacugguccagagcggcgccgggguuaagaaacccggauccucuaugaaggugucaugcaaagcuagugguagcaucuucuccaacuacggcauuucuuggguaagacaggcaccugggcagggacucgaguggaugggcgguauaaucccaauuuuuggggccgcgaauuaugcucaaaaguuccagggaagggugaccaucacagccgacgaaucgacuucaacggucuacauggaggugcggagccuucgcagugaagauaccgcaguuuauuacugugcccgacgucagcagcuguauaaaggcuacuaucaccauuggggccaagggacauuggugacugucuccucugcuagcaccaagggaccguccguguuucccuuagcaccuucaaguaagagcacaucugguggcaccgccgcucuggggugccuaguaaaagacuacuucccagagcccguuacuguguccuggaacucaggagcccucacaagcggcguccacaccuuuccugcggugcugcagaguucuggucuuuacucccugagcucgguggucacgguuccaucuuccucauuggggacucagaccuauauuuguaaugugaaccauaagcccaguaauacaaaaguagauaagaaaguggaaccuaagagcugcgacaagacucacaccuguccaccgugccccgcaccugagcuccugggaggcccauccgucuuccuguuucccccuaaaccaaaggauacacucaugaucucuagaacccccgaggugacguguguuguggucgacgugagccaugaagauccggagguaaaauucaacugguacguugacggcguggaaguccacaaugccaagacuaaaccuagggaggagcaguauaacucaacauaccggguggucaguguguuaaccguucugcaccaagauuggcuuaaugggaaggaauauaaaugcaagguguccaacaaggcuuugcccgccccaauagagaaaacuaucagcaaggcaaaaggacagccucgcgaaccccagguauacacacugccacccucuagagaggaaaugaccaagaaucaagucucacuaacgugucucgugaaagguuuuuauccuagugacauugcuguugagugggagagcaacggccagccagaaaauaacuacaagaccacaccgcccgugcuggauuccgacgggucuuucuuucuuuacucgaagcugacugucgauaaauccagguggcagcagggaaauguguucagcugcucaguaaugcaugaggccuugcacaaccauuauacccaaaagagucucucucugagcccuggcaaa

SEQ ID NO: 28180 - RNA, 1350 nt, Artificial Sequence
  derived and/or modified sequence opt3 from anti-influenza_Chain
caggugcaacugguccagagcggcgccgagguuagaaagcccggguccucugugaaaguaucaugcaaggugaguggagguaucauuaggaaauacgcuauaaacuggguccggcaggcaccuggccaggggcucgaauggaugggaggcaucauugccaucuucaauaccgcgaacuaugcucaaaaguuucagggucgcgugacaauuacugccgacgagagcacguccaccguuuacauggaacuuucuucgcugcgaucagaggauacagcauuguauuacugugcccgugggaugaauuauuacagcgacuauuucgauuacuggggacagggcaguuuagugacugucuccccagcuucuaccaaaggcccgagcguguuuccccuggcaccuuccucaaagaguacaagcgggggaaccgccgcucuagguugccucguaaaggacuacuucccagaacccguuacugugucuuggaacuccggcgcccugacaucagggguccacaccuuuccugcggugcuucagagcaguggacuguauucuuuguccagcguggucacgguuccaucgucuucccucggcacucaaaccuacaucuguaaugugaaccauaaacccucaaauacaaagguagauaaaaagguggagccuaaaaguugcgacaagacucacaccuguccaccgugccccgcaccugagcugcugggugggccaagcgucuuccucuuucccccuaagccaaaagauacauuaaugauauccagaacccccgaagugacguguguuguggucgacgugucucaugaggauccggaaguaaaguucaacugguauguugacggaguggagguccacaaugccaaaacuaagccuagggaggaacaguacaacagcacauaucggguggucucagugcugaccguucuucaucaggauugguugaauggcaaagaguacaagugcaaagugaguaacaaggcucugcccgccccaaucgaaaagacuauuuccaaagcaaagggccagccucgcgagccccaaguauauacacuaccacccagcagagacgaacucaccaaaaaucaggucucucugacgugucuugugaagggguuuuacccuucagauaucgcuguugagugggagaguaacggacagccagaaaauaacuacaaaaccacaccgcccgugcuggacagcgacgguuccuucuuuuuguauucuaagcucacugucgauaagucgagguggcaacagggcaacguguucagcugcuccguaaugcacgaggcccugcacaaucauuacacccagaaaucauuaagucugucuccugggaag

SEQ ID NO: 28181 - RNA, 1350 nt, Artificial Sequence; identical to SEQ ID NO: 28180
  derived and/or modified sequence opt3 from anti-influenza_Chain

SEQ ID NO: 28182 - RNA, 1350 nt, Artificial Sequence; identical to SEQ ID NO: 28178
  derived and/or modified sequence opt3 from anti-influenza_Chain

SEQ ID NO: 28183 - RNA, 1350 nt, Artificial Sequence; identical to SEQ ID NO: 28179
  derived and/or modified sequence opt3 from anti-influenza_Chain

SEQ ID NO: 28184 - RNA, 1350 nt, Artificial Sequence; identical to SEQ ID NO: 28174
  derived and/or modified sequence opt3 from anti-influenza_Chain

SEQ ID NO: 28185 - RNA, 1350 nt, Artificial Sequence; identical to SEQ ID NO: 28175
  derived and/or modified sequence opt3 from anti-influenza_Chain

SEQ ID NO: 28186 - RNA, 1350 nt, Artificial Sequence; identical to SEQ ID NO: 28176
  derived and/or modified sequence opt3 from anti-influenza_Chain

SEQ ID NO: 28187 - RNA, 1350 nt, Artificial Sequence; identical to SEQ ID NO: 28177
  derived and/or modified sequence opt3 from anti-influenza_Chain

SEQ ID NO: 28188 - RNA, 1353 nt, Artificial Sequence
  derived and/or modified sequence opt3 from anti-influenza_Chain
gaggugcagcuggucgaaagcggcgccgagguuaagaaacccggguccucugugaagguaucaugcaaagcuaguggagguccuuucagaagcuacgcaaucuccugggugaggcaagccccaggccaggggccggaauggaugggaggcauuauacccaucuuugguaccacaaaguaugcgccuaaauuccaggggcgggucacuauuacggcugacgauuuugccggaaccguguacauggagcucucuucgcuucgcucagaagacacagcaauguauuacugugccaagcacaugggcuaucagguucgagagacuauggauguguggggcaaggggaccacagucaccgugagcagugcuuccacuaaaggaccaucuguauucccccuggcaccuagcuccaagucaacaagugguggcaccgccgcuuuggggugcuuaguuaaagacuacuuuccagagcccgugacggucagcuggaacucuggagcccugacuuccggcgugcauaccuucccugcggugcuacaaucaagcggucucuauagucugucuuccgucguuacagugccaagcucgucucuugggacucagaccuacaucuguaauguaaaccacaagccguccaauacaaaaguggauaagcgugucgaacccaagucaugcgacaaaacccauacguguccuccaugccccgcaccugagcuguugggaggcccaaguguguuucucuuucccccgaagccuaaagauacucugaugauuagcagaacacccgaaguuaccuguguggucguggacguaucccacgaggauccagagguuaaguucaacugguacguggacggcgucgaagugcauaaugccaaaacuaagccuagggaggaacaguauaacucuacauaccgggucgugagcguucugaccgugcuccaccaggauugguuaaaugggaaagaguauaagugcaagguaucaaacaaagcucugcccgccccaaucgaaaagacgauaaguaaagcaaagggacaaccccgcgagccucaggucuacacccuuccaccguccagagaggaaaugacuaaaaaucaggugagcuugacaugucugguuaaggguuucuaucccucugacaucgcuguggagugggaaucaaacggccagccugagaauaacuacaagaccacaccacccguccuagauagugacgggagcuuuuuccucuauuccaaacugacuguggacaagucuagguggcaacagggaaauguauuuucgugcagcgugaugcacgaagcccuucauaaccacuacacccagaaaucccugucauugaguccuggcaag

SEQ ID NO: 28189 - RNA, 1353 nt, Artificial Sequence
  derived and/or modified sequence opt3 from anti-influenza_Chain
caggugcaacugguccagagcggcgccgagguuaagaaacccggguccucugugaagguaucaugcaaagcuaguggagguccuuucagaagcuacgcaaucuccugggugaggcaggccccaggccaggggccggaauggaugggaggcauuauacccaucuuugguaccacaaaguaugcgccuaaauuccaagggcgggucacuauuacggcugacgauuuugccggaaccguguacauggagcucucuucgcuucgcucagaagacacagcaauguauuacugugccaagcacaugggcuaucagguucgagagacuauggauguguggggcaaggggaccacagucaccgugagcagugcuuccacuaaaggaccaucuguauucccccuggcaccuagcuccaagucaacaagugguggcaccgccgcuuuggggugcuuaguuaaagacuacuuuccagaacccgugacggucagcuggaacucuggagcccugacuuccggcgugcauaccuucccugcggugcuacagucaagcggucucuauagucugucuuccgucguuacagugccaagcucgucucuugggacucagaccuacaucuguaauguaaaccacaagccguccaauacaaaaguggauaagcgugucgagcccaagucaugcgacaaaacccauacguguccuccaugccccgcaccugagcuguugggaggcccaaguguguuucucuuucccccgaagccuaaagauacucugaugauuagcagaacacccgaaguuaccuguguggucguggacguaucccacgaggauccagaaguuaaguucaacugguacguggacggcgucgaggugcauaaugccaaaacuaagccuagggaggaacaauauaacucuacauaccgggucgugagcguucugaccgugcuccaccaggauugguuaaaugggaaagaguauaagugcaagguaucaaacaaagcucugcccgccccaaucgaaaagacgauaaguaaagcaaagggacagccccgcgagccucaggucuacacccuuccaccguccagagaagagaugacuaaaaaucaagugagcuugacaugucugguuaaggguuucuaucccucugacaucgcuguggagugggaaucaaacggccagccugagaauaacuacaagaccacaccacccguccuagauagugacgggagcuuuuuccucuauuccaaacugacuguggacaagucuagguggcagcaaggaaauguauuuucgugcagcgugaugcacgaagcccuucauaaccacuacacccagaaaucccugucauugaguccuggcaag

SEQ ID NO: 28190 - RNA, 1353 nt, Artificial Sequence
  derived and/or modified sequence opt3 from anti-influenza_Chain
gaggugcagcuggucgaaagcggcgcugagguuaagaaacccggguccucugugaagguaucaugcaaagcuaguggagguaccuucagcuuuuacuccaugucuugggugagacaagcaccuggccaggggcucgaauggaugggaggcaucauuccaauguucgguacaacuaacuaugcccagaaguuucaggggagggucacgauaaccgcgguggagucgacaucaacugcuuacauggaaguuagcagucuucgguccgaggacaccgccguguauuacugugcacgcggagauaaaggcaucuauuacuauuacauggacgucuggggcaaggggacaaccgugacuguaucuagcgccuccacaaagggaccgucaguuuucccccuggcuccuaguagcaaaucuaccuccgguggcacggcagccuuggggugcuuagugaaggauuacuuuccagagcccgucacugugucauggaauagcggagcucugaccaguggcgugcacacauucccugccguccuacaaucuuccggucucuauagccugucgucuguugugacuguaccauccucaagucuugggacccagacauacauuuguaacgugaaucauaaacccagcaacaccaaggucgacaaacgaguggaaccuaaguccugcgauaagacgcacacuuguccaccgugccccgcgccugagcuguugggaggcccaucuguuuuucucuuucccccuaaaccaaaggacacacugaugaucagccguacccccgaagugacuugugucgugguagauguuucacaugaggacccggaggugaaauucaauugguaugucgauggcguggaaguccacaacgcaaagacaaaaccuagagaggaacaguacaauaguaccuauagggugguuuccgugcugacgguacuccaucaggacugguuaaacgggaaggaguacaaaugcaaggucagcaauaaggcccugcccgcuccaauugagaaaaccaucucuaaggccaaaggacaaccucgggaaccccagguguauacacuuccacccucacgcgaggaaaugacuaagaaccagguuaguuugaccugucuggugaaagguuucuacccuagcgauauagcagucgagugggaauccaauggccagccagagaacaauuacaagacaacuccgcccgugcuagacucugaugggucguuuuuccucuauagcaagcugaccguagacaaauccagauggcaacagggaaacguguuuucaugcaguguuaugcacgaagcccuucacaaucauuacacacagaagucucugagcuuguccccuggcaaa

SEQ ID NO: 28191 - RNA, 1353 nt, Artificial Sequence; identical to SEQ ID NO: 28188
  derived and/or modified sequence opt3 from anti-influenza_Chain

SEQ ID NO: 28192 - RNA, 1353 nt, Artificial Sequence; identical to SEQ ID NO: 28189
  derived and/or modified sequence opt3 from anti-influenza_Chain

SEQ ID NO: 28193 - RNA, 1353 nt, Artificial Sequence; identical to SEQ ID NO: 28190
  derived and/or modified sequence opt3 from anti-influenza_Chain

SEQ ID NO: 28194 - RNA, 1356 nt, Artificial Sequence
  derived and/or modified sequence opt3 from anti-influenza_Chain
caggugcaacugguccagagcggcgggggacucguuaagcccgguggcucccuuagacugucuugcgccgcuucaggguucaccuuuaguagcuacuccaugaacugggugaggcaggcaccuggaaaaggcuuggaguggguaucuucgaucucaagcaguuccucuuauauuuacuauguggacagcgucaagggucgguucacaauaucccgcgauaaugccaaaaacucauuauaccugcagaugaauagucuacgagcggaagacacugcuguguauuacugugcccgugggggaggcagcuauggcgcauacgagggguuugauuacuggggacaagguacgcucguuaccgugucuuccgccucaacaaagggcccaagcgucuucccgcuggcucccaguucuaaauccacuagcgggggaaccgcagcccuuggcugccuggugaaggacuauuuuccugaaccaguaacaguuucguggaacucuggugcuuugaccuccggggugcacacuuuccccgccguccuccagucaaguggacuguacagccuguccucuguggugacagucccuagcucaagucucggcacccagacguauaucuguaauguuaaccauaagccauccaauacuaaaguggauaagagaguagagcccaaaagcugcgacaagacccacacauguccuccaugcccggcgcccgaauuacugggcgggccuucuguguuucuuuucccacccaaaccuaaggauacuuugaugauuucaaggaccccagaggucacaugugugguuguggacgucagucaugaggaucccgaagugaaguuuaacugguacguagacggaguugaggugcacaaugcaaaaaccaagccgcgggaagaacaguauaacagcacguaccgcgucguguccguccugacugugcuacaucaagauuggcucaaugguaaagaguauaagugcaaaguuucuaacaaggcccugccugcucccaucgagaaaacaauuucgaaggccaagggccagccaagagagccucagguguacacccuucccccaagcagggaagagaugacuaaaaaucagguaucccugacauguuuggucaagggguucuaccccucagacaucgcaguggaaugggagaguaacggacaaccugagaauaacuauaaaaccacgccaccgguucucgauucugacggcagcuuuuuccuguacuccaaguuaaccguggacaaaucacgguggcagcaggguaacgucuuuagcugcucugugaugcacgaagcucugcacaaucauuauacacaaaagucccucagucuuagccccgggaag

SEQ ID NO: 28195 - RNA, 1356 nt, Artificial Sequence
  derived and/or modified sequence opt3 from anti-influenza_Chain
caggugcaacugguccagagcggcgccgagguuaagcagcccggggcuuccgugaaaguaucuugcaaggcaucaggauacaccuucaacgccuauuacauccacugggugagacaggcgccuggucaaggccucgaauggaugggguggauuaauccaaacuuuggaggcacacauuaugcuaggaaauuccagggucgggucacuaugacgcgcgacgccaguauaaauaccgcauacauggagcuugaucgacugaucagcgacgauacagccguguauuacuguguucguuggagagcugcagccgugauuauggaccaguuuuauaagauggaugucugggggcagggaacuuuggugaccguauccucugcuucgacaaaaggcccgucaguuuuccccuuagccccuugcagcaggaguaccuccgaaucuacugcggcacugggcugucuagugaaggacuacuuuccagagcccgucacagugagcuggaacuccggggcccucaccucaggagugcacacguucccugcuguccugcaaaguagcggucuuuacucucuguccucaguugugacuguaccaagcaguucuuugggcaccaagacauauacuugcaauguggaucauaaacccuccaacaccaaggucgacaaaacacgggaaagcaaguacgggccuccauguccgucgugccccgccccugaguuucucggaggcccaucuguguuccuguuucccccuaaaccaaaggauacccugaugaucucccgcacgcccgagguuacuuguguggucguggacguaucacaggaagauccggagguucaguucaauugguauguggacggugucgaagugcacaacgcaaagacaaaaccuagagaggagcaguuuaauaguaccuacagggucgugagcguucucacuguguuacaucaagauuggcugaacgggaaggaauauaaaugcaagguauccaauaaaggacuucccucuagcauugagaagacaaucucaaaagcuaagggccagccacgggaaccucaggucuacaccuugcccccagcccaagaggaaaugacgaagaaccaggugagucugaccugucuaguuaaaggcuucuaucccuccgacauagcgguggagugggagagcaaugggcagccugaaaacaauuacaagacaacuccaccgguccucgacucugauggaucauuuuuccuguacagucgccuuaccguggacaaaagccgauggcaggaggguaacguauucuccugcucugugaugcacgaagcccugcacaaccauuauacacaaaagucguugagccucucccugggcaaa

SEQ ID NO: 28196 - RNA, 1356 nt, Artificial Sequence
  derived and/or modified sequence opt3 from anti-influenza_Chain
gaggugcagcugguccaaagcggcgccgaaguuaagaaacccggggcuuccgugaagguaucuugcaaagcaucaggauacaucuucaccgguuauuacauucacugggugagacaggccccuggccaggggcucgaguggaugggaaggauagacccaaacggcgcggguacaacuuaugcucagaaguuucaagggcgggucacgcuuaccauggauacaaguaucacuaccgccuacauggaacugagccgcuugcgauucgacgauacagcaauuuauuacugugcccguugggacuggaauuuugauuuauaucugggaugguucgacccguggggccagggcacccccgugacuguugcuuccgcaucuacaaaagggccuucgguguuuccacuagcccccucaagcaagaguaccuccggagguacggcugcccucggcugccuggucaaggauuacuucccugagccagugacuguaucuuggaacagcggggcgcuuaccuccggaguucauacauuucccgcagugcugcagucaaguggcuuguacagccucucuuccgucgugacugugccuucaagcagucuggguacccagacauauaucuguaaugucaaccacaaaccaucuaauaccaagguugacaaaaagguggaaccgaaauccugcgauaagacgcauacuugucccccuugcgccccagagcugcucgggggacccagcguauucuuauuuccuccaaagcccaaagacacacugaugauuucgagaaccccggaggugacuugugucgugguugaugugucucacgaagacccugaggucaaguucaacugguacguggauggcguagaaguucauaaugcuaaaacaaagcccagggaggagcaauauaacuccaccuaccggguggucucagugcuuacggucuugcaccaggacuggcugaauggcaaagaauauaagugcaaagugaguaacaaggcccuaccagcaccuaucgagaagaccauaagcaaagcuaaggggcagccccgcgaaccacagguuuacacauuacccccuuccagagaggaaaugacuaaaaaucaagugucucugaccugucuuguaaagggauuuuauccaagcgacaucgccgucgagugggagucaaacggucagccggaaaauaacuacaaaacaacucccccugugcuggauagugacggcuccuucuuuuuguacagcaagcucaccguugauaagucuagguggcagcaagggaauguguucucaugcagugucaugcacgaggcgcugcauaaccacuauacacagaaaagccucucccugucuccaggaaag

SEQ ID NO: 28197 - RNA, 1356 nt, Artificial Sequence; identical to SEQ ID NO: 28195
  derived and/or modified sequence opt3 from anti-influenza_Chain

SEQ ID NO: 28198 - RNA, 1356 nt, Artificial Sequence; identical to SEQ ID NO: 28194
  derived and/or modified sequence opt3 from anti-influenza_Chain

SEQ ID NO: 28199 - RNA, 1356 nt, Artificial Sequence; identical to SEQ ID NO: 28196
  derived and/or modified sequence opt3 from anti-influenza_Chain

SEQ ID NO: 28200 - RNA, 1359 nt, Artificial Sequence
  derived and/or modified sequence opt3 from anti-influenza_Chain
caggugcaacugguccagagcggcgccgagguuaagaaacccggguccucugugagaguaucaugcaaggcuaguggaagcaucuucaggaacuacgcaauguccugggugcggcaggccccuggucagggccucgaauggaugggagggauuauagcgaucuuuggcaccccaaaauaugcucaaaaguuccagggucgcgucacaauuacugccgacgagucuacgucgaccguguacauggaacuuucagggcugcgaagcgaggauacagcaauguauuacugugcccguaucccgcacuauaauuuuggaaguggcuccuacuucgacuauuggggccaggggacuuugguuaccgugucuagcgcuuccacaaaaggacccucagucuuuccuuuagcaccaaguagcaagucuaccuccgguggcacugccgcucuggggugccuagugaaggauuacuuccccgaaccuguaacaguuucauggaacagcggagcccucaccaguggcgugcauacguuuccagcgguccugcagucuuccggucuuuacagccugucgucuguggugacuguccccuccucaaguuuggggacccaaacauauauuuguaauguuaaccacaaaccuagcaauacuaagguggacaaaagaguagagccaaaguccugcgauaaaacccauacauguccgcccugcccugcaccagagcuccugggaggccccucuguguuccuguuuccuccaaagcccaaggacacccucaugaucagcaggacgccggaagucacuugugugguuguggaugucucacacgaggacccugaagugaaauucaacugguacguagauggcguugaggugcauaaugccaagacaaaaccccgggaggaacaguauaacaguaccuaccgcgucguguccgucuuaacugugcugcaccaggacuggcuuaaugggaaggaguauaaaugcaagguuagcaacaaagccuugccagcuccuauagaaaagacaaucucuaaggcaaaaggacagcccagagagccacaaguguacacccugcccccuucaagggaagagaugacgaagaaucagguaagucuaaccugucucgucaaagguuuuuauccaagcgauauugcuguggagugggaauccaacggccagccggagaauaacuacaagacaacucccccuguucuggacucugaugggucguucuuucuuuacagcaaacugaccguggacaagucccgguggcaacagggaaaugucuucucaugcagugugaugcacgaagccuugcauaaccacuauacacagaagucucucagccuguccccaggcaaa

SEQ ID NO: 28201 - RNA, 1359 nt, Artificial Sequence
  derived and/or modified sequence opt3 from anti-influenza_Chain
caggugcaacugguccagagcggcgccgagguuaagaaacccggggcuuccgugaagguaucuugcaaagcaucaggauacaucuucaccgguuauuacauucacugggugagacaggccccuggccaggggcucgaauggaugggaaggauagacccaaacggcagugguacaacuuaugcgcaaaaguuucaggggcgggucacgcuuaccauggauacaagcaucacuaccgcuuacauggagcugucccgcuugcgauucgacgauacagccauuuauuacugugcacguugggacuggaauuuugauuuauaucugggaugguucgacccguggggccagggcacccccgugacuguugccucugcuucgacaaaagggccuucaguguuuccacuagcacccagcaguaaguccaccucuggagguacggccgcucucggcugccuggucaaggauuacuucccugaaccagugacuguaagcuggaacuccggggcccuuaccucaggaguucauacauuucccgcggugcugcagaguagcggcuuguacucucucuccucagucgugacugugccuagcaguucucuggguacccaaacauauaucuguaaugucaaccacaaaccauccaauaccaagguugacaaaaagguggagccgaaaagcugcgauaagacgcauacuugucccccuugcccagcacccgaacugcucgggggaccuucgguauucuuauuuccacccaagccgaaagacacacugaugauuucuagaaccccugaggugacuugugucgugguugaugugucccacgaggaccccgaagucaaguucaacugguacguggauggcguagagguucauaaugccaaaacaaagccaagggaggaacaguauaacucaaccuaccggguggucagugugcuuacggucuugcaccaggacuggcugaauggcaaagaguauaagugcaaagugagcaacaaggcucuaccugcccccaucgaaaagaccauauccaaagcaaaggggcagccacgcgagccccaaguuuacacacucccuccaucuagagaagagaugacuaaaaaucaggugagccugaccugucuuguaaagggauuuuauccgucagacaucgcugucgaaugggagaguaacggucagcccgagaauaacuacaaaacaacuccuccagugcuggauuccgacggcagcuucuuuuuguacucuaagcucaccguugauaagucaagguggcaacaggggaauguguucaguugcagcgucaugcacgaagcccugcauaaccacuauacacagaaauccuuaucucugucgcccggaaag

SEQ ID NO: 28202 - RNA, 1359 nt, Artificial Sequence
  derived and/or modified sequence opt3 from anti-influenza_Chain
gaggugcagcugguccaaagcggcgccgaaguuaagaaacccggggcuuccgugaagguaucuugcaaagcaucaggauacaucuucaccgguuauuacauucacugggugagacaggccccuggccaggggcucgaguggaugggaaggauagacccaaacggcgcggguacaacuuaugcucagaaguuucaagggcgggucacgcuuaccauggauacaaguaucacuaccgccuacauggaacugagccgcuugcgauucgacgauacagcaauuuauuacugugcccguugggacuggaauuuugauuuauaucugggaugguucgacccguggggccagggcacccccgugacuguugcuuccgcaucuacaaaagggccuucgguguuuccacuagcccccucaagcaagaguaccuccggagguacggcugcccucggcugccuggucaaggauuacuucccugagccagugacuguaucuuggaacagcggggcgcuuaccuccggaguucauacauuucccgcagugcugcagucaaguggcuuguacagccucucuuccgucgugacugugccuucaagcagucuggguacccagacauauaucuguaaugucaaccacaaaccaucuaauaccaagguugacaaaaagguggaaccgaaauccugcgauaagacgcauacuugucccccuugcccagcccccgagcugcucgggggaccuagcguauucuuauuuccacccaagccgaaagacacacugaugauuucgagaaccccugaggugacuugugucgugguugaugugucucacgaagaccccgaggucaaguucaacugguacguggauggcguagaaguucauaaugcuaaaacaaagccaagggaggagcaauauaacuccaccuaccggguggucucagugcuuacggucuugcaccaggacuggcugaauggcaaagaauauaagugcaaagugaguaacaaggcccuaccugcacccaucgagaagaccauaagcaaagcuaaggggcagccacgcgaaccccagguuuacacacucccuccauccagagaggaaaugacuaaaaaucaagugucucugaccugucuuguaaagggauuuuauccgagcgacaucgccgucgagugggagucaaacggucagcccgaaaauaacuacaaaacaacuccuccagugcuggauagugacggcuccuucuuuuuguacagcaagcucaccguugauaagucuagguggcagcaagggaauguguucucaugcagugucaugcacgaggcgcugcauaaccacuauacacagaaauccuuaagccugucucccggaaag

SEQ ID NO: 28203 - RNA, 1359 nt, Artificial Sequence
  derived and/or modified sequence opt3 from anti-influenza_Chain
caggugcaacugguccagagcggcgccgagguuaagaaacccggggcuuccgugaagguaucuugcaaagcaucaggauacaccuucaacgcccaccauaugcacugggugagacaggcgccuggucagggccucggguggaugggauggaucgacccaaauaacgauggcacaauuuaugcucaaaaguuucaggguagggucacucuuacgauggacaccaguauacauacagccuacauggaacugagcggguugcgguaugaugacacugcaaucuacuauugugugcgcugggccuggaauuucgacuuuuucuuaggaugguuugauccguggggccagggcacccugguuacaguggcuuccgcaucuaccaaagggcccucggucuucccucuagccccaucaagcaagaguacuuccggagguacagcugcccucggcugccuggugaaggauuacuuucccgagccuguaaccguuucuuggaacagcggggcgcuuacguccggagugcacacuuucccagcaguccugcagucaaguggcuuguauagccucucuuccguggugaccguccccucaagcagucuggguacacaaacuuacauuuguaauguuaaccauaaaccuucuaauaccaagguggacaaaaagguagaaccaaaauccugcgauaagacacacaccuguccgcccugcccugccccagagcugcucgggggacccagcguguuuuuauucccuccaaagcccaaagacacgcugaugaucucgcgaacuccggaagucacaugugugguuguggaugucucucacgaggacccugaggugaaguuuaacugguacguagauggcguugaagugcauaaugcuaaaaccaagccccgugaggaacaguauaacuccacuuacagagucgugucaguccuuacaguguugcaccaggacuggcugaauggcaaagaguauaagugcaaaguuaguaacaaggcccuaccagcaccuauugagaagaccaucagcaaagcuaaggggcagcccagggaaccacaaguguacacguuacccccuucccgggaggaaaugaccaaaaaucagguaucucugacaugucuugucaagggauucuauccaagcgacauagccguggagugggaaucaaacggucagccggagaauaacuacaaaacuacacccccuguucuggauagugacggcuccuuuuucuuguauagcaagcucaccguggauaagucucgcuggcaacaggggaacgucuucucaugcagugugaugcaugaggcgcugcacaaucacuacacucagaaaagccucucccugucuccaggaaag

SEQ ID NO: 28204 - RNA, 1359 nt, Artificial Sequence
  derived and/or modified sequence opt3 from anti-influenza_Chain
gaggugcagcugguccagagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcgacuccgauacaaucuacucuccgucguuucagggucaagugacuauuucagcugacaacagcaucaguacggcauaucugcagugguccucuuugaaagccagcgauaccgcgauuuacuauugugcuuccgggcccggauacucaggcuaucacuacggcugguucgacacaugggggcagggaacuuuagucaccgugaguagcgccucuacaaaggguccuuccguuuuuccacuggcacccucaagcaagaguaccucuggcgggacugccgcucuaggaugccucgugaaagauuacuucccugagccagucacaguguccuggaauagcggcgcacugaccucggguguacauacguuucccgccguucuucagucuuccgggcuguauucauugaguagcguggucacugugccuuccucuagccucggaacccaaacauacaucuguaacgugaaucacaagccaucaaacacuaaagucgacaagaaaguugaaccgaagaguugcgauaagacccauacaugucccccuugcccagcucccgagcugcugggcggcccuuccguguuccucuuuccacccaaaccgaaggacaccuuaaugauaagcaggacgccugagguaacuuguguggucguggauguuucucacgaagaccccgaggugaaauucaauugguaugucgaugggguggaaguacauaacgccaagacaaaaccacgggaggagcaguacaauucaaccuaucgcguugugaguguccugacugugcuucaccaggacugguugaacggaaaggaauacaaaugcaaggucagcaauaaggcgcugccugcacccaucgagaaaacaauuuccaaggccaaaggucagccacgagaaccccaaguguauacccuaccuccaucucgugaggaaaugacgaagaaccagguuucgcucaccugucuggugaaaggcuuuuacccgagcgauaucgcuguagagugggaguccaaugggcagcccgaaaacaauuacaagacaacuccuccaguccuugacucagacggaaguuucuuucuguauucuaaguugaccguggauaaaagcagauggcaacagggcaacguuuucuccugcucagugaugcacgaggcccuccauaaucacuacacacaaaagagccugucuuuaucccccgguaaa

SEQ ID NO: 28205 - RNA, 1359 nt, Artificial Sequence
  derived and/or modified sequence opt3 from anti-influenza_Chain
gaggugcagcugguccaaagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcgacgcugaugcaaucuacuccccgucuuuucagggucaagugacaauuucggccgacaacucaaucagcacugcguaucugcaguggaguuccuugaaggcuucugauacggccauuuacuauugugcaagcgggcccggauacuccggcuaucacuacggcugguucgacaccugggggcagggaacauuagucacugugucaagugccagcaccaaagguccuucuguuuuuccacuggcucccuccucaaagagcacaaguggcgggaccgcagcccuaggaugccucgugaaagauuacuucccugagccagucacugugucuuggaacuccggcgcucugacaagcgguguacauaccuuucccgccguucuucagucgucugggcuguauuccuugucaaguguggucacggugccuagcuccucucucggaacucaaaccuacaucuguaaugugaaucacaagccaagcaacacaaaagucgacaagaaaguugaaccgaagucaugcgauaagacucauaccugucccccuugcccagcgcccgagcugcugggcggcccuaguguguuccucuuuccacccaaaccgaaggacacauuaaugauauccaggaccccugagguaacguguguggucguggauguuagccacgaagaccccgaggugaaauucaauugguaugucgaugggguggaaguacauaacgcaaagacuaaaccacgggaggagcaguacaauucuacauaucgcguugugucaguccugaccgugcuucaccaggacugguugaacggaaaggaauacaaaugcaaggucaguaauaaggcccugccugcucccaucgagaaaacuauuagcaaggccaaaggucagccacgagaaccccaaguguauacacuaccuccaucccgugaggaaaugaccaagaaccagguuucucucacgugucuggugaaaggcuuuuacccgucggauaucgcaguagagugggagagcaaugggcagcccgaaaacaauuacaagaccacaccuccaguccuugacuccgacggaucauucuuucuguauaguaaguugacuguggauaaaucuagauggcaacagggcaacguuuucagcugcuccgugaugcacgaggcucuccauaaucacuacacccagaagucacugagcuuaucucccgguaaa

SEQ ID NO: 28206 - RNA, 1359 nt, Artificial Sequence; identical to SEQ ID NO: 23949
  derived and/or modified sequence opt3 from anti-influenza_Chain

SEQ ID NO: 28207 - RNA, 1359 nt, Artificial Sequence
  derived and/or modified sequence opt3 from anti-influenza_Chain
gaggugcagcugguccaaagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcgacgcugauacaaucuacuccccgucuuuucagggucaagugacuauuucggcagacaacucaaucagcacggccuaucugcaguggaguuccuugaaagcgucugauaccgcuauuuacuauugugccagcgggcccggauacuccggcuaucacuacggcugguucgacacaugggggcagggaacuuuagucaccgugucaagugcaagcacaaaggguccuucuguuuuuccacuggcccccuccucaaagagcaccaguggcgggacugcugcacuaggaugccucgugaaagauuacuucccugagccagucacagugucuuggaacuccggcgcccugaccagcgguguacauacguuucccgcuguucuucagucgucugggcuguauuccuugucaaguguggucacugugccuagcuccucucucggaacccaaacauacaucuguaaugugaaucacaagccaagcaacacuaaagucgacaagaaaguugaaccgaagucaugcgauaagacccauacaugucccccuugcccagcccccgagcugcugggcggcccuaguguguuccucuuuccacccaaaccgaaggacaccuuaaugauauccaggacgccugagguaacuuguguggucguggauguuagccacgaagaccccgaggugaaauucaauugguaugucgaugggguggaaguacauaacgcgaagacaaaaccacgggaggagcaguacaauucuaccuaucgcguugugucaguccugacugugcuucaccaggacugguugaacggaaaggaauacaaaugcaaggucaguaauaaggcacugccugcccccaucgagaaaacaauuagcaaggcuaaaggucagccacgagaaccccaaguguauacccuaccuccaucccgugaggaaaugacgaagaaccagguuucucucaccugucuggugaaaggcuuuuacccgucggauaucgccguagagugggagagcaaugggcagcccgaaaacaauuacaagacaacuccuccaguccuugacuccgacggaucauucuuucuguauaguaaguugaccguggauaaaucuagauggcaacagggcaacguuuucagcugcuccgugaugcacgaggcacuccauaaucacuacacacagaagucacugagcuuaucucccgguaaa

SEQ ID NO: 28208 - RNA, 1359 nt, Artificial Sequence
  derived and/or modified sequence opt3 from anti-influenza_Chain
gaggugcagcugguccaaagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcuccucugacacaaucuacucgccgucauuucagggucaagugacuauuagcgcugauaacaguaucuccacggcauaucugcaguggucuagcuugaaagccuccgacaccgcgauuuacuauugugcuucagggcccggauacaguggcuaucacuacggcugguucgauacaugggggcagggaacuuuagucaccgugagcucugccuccacaaaggguccuucaguuuuuccacuggcacccagcaguaagucuaccuccggcgggacugccgcucuaggaugccucgugaaagacuacuucccugagccagucacagugagcuggaacucgggcgcacugaccucugguguacauacguuucccgccguucuucaguccucagggcuguauaguuugagcuccguggucacugugccuucuagcucacucggaacccaaacauacaucuguaaugugaaucacaagccaaguaacacuaaagucgauaagaaaguugaaccgaaguccugcgacaagacccauacaugucccccuugcccagcucccgagcugcugggcggcccuagcguguuccucuuuccacccaaaccgaaggauaccuuaaugauaucuaggacgccugagguaacuuguguggucguggacguuucacacgaagaucccgaggugaaauucaauugguaugucgacgggguggaaguacauaacgccaagacaaaaccacgggaggagcaguacaauaguaccuaucgcguugugagcguccugacugugcuucaccaggauugguugaacggaaaggaauacaaaugcaaggucuccaauaaggcgcugccugcacccaucgagaaaacaauuucuaaggccaaaggucagccacgagaaccccaaguguauacccuaccuccaucgcgugaggaaaugacgaagaaccagguuagccucaccugucuggugaaaggcuuuuacccguccgacaucgcuguagagugggagucaaaugggcagcccgaaaacaauuacaagacaacuccuccaguccuugauagugacggaucuuucuuucuguauagcaaguugaccguggacaaauccagauggcaacagggcaacguuuucucaugcagcgugaugcacgaggcccuccauaaucacuacacacagaagucucuguccuuaagucccgguaaa

SEQ ID NO: 28209 - RNA, 1359 nt, Artificial Sequence
  derived and/or modified sequence opt3 from anti-influenza_Chain
gaggugcagcugguccagagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcgacuccgaugcuaucuacucuccgucguuucagggucaagugacaauuucagcagacaacagcaucaguacugccuaucugcagugguccucuuugaaagcgagcgauacggcuauuuacuauugugccuccgggcccggauacucaggcuaucacuacggcugguucgacaccugggggcagggaacauuagucacugugaguagcgcaucuaccaaggguccuuccguuuuuccacuggcccccucaagcaagaguacaucuggcgggaccgcugcacuaggaugccucgugaaagauuacuucccugagccagucacuguguccuggaauagcggcgcccugacaucggguguacauaccuuucccgcuguucuucagucuuccgggcuguauucauugaguagcguggucacggugccuuccucuagccucggaacucaaaccuacaucuguaacgugaaucacaagccaucaaacacaaaagucgacaagaaaguugaaccgaagaguugcgauaagacucauaccugucccccuugcccagcccccgagcugcugggcggcccuuccguguuccucuuuccacccaaaccgaaggacacauuaaugauaagcaggaccccugagguaacguguguggucguggauguuucucacgaagaccccgaggugaaauucaauugguaugucgaugggguggaaguacauaacgcgaagacuaaaccacgggaggagcaguacaauucaacauaucgcguugugaguguccugaccgugcuucaccaggacugguugaacggaaaggaauacaaaugcaaggucagcaauaaggcacugccugcccccaucgagaaaacuauuuccaaggcuaaaggucagccacgagaaccccaaguguauacacuaccuccaucucgugaggaaaugaccaagaaccagguuucgcucacgugucuggugaaaggcuuuuacccgagcgauaucgccguagagugggaguccaaugggcagcccgaaaacaauuacaagaccacaccuccaguccuugacucagacggaaguuucuuucuguauucuaaguugacuguggauaaaagcagauggcaacagggcaacguuuucuccugcucagugaugcacgaggcacuccauaaucacuacacccaaaagagccugucuuuaucccccgguaaa

SEQ ID NO: 28210 - RNA, 1359 nt, Artificial Sequence
  derived and/or modified sequence opt3 from anti-influenza_Chain
gaggugcagcugguccaaagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcgacacagauacuaucuacuccccgucuuuucagggucaagugacgauuucggcugacaacucaaucagcaccgcauaucugcaguggaguuccuugaaagccucugauacagcgauuuacuauugugcuagcgggcccggauacuccggcuaucacuacggcugguucgacacuugggggcagggaaccuuagucacagugucaagugccagcaccaaggguccuucuguuuuuccacuggcacccuccucaaagagcacuuccggcgggacagccgcucuaggaugccucgugaaagauuacuucccugagccagucaccgugucuuggaauaguggcgcacugacgagcgguguacauacuuuucccgccguucuucagucgucugggcuguauuccuugucaaguguggucaccgugccuagcuccucucucggaacacaaacuuacaucuguaacgugaaucacaagccaagcaacaccaaagucgacaagaaaguugaaccgaagucaugcgauaagacacauaccugucccccuugcccagcucccgagcugcugggcggcccuaguguguuccucuuuccacccaaaccgaaggacacguuaaugauauccaggacuccugagguaacauguguggucguggauguuagccacgaagaccccgaggugaaauucaauugguaugucgaugggguggaaguacauaacgccaagaccaaaccacgggaggagcaguacaauucuacuuaucgcguugugucaguccugacagugcuucaccaggacugguugaacggaaaggaauacaaaugcaaggucaguaauaaggcgcugccugcacccaucgagaaaaccauuagcaaggccaaaggucagccacgagaaccccaaguguauacgcuaccuccaucccgugaggaaaugaccaagaaccagguuucucucacaugucuggugaaaggcuuuuacccgucggauaucgcuguagagugggagagcaaugggcagcccgaaaacaauuacaagacuaccccuccaguccuugacuccgacggaucauucuuucuguauaguaaguugacaguggauaaaucuagauggcaacagggcaacguuuucagcugcuccgugaugcacgaggcccuccauaaucacuacacucagaagucacugagcuuaucucccgguaaa

SEQ ID NO: 28211 - RNA, 1359 nt, Artificial Sequence
  derived and/or modified sequence opt3 from anti-influenza_Chain
gaggugcagcugguccaaagcggcgccgaaguuaagaaacccggggagucccucaagaucucuugcaaagugucaggauacaguuucaccagccaguggauugguuggguaagacagaugccuggcaaggggcuugaauggauaggaaugauguauccaggcgaguccgacacaaucuacucuccgucguuucagggucaagugacuauuucagcugauaacagcaucaguacggcauaucugcagugguccucuuugaaagccagcgacaccgcgauuuacuauugugcuuccgggcccggauacucaggcuaucacuacggcugguucgauacaugggggcagggaacuuuagucaccgugaguagcgccucuacaaaggguccuuccguuuuuccacuggcacccucaagcaagaguaccucuggcgggacugccgcucuaggaugccucgugaaagacuacuucccugaaccagucacaguguccuggaauagcggcgcacugaccucggguguacauacguuucccgccguucuucagucuuccgggcuguauucauugaguagcguggucacugugccuuccucuagccucggaacccaaacauacaucuguaacgugaaucacaagccaucaaacacuaaagucgauaagaaaguugagccgaagaguugcgacaagacccauacaugucccccuugcccagcucccgagcugcugggcggcccuuccguguuccucuuuccacccaaaccgaaggauaccuuaaugauaagcaggacgccugaaguaacuuguguggucguggacguuucucacgaggaucccgaagugaaauucaauugguaugucgacgggguggagguacauaacgccaagacaaaaccacgggaggaacaguacaauucaaccuaucgcguugugaguguccugacugugcuucaccaggauugguugaacggaaaggaguacaaaugcaaggucagcaauaaggcgcugccugcacccaucgaaaagacaauuuccaaggccaaaggucagccacgagagccccaaguguauacccuaccuccaucucgugaagagaugacgaagaaccagguuucgcucaccugucuggugaaaggcuuuuacccgagcgacaucgcuguagagugggaauccaaugggcagcccgagaacaauuacaagacaacuccuccaguccuugauucagacggaaguuucuuucuguauucuaaguugaccguggacaaaagcagauggcaacagggcaacguuuucuccugcucagugaugcacgaagcccuccauaaucacuacacacagaaaagccugucuuuaucccccgguaaa

SEQ ID NO: 28212 - RNA, 1359 nt, Artificial Sequence; identical to SEQ ID NO: 28200
  derived and/or modified sequence opt3 from anti-influenza_Chain

SEQ ID NO: 28213 - RNA, 1359 nt, Artificial Sequence; identical to SEQ ID NO: 28201
  derived and/or modified sequence opt3 from anti-influenza_Chain

SEQ ID NO: 28214 - RNA, 1359 nt, Artificial Sequence; identical to SEQ ID NO: 28202
  derived and/or modified sequence opt3 from anti-influenza_Chain

SEQ ID NO: 28215 - RNA, 1359 nt, Artificial Sequence; identical to SEQ ID NO: 28203
  derived and/or modified sequence opt3 from anti-influenza_Chain

SEQ ID NO: 28216 - RNA, 1359 nt, Artificial Sequence; identical to SEQ ID NO: 28204
  derived and/or modified sequence opt3 from anti-influenza_Chain

SEQ ID NO: 28217 - RNA, 1359 nt, Artificial Sequence; identical to SEQ ID NO: 28205
  derived and/or modified sequence opt3 from anti-influenza_Chain

SEQ ID NO: 28218 - RNA, 1359 nt, Artificial Sequence; identical to SEQ ID NO: 23949
  derived and/or modified sequence opt3 from anti-influenza_Chain

SEQ ID NO: 28219 - RNA, 1359 nt, Artificial Sequence; identical to SEQ ID NO: 28207
  derived and/or modified sequence opt3 from anti-influenza_Chain

SEQ ID NO: 28220 - RNA, 1359 nt, Artificial Sequence; identical to SEQ ID NO: 28208
  derived and/or modified sequence opt3 from anti-influenza_Chain

SEQ ID NO: 28221 - RNA, 1359 nt, Artificial Sequence; identical to SEQ ID NO: 28209
  derived and/or modified sequence opt3 from anti-influenza_Chain

SEQ ID NO: 28222 - RNA, 1359 nt, Artificial Sequence; identical to SEQ ID NO: 28210
  derived and/or modified sequence opt3 from anti-influenza_Chain

SEQ ID NO: 28223 - RNA, 1359 nt, Artificial Sequence; identical to SEQ ID NO: 28211
  derived and/or modified sequence opt3 from anti-influenza_Chain

SEQ ID NO: 28224 - RNA, 1365 nt, Artificial Sequence
  derived and/or modified sequence opt3 from anti-influenza_Chain
caggugcaacuggucgagagcggcgggggaguugugcagcccgguagaucccucaggcuuucuugcgccgcuucaggcuucgcauuucacaaccgggccaugcauuggguacgccaggcgccugggaagggacuggaauggguggcuuugaucuacuucgacggcaguaaacaguauuacgccgauagcgucaagggucgauuuaccauuucccgugacaauucuaaaaacacaguguucuuacaaaugaacucgcugagaccagaggauacugcaguuuauuacugugccgugccggggcccauauuuggaaucuucccuccauggucauauuuugaccacuggggccagggcauucuagucacggugagcagugcuuccaccaaggggcccucuguauucccucucgcaccaagcuccaaaucaacaaguggagguacugccgcucugggcugccuuguuaaggauuacuuucccgaaccugugaccgucagcuggaacucuggggcccugacauccggagugcauaccuucccagcgguguugcagucaagcggccucuauagucugucuuccgucguuacugugccgagcucgucucuggguacacagaccuacaucuguaauguaaaucacaagcccuccaauacgaaaguggacaagaaagucgagccuaagucaugcgauaaaacucauaccuguccacccugcccugcaccagaacucuuagggggacccaguguguuucuguucccgccuaagcccaaggacacacuuaugauuagcaggacuccagagguuaccuguguggucguggauguaucccacgaggacccugaaguuaaauuuaacugguacguggauggcgucgaggugcacaaugccaagacaaaaccccgggaggaacaauauaacucuaccuaccgcgucgugagcguuuugacggugcugcaucaggacuggcuaaauggcaaggaguauaaaugcaagguaucaaacaaagcucucccagcccccaucgaaaagacuauaaguaaggcaaaagggcagccuagagagccacaggucuacacacugccgcccuccagggaagagaugaccaagaaucaagugagccuuacuugucugguuaaaggauucuauccuucugauaucgcuguggaaugggagucaaacggucagccagagaauaacuacaagacaacgcccccugucuuggacagugacggcagcuucuuucucuauuccaaacugaccguggauaagucucgguggcagcaagggaacguauucucgugcagcgugaugcacgaagccuuacauaaucacuacacccagaagucccugucacucaguccaggaaaa

SEQ ID NO: 28225 - RNA, 1365 nt, Artificial Sequence
  derived and/or modified sequence opt3 from anti-influenza_Chain
gaggugcagcuggucgaaagcggcgggggaguugugcaacccgguagaucccucaggcuuucuugcgccgcuucaggcuucgcauuucacaaccgggccaugcauuggguacgccaggcgccugggaagggacuggaguggguggcuuugaucuacuucgacggcaguaaacaguauuacgccgauagcgucaagggucgauuuaccauuucccgugacaauucuaaaaacacaguguucuuacagaugaacucgcugagaccagaagauacugcaguuuauuacugugccgugccggggcccauauuuggaaucuucccuccauggucauauuuugaccacuggggccaaggcauucuagucacggugagcagugcuuccaccaaggggcccucuguauucccucucgcaccaagcuccaaaucaacaaguggagguacugccgcucugggcugccuuguuaaggauuacuuucccgagccugugaccgucagcuggaacucuggggcccugacauccggagugcauaccuucccagcgguguugcagucaagcggccucuauagucugucuuccgucguuacugugccgagcucgucucuggguacacagaccuacaucuguaauguaaaucacaagcccuccaauacgaaaguggacaagaaagucgaaccuaagucaugcgauaaaacucauaccuguccacccugcccugcaccagagcucuuagggggacccaguguguuucuguucccgccuaagcccaaggacacacuuaugauuagcaggacuccagagguuaccuguguggucguggauguaucccacgaagacccugagguuaaauuuaacugguacguggauggcgucgaagugcacaaugccaagacaaaaccccgggaggagcaguauaacucuaccuaccgcgucgugagcguuuugacggugcugcaucaagacuggcuaaauggcaaggaauauaaaugcaagguaucaaacaaagcucucccagcccccaucgagaagacuauaaguaaggcaaaagggcagccuagagaaccacaggucuacacacugccgcccuccagggaggaaaugaccaagaaucaggugagccuuacuugucugguuaaaggauucuauccuucugauaucgcuguggagugggagucaaacggucaaccagaaaauaacuacaagacaacgcccccugucuuggacagugacggcagcuucuuucucuauuccaaacugaccguggauaagucucgguggcagcaggggaacguauucucgugcagcgugaugcacgaggccuuacauaaucacuacacccaaaagucccugucacucaguccaggaaaa

SEQ ID NO: 28226 - RNA, 1365 nt, Artificial Sequence
  derived and/or modified sequence opt3 from anti-influenza_Chain
gaggugcagcugguccaaagcggcgggggaguugugcagcccgguaagucccucagacuuucuugcgccgcuucaggccugaccuucaguagcuacgcaguacacugggugaggcaggccccugggaaaggauuggaaugggucacauuaaucuccuaugacggcgcgaaccaguacuaugcugauucugugaagggucgguuuacuauuucgcgcgacaauucaaagaacacgguuuaccugcaaaugaauagccuacgaccagaggauaccgccguguauuacugugcagucccggggcccguguucggaauauuuccuccauggaguuauuucgacaacuggggccagggcauccucguaacaguuuccucugccagcacuaaagggcccuccguguuuccucuggcuccaucaaguaaaagcaccucuggagguacagcagcccuuggcugccuggucaaggauuacuuccccgaaccugugaccguguccuggaacucaggggcuuugacuagcggaguccauacauuuccagccguucuccagaguucuggccuguacucccugagcucggugguaaccgugccgucuuccucacucgguacgcagacuuauauuuguaaugucaaucacaagcccaguaacaccaaaguggacaagaaaguugagccuaagagcugcgauaaaacacauacuuguccacccugcccugcgccagaauuacuugggggacccuccguguuccuguuuccgccuaagcccaaggacaccuugaugaucucucguacaccagaggucaccugugugguaguugaugugagccacgaggacccugaagucaaauucaauugguacguggauggcgucgaggugcauaacgcaaagacgaaacccagagaggaacaauauaauucaacuuacaggguugugaguguacugacaguccuacaccaggacuggcucaacggcaaggaguauaaaugcaagguguccaauaaagcccugccagcucccauugaaaagaccaucagcaaggccaaagggcagccucgggagccacagguuuacacucuuccgcccucucgcgaagagaugacaaagaaccaagugucacugaccuguuuggucaaaggauuuuauccuagugauauagcaguggaaugggagagcaauggucagccagagaacaacuacaagacgacacccccuguacucgacuccgacggcucuuucuuucuguacucgaaauuaaccguggauaagagcagauggcagcaagggaauguuuucuccugcucagucaugcacgaagcucugcauaaccacuauacucagaagagucucucucuuagcccaggaaaa

SEQ ID NO: 28227 - RNA, 1365 nt, Artificial Sequence
  derived and/or modified sequence opt3 from anti-influenza_Chain
caggugcaacuggucgagagcggcgggggaguugugcagcccgguaagucccucagacuuucuugcgccgcuucaggccugaccuucaguagcuacgcaguacacugggugaggcaggccccugggaaaggauuggaaugggucacauuaaucuccuaugacggcgcgaaccaguacuaugcugauucugugaagggucgguuuacuauuucgcgcgacaauucaaagaacacgguuuaccugcaaaugaauagccuacgaccagaggauaccgccguguauuacugugcagucccggggcccguguucggaauauuuccuccauggaguuauuucgacaacuggggccagggcauccucguaacaguuuccucugccagcacuaaagggcccuccguguuuccucuggcuccaucaaguaaaagcaccucuggagguacagcagcccuuggcugccuggucaaggauuacuuccccgaaccugugaccguguccuggaacucaggggcuuugacuagcggaguccauacauuuccagccguucuccagaguucuggccuguacucccugagcucggugguaaccgugccgucuuccucacucgguacgcagacuuauauuuguaaugucaaucacaagcccaguaacaccaaaguggacaagaaaguugagccuaagagcugcgauaaaacacauacuuguccacccugcccugcgccagaauuacuugggggacccuccguguuccuguuuccgccuaagcccaaggacaccuugaugaucucucguacaccagaggucaccugugugguaguugaugugagccacgaggacccugaagucaaauucaauugguacguggauggcgucgaggugcauaacgcaaagacgaaacccagagaggaacaauauaauucaacuuacaggguugugaguguacugacaguccuacaccaggacuggcucaacggcaaggaguauaaaugcaagguguccaauaaagcccugccagcucccauugaaaagaccaucagcaaggccaaagggcagccucgggagccacagguuuacacucuuccgcccucucgcgaagagaugacaaagaaccaagugucacugaccuguuuggucaaaggauuuuauccuagugauauagcaguggaaugggagagcaauggucagccagagaacaacuacaagacgacacccccuguacucgacuccgacggcucuuucuuucuguacucgaaauuaaccguggauaagagcagauggcagcaagggaauguuuucuccugcucagucaugcacgaagcucugcauaaccacuauacucagaagagucucucucuuagcccaggaaaa

SEQ ID NO: 28228 - RNA, 1365 nt, Artificial Sequence
  derived and/or modified sequence opt3 from anti-influenza_Chain
caggugcaacuggucgagagcggcgggggaguugugcagcccgguaaguccccuagacucucuugcgccgcuucaggcccaaccuucaguagcuacgcaguacacugggugaggcaggccccggggaaaggacuugaaugggucacacugaucuccuaugacggcgcgaaccaguacuaugcugauucugugaagggucgguuuacuauuucgcgcgacaauucaaagaacacgguuuacuugcaaaugaauagcuuacgacccgaggauaccgccguguauuacugugcagucccugggccaguguucggaauauuucccccuuggaguuauuucgacaacuggggccagggcauccugguaacaguuuccucugccagcacuaaagggccauccguguuuccccuagcuccuucaaguaaaagcaccucuggagguacagcagcccucggcugccuggucaaggauuacuucccagaaccggugaccguguccuggaacucaggggcucuuacuagcggaguccauacauuucccgccguucugcagaguucuggcuuguacucccucagcucggugguaaccgugccuucuuccucacuggguacgcagacuuauauuuguaaugucaaucacaagccaaguaacaccaaaguggacaagaaaguugagcccaagagcugcgauaaaacacauacuuguccuccaugccccgcgccggaacugcucgggggaccuuccguguucuuauuucccccaaagccuaaggacacccugaugaucucucguacacccgaggucaccugugugguaguugaugugagccacgaggacccagaagucaaauucaauugguacguggauggcgucgaggugcauaacgcaaagacgaaacccagagaggaacaauauaauucaacuuacaggguugugaguguacuuacagucuugcaccaggacuggcugaacggcaaggaguauaaaugcaagguguccaauaaagcccuaccugcuccaauugaaaagaccaucagcaaggccaaagggcagccgcgggagccccagguuuacacucucccuccaucucgcgaagagaugacaaagaaccaagugucacugaccugucuugucaaaggauuuuaucccagugauauagcaguggaaugggagagcaauggucagccugagaacaacuacaagacgaccccacccguacuggacuccgacggcucuuucuuuuuguacucgaaacucacaguggauaagagcagauggcagcaagggaauguuuucuccugcucagucaugcacgaagcucugcauaaccacuauacucagaagaguuuaucucugagcccgggaaaa

SEQ ID NO: 28229 - RNA, 1365 nt, Artificial Sequence; identical to SEQ ID NO: 23933
  derived and/or modified sequence opt3 from anti-influenza_Chain

SEQ ID NO: 28230 - RNA, 1365 nt, Artificial Sequence
  derived and/or modified sequence opt3 from anti-influenza_Chain
caggugcaacugguccagagcggcgccgagcucaagagacccggggcuuccguuaaagugucuugcaagaccucaggauacaguuucaacaauuaugguaucaacuggguaaggcaggcaccuggccaggggcuugaauggaugggauggauuagcgccuacacaggcaauacucacuaugcgaaaaacuuugagggucgggugacgcugaccacagacacuuccaccucuacagcuuacauggaaguccgcucguugcgaucagaugacagcgccguguauuucugugcacgugccaugauacaagggguugugaccuuauaccugagaccaggagauuauuggggccagggcacucuagucacagugaguuccgcuucuaccaaggggccgagcguauuuccccucgcaccuuccucaaaaaguacgagcggagguacugccgcucugggcugccuuguuaaggacuacuucccagagcccgugaccgucucuuggaacuccggggcccugacaucaggagugcauacuuuuccugcgguguugcagagcaguggccucuacucucuguccagcgucguuaccgugccaucgucuucccuggguacacagaccuauaucuguaauguaaaucacaagcccucaaacacgaaaguggauaagaaagucgaaccuaagaguugcgacaaaacucauacauguccaccgugccccgcaccugagcucuuagggggaccaagcguguuccuguuucccccuaagccaaaggauacccuuaugauuuccaggacucccgagguuacauguguggucguggacguaucucacgaagauccggagguuaaauucaauugguacguggacggcgucgaagugcauaacgccaagaccaaaccucgggaggagcaauauaauagcacguaccgcgucgugucaguuuugaccgugcugcaccaggauuggcuaaacggcaaggaauauaaaugcaagguaaguaauaaagcucuccccgccccaaucgagaagacaauuuccaaggcaaaagggcagccuagagaaccccaggucuacacucugccacccagcagggaggaaaugaccaagaaccaagugucucuuacaugucugguuaaaggauuuuauccuucagacaucgcuguggagugggagaguaauggucagccagaaaacaacuacaagacuaccccgcccgucuuggauagcgacggcuccuucuuucucuacucuaaacugacaguggacaagucgcgguggcagcaagggaauguauucagcugcuccgugaugcacgaggccuuacauaaccacuauacccagaagucacugagucucucuccuggaaaa

SEQ ID NO: 28231 - RNA, 1365 nt, Artificial Sequence; identical to SEQ ID NO: 28224
  derived and/or modified sequence opt3 from anti-influenza_Chain

SEQ ID NO: 28232 - RNA, 1365 nt, Artificial Sequence; identical to SEQ ID NO: 28225
  derived and/or modified sequence opt3 from anti-influenza_Chain

SEQ ID NO: 28233 - RNA, 1365 nt, Artificial Sequence; identical to SEQ ID NO: 28226
  derived and/or modified sequence opt3 from anti-influenza_Chain

SEQ ID NO: 28234 - RNA, 1365 nt, Artificial Sequence; identical to SEQ ID NO: 28227
  derived and/or modified sequence opt3 from anti-influenza_Chain

SEQ ID NO: 28235 - RNA, 1365 nt, Artificial Sequence; identical to SEQ ID NO: 28228
  derived and/or modified sequence opt3 from anti-influenza_Chain

SEQ ID NO: 28236 - RNA, 1365 nt, Artificial Sequence; identical to SEQ ID NO: 23933
  derived and/or modified sequence opt3 from anti-influenza_Chain

SEQ ID NO: 28237 - RNA, 1365 nt, Artificial Sequence; identical to SEQ ID NO: 28230
  derived and/or modified sequence opt3 from anti-influenza_Chain

SEQ ID NO: 28238 - RNA, 1368 nt, Artificial Sequence
  derived and/or modified sequence opt3 from anti-influenza_Chain
gaggugcagcugguccaaagcggcgggggaguugugcagcccagaaggucccuccggcuuucuugcgccgcuucagguuucaccuuuaguagcuacgcaaugcacuggguacgccaggccccuggcaaggggcuggaauggguggcggucaucuccuaugacggacgaaacaaauacuaugcugauucugugaagggccguuucacaguuucgagagacaauucaaagaacacuuuguacuuacagaugaauagccugagggccgaggauacgaguguguauuacugugcacgggaacuacucauggacuauuacgaucauauugguuacuccccagggccgaccuggggacaaggcacacuggucacugugucuagcgccuccaccaaaggccccucaguauuuccucuugcuccaaguagcaaaucuacauccgggggaaccgcagcccuggguugcuugguuaaggacuauuuccccgagccugugacugucucauggaacagcggcgcucucacaaguggggugcacaccuuuccagccgugcugcagucuuccggacuguacagccucucgucugucguuacggugcccuccucaaguuuaggcacucagaccuauauauguaauguaaaccauaagccuagcaauacaaaaguggauaagcgcgucgaaccaaaauccugcgacaagacucacaccuguccgcccugcccugcgccagagcugcuuggugggcccucuguguucuuguuuccuccaaaacccaaggauacacugaugaucagcagaaccccggagguuacguguguggucguggacguaucacaugaagauccugagguuaaguucaacugguacguggacggagucgaagugcacaaugcaaaaacuaagcccagggaggagcaguauaacaguacauaccgggucguguccguucuaaccgugcuccaccaagauuggcugaauggcaaagaauauaagugcaaaguaagcaacaaggcccuuccagcuccuauugagaaaacuaucucuaaggccaagggccagccccgcgaaccacaggucuacacacugcccccuucacgagaggaaaugaccaaaaaucaggugaguuugacgugucucguuaagggguuuuacccaagcgacauugcaguggagugggaguccaacggacaaccggaaaauaacuauaaaaccacacccccuguccuggacucugaugguucguucuuuuuauacagcaagcugacuguggacaaauccagauggcagcagggcaacguauucucaugcagugugaugcaugaggcucuccacaaucauuauacccaaaagucucuuagccuguccccagggaag

SEQ ID NO: 28239 - RNA, 1371 nt, Artificial Sequence
  derived and/or modified sequence opt3 from anti-influenza_Chain
auggugauccagagaaacagcauucugcuccuuauaaucauuuucgccuccucuaucucaaccugcaggaguaaugucauugacgauaaccuguuuaagcaaguuuacgacaauaucuuggagcaggaguucgcucacgauuuucaggcauauuuaagcuaccuguccaaaaacauagaaucuaauaacaauaucgacaagguggauaaaaacggcauuaagguaaucaaugugcuaucguucggggccaaaggagacgguaagacauaugauaacauugcguuugaacaggcuuggaaugaggccuguucaagccggacucccguccaauucgugguuccuaagaacaaaaauuaccuccugaagcagaucacguuuaguggcccaugccgcuccucuauaagcgugaaaauuuucgggucccuugaagcaucaaguaagaucagcgacuauaaagaucgacgucuguggauugccuuugacucuguccagaacuuggugguaggaggcggugggaccaucaauggaaacggccagguuugguggccguccucauguaagaucaacaagagccuccccugcagagaugcuccuacagcacugacuuucuggaauuguaaaaaccugaaggugaauaaccucaaaaguaagaaugcccaacagauucauauaaaauuugagucuugcaccaacgucguggcuuccaauuuaaugaucaacgccagcgcgaagucgccaaauacagacggcgugcacgucucuaacacccaguacauucagaucuccgauacuauaauugggacaggagacgacuguaucucaaucguuagugguagccaaaaugugcaggcaaccaacauuacgugcggccccgggcauggaaucuccauuggcucucuggguagcggaaauucagaggccuauguaaguaacgugacugucaaugaagcuaaaauaaucggggccgagaacggcgugaggauuaagaccuggcagggcggguccggacaagcaagcaacaucaaguuccuuaauguugaaaugcaggaugugaaauacccuaucauuauagaccagaacuacugugaucgggucgagccaugcauccagcaauuuucugcugugcagguaaagaauguuguguaugagaacauuaaagguacaucagccacuaaggucgcgaucaaauucgacuguaguaccaauuuccccugcgaaggcauuaucauggagaacauaaauuuggugggggaaagcggaaagccuuccgaggccacaugcaagaacguccacuuuaauaacgcagaacaugugaccccacacuguacgucucuggagaucucggaggaugaagcucuacucuacaauuau

SEQ ID NO: 28240 - RNA, 1371 nt, Artificial Sequence; identical to SEQ ID NO: 28239
  derived and/or modified sequence opt3 from anti-influenza_Chain

SEQ ID NO: 28241 - RNA, 1380 nt, Artificial Sequence
  derived and/or modified sequence opt3 from anti-influenza_Chain
augaagcuguggcucaacuggaucuuccuugugacccuguugaaugacauucagugcgaggucaaauuaguugaaagcggcgggggacuggugcaacccgguggcucccuaagacucucuugugccacaucaggguuuacuuucagugauuacuauaugagcuggguaaggcaguccccuggaaaggcucuggaguggcuuggcuuuacgcggucucgcgugcuggguuacaccacagacuauucggcaucagucaaagggcgauucacuauaagccgugauaacagucaguccaucuuguaccuccagaugaacucucugagaggagaagacagcgccaccuauuacugcgcgagggaucggccaauggacuauuggggccaaggcacauccgugaccguuucaagugcuaagacuacaccgcccagcguguacccucuggccccagggucugcagcccagaccaauuccauggucacgcucggauguuuagugaaagguuacuuucccgagccuguaacuguuaccuggaacucaggcagccugaguucuggggugcacacauucccagcuguccuucaguccgauuuguauacucugagcucgucugugaccgugcccuccucaacauggccuagugaaaccgucacgugcaauguugcacauccagccagcuccacuaagguggacaagaaaauuguaccgcgcgauuguggaugcaagcccuguaucugcacagugccugaggucucuagcguguuuauuuucccacccaaaccuaaggacguucuaaccaucacucucacaccaaaagugaccugugucgugguagauauaucaaaggacgaucccgagguucaguuuaguugguucguggacgacgucgaagugcacacggcucaaacccagccgagagaggaacaguuuaauuccacauucaggagcgucucugagcugccuaucaugcaucaggauuggcuuaacggcaaggaguuuaaaugccggguuaauucagccgcguuccccgcaccaauugaaaagacuaucaguaaaaccaagggucgcccuaaagcuccccaaguguacacaauuccacccccuaaggagcagauggccaaagacaaggugagccugacuuguaugaucaccgauuucuuuccagaagacauaacaguagaguggcaguggaacgggcaaccggccgaaaauuauaagaacacccagcccauuauggauacugacggauccuacuucgucuauucuaaauugaaugugcagaagucgaacugggaggcaggcaauacguuuacaugcagcguucuccacgagggccugcauaaccaccacaccgaaaaauccuuaucacauaguccugggaag

SEQ ID NO: 28242 - RNA, 1380 nt, Artificial Sequence; identical to SEQ ID NO: 28241
  derived and/or modified sequence opt3 from anti-influenza_Chain

SEQ ID NO: 28243 - RNA, 1386 nt, Artificial Sequence
  derived and/or modified sequence opt3 from anti-influenza_Chain
auggaguggagcuggaucuuccuguuucuccuuuccggcaccgccggggugcacucugaaguccagcugcaacagucaggacccgaguugguuaagccuggugcuagugugaaaaugagcugcaaggcauccggcuacacauucacuucuuauguaaugcauugggugaaacagaagccagggcagggauuagaauggauuggcuacauaaacccguauaaugacgguacgagauacaacgagaaauuuagggucaaggccacccugacaucggauaagucaagcaguacugcguauauggaacuauccucucucaccagcgaggacuccgcuguguacuauugugcccggcgcgggcugaucacaacccccacucuugauuacuggggacaaggcacaacccugacgguuucaagugcaaaaacuaccccuccaagcguguaccccuuggccccuggcucugcugcacagacaaauuccauggucacucucgggugccuggugaagggauauuucccagagcccguaaccguuacauggaacucagguagccugaguucuggcgugcacaccuuuccugccguccuccaguccgacuuauacacgcugagcucgucugugacugugccauccucaacauggccgagugaaaccgucacuuguaauguugcucaucccgccagcuccacaaaaguggauaagaaaauuguaccucgagacugcggguguaagccaugcaucuguaccgugcccgaggucucuagcguguucauuuuuccuccaaagcccaaagauguucuuacgaucaccuugacaccgaaggugacuugcgucgugguagacauaucaaaagaugacccugaaguucaguucaguuggguggaugacgucgaggugcacaccgcgcaaacacagccccgugaggaacaguuuaacuccacuuucagaagcgucucugagcugccaaucaugcaucaggauuggcuaaauggaaaggaauuuaaauguagggugaacucagcagccuucccugcucccauugagaagaccaucaguaaaacaaagggccggccaaaggcaccccaaguuuauaccauuccuccaccgaaagaacagauggccaaggacaaagugagccucacuugcaugaucacggacuuuuuccccgaggauauaacaguagaguggcaguggaauggucaaccugcugaaaacuacaagaauacccagccaauuauggacacugauggguccuauuucgucuacucuaaacugaacgugcagaagucgaauugggaggccggaaacaccuuuacauguagcguucuucacgaaggccugcacaaucaucacaccgagaaguccuugucacauagucccggcaaa

SEQ ID NO: 28244 - RNA, 1386 nt, Artificial Sequence
  derived and/or modified sequence opt3 from anti-influenza_Chain
caggugcaacugguccagagcggcgccgagguuaagaaacccggggcuuccgugaagguaucuugcaaaaccucaggauacacauucacugcauauacgauccacugggugagacaggccccuggucagaggcucgaauggaugggcuggauuaacgcggggaauggacauaccaaguacagucaacgguuuaaaggccgcgucacaauaacucgagacaccagcgcucguacaaccuauauggagcuuagaucccugacuucugaagauacagccuuguacuucugugcaagggguccagagaccuauuacuaugacaagacgaacugguuaaauucgcacccggaugaauacuuucagcauugggggcacggaacucaggugaccguuucaagcgccaguacaaagggccccuccguguucccucuggcuccaucuagcaaauccacuucaggcgggaccgcagcccuaggaugccucgucaaggacuacuuucccgagccugugacaguaaguuggaacagcggugcucugaccucuggcguucauacguucccagccgugcuucaguccucagggcuguauagcuugaguucugucgugacugugcccuccagcucgcucggaacacaaaccuacaucuguaaugucaaccacaaaccuucuaauacuaagguugauaaaaagguggagccaaaguccugcgacaaaacacacaccuguccgcccugcccugcgccagaacugcugggcggucccucaguauuucucuucccuccaaagcccaaagauacguuaaugauuagucggaccccggaggugacaugugucgugguugacgugagccaugaagauccugaggucaaguuuaacugguauguggacgggguagagguucacaaugcaaaaacuaagccccgcgaggaacaguacaacuccaccuauagaguggucucugugcugacaguccuucaucaggauugguugaauggaaaagaauacaagugcaaggugagcaacaaagcccugccagcuccuaucgagaagacuauuucaaaagccaagggccagcccagggaaccacaaguuuauacccuacccccuagucgggacgagcucaccaaaaaucaggugucccugacaugucuuguaaagggcuucuacccaagcgauaucgcagucgagugggaaucuaacgggcagccggagaauaacuacaagacuacgcccccugugcuggacucagacggaaguuucuuuuuguauagcaaacucacaguugauaagucccgcuggcaacaggguaacguguuuucuugcucggucaugcacgaagcucugcacaaucauuacacccagaaauccuuaagccugucaccaggcaag

SEQ ID NO: 28245 - RNA, 1386 nt, Artificial Sequence; identical to SEQ ID NO: 28244
  derived and/or modified sequence opt3 from anti-influenza_Chain

SEQ ID NO: 28246 - RNA, 1386 nt, Artificial Sequence; identical to SEQ ID NO: 28243
  derived and/or modified sequence opt3 from anti-influenza_Chain

SEQ ID NO: 28247 - RNA, 1398 nt, Artificial Sequence
  derived and/or modified sequence opt3 from anti-influenza_Chain
augcugcccagcaccgugcagacacucacucuucuguugacguccggcggggucuuacugucucuauacguuucagccagucucagcuaucugcuuuacuccgacgugcuguugaaguucucuucgaccaaaacaacugcuccuaccaugucacucgagugcacaaacgcaagcaaugcccaaaccguaaaccacagugcgacuaaggaaaugacauuuccaccgcccgagccugaauggaccuauccaagacuguccugucagggaucuacguuccagaaagcucugcucaucagcccccauagguuuggugagauuaagggcaauuccgccccuuuaauaauccgggaaccauucguggcaugcgggcccaaagagugucgccacuuugcccugacucauuacgcugcacagccuggaggcuauuacaacgguacccgaaaggaucguaauaaacuuagacacuuggucucagugaagcuggggaagauuccaacaguugagaacaguaucuuccauauggccgcuuggagcggaucugccugccacgacggcagggaauggacuuauauuggcguggaugggccggacaaugaugcgcuagucaaaaucaaguacggagaggcauacaccgacacauaucacuccuacgcccauaacauacuccggacccaagaaucagcuuguaauugcaucgguggcgauuguuaucugaugauuacggacgggagcgccaguggaaucucuaaaugccgcuuucuuaagauuagagagggcaggaucauaaaggagauucugcccacuggucggguggaacacacagaggaauguaccugcggguucgcauccaacaaaacuaucgagugugcuugccgcgauaauagcuacacagccaagcgaccuuuuguaaaauugaacguugaaaccgacacggcggagauuagacucaugugcaccaagacauaucuggauacuccaaggcccgacgauggaucgaucgccggcccuugugagucuaauggcgacaaaugguuagggggaaucaaggguggcuucgugcaucagcggauggcauccaaaauugggcguugguacucacgcaccaugaguaagacaaacagaaugggaauggaacuguaugucaaguacgacggcgauccauggacugacagcgaugcucucacccuuuccggugugauggugucuauagaggaacccgggugguacagcuuuggcuucgagaucaaagacaagaaaugcgaugucccguguauuggaaucgaaaugguucacgacggcgggaaggauacauggcacucagccgcuaccgccauauauugccugaugggaaguggucaguugcuaugggacacugugacgggcguagauauggcacug

SEQ ID NO: 28248 - RNA, 1398 nt, Artificial Sequence; identical to SEQ ID NO: 28247
  derived and/or modified sequence opt3 from anti-influenza_Chain

SEQ ID NO: 28249 - RNA, 1407 nt, Artificial Sequence
  derived and/or modified sequence opt3 from anti-influenza_Chain
auggacuggaccuggagauuccuguuuguggucgccgcugcaacaggcguucagagccaagugcagcucguacaguccggggccgaggugaagaaacccggaucuucagucaaggugaguugcaaagcgagcgguggcacucuuaacaauuacgcuaucuccuggguuaggcaggccccugggcaaggacuggaauggaugggcgguauuucuccaauauucgggacguugaacuaugcagagcgguuucagggacgcgugaccaucacagccgaugucuucacuaauaccguguacauggaauuaucgucacugcgaagcgaggacacagcuguauauuuuugugcacguggcugcggcuacaacuguuauuacuucgauggguggggacaggguacccuaguuacugugaguuccgccucuacaaagggcccgagcgucuuuccccucgcuccuuccucaaaaaguaccagcgggggaacggccgcgcugggcugccuugugaaggacuauuucccagaacccgugacugucucuuggaacuccggugcacugaccucagggguucacacauuuccugccguguugcagagcaguggacucuacucucuguccagcguagugacugucccaucgucuucccugggcacccaaacauacauuuguaaugugaaucauaagcccucaaacaccaaaguugauaagaaaguggagccuaagaguugcgacaaaacgcacacuuguccaccgugccccgcuccugagcucuuaggcgggccaagcgucuuccuguuucccccuaagccaaaggauacacuuaugaucuccagaacccccgaagugacuuguguaguuguggacgucucucaugaggauccggaagugaaauucaauugguaugucgacggaguggagguucacaacgccaagacaaaaccuagggaggaacaguacaauagcaccuaucgggugguaucagucuugacggugcugcaucaggauuggcuaaacgguaaggaguacaaaugcaagguuaguaauaaagcacuccccgcuccaauugaaaagaccaucuccaaggccaaaggccagccucgcgagccccaaguguauacacugccacccagcagagacgaacuuacuaagaaccaggucucucugaccuguuuggugaaaggguuuuacccuucagauauagcgguagagugggagaguaauggacagccagaaaacaacuauaagacaacuccgcccgugcucgacagcgacggcuccuucuuccuguacucuaaauuaaccguugauaagucgagguggcaacaggguaaugucuuuagcugcuccgugaugcacgaggggcugcacaaccauuacacacagaagucacucagucuuucuccuggcaaa

SEQ ID NO: 28250 - RNA, 1407 nt, Artificial Sequence; identical to SEQ ID NO: 28249
  derived and/or modified sequence opt3 from anti-influenza_Chain

SEQ ID NO: 28251 - RNA, 1407 nt, Artificial Sequence; identical to SEQ ID NO: 28249
  derived and/or modified sequence opt3 from anti-influenza_Chain

SEQ ID NO: 28252 - RNA, 1413 nt, Artificial Sequence
  derived and/or modified sequence opt3 from anti-influenza_Chain
gacggcgugaagccccugauccucagagauugcagcgucgccggguggcuucugggaaacccuaugugugacgaguucauuaauguuccagaaugguccuacauaguggagaaagcuaacccggcaaaugauuugugcuaucccgguaacuuuaaugacuacgaagaguuaaagcaucugcuaucuaggaucaaccacuucgagaaaauucagaucauuccuaagucaaguuggagcgaucacgaagccuccucuggcguaucgucagcguguccauaucaagggacccccagcuuuuuccggaauguggucuggcucaucaaaaagaacaauacauacccuacuauaaagcgcaguuauaacaauacgaaccaggaggaccugcuuauccuguggggcauucaucacuccaaugaugcugccgaacagaccaaauuguaccagaacccaacaacuuauaucucugugggaaccagcacacucaaucaacgacugguucccaagauugcaacccguuccaaagugaacggucagaacgggagaauggacuuuuucuggacuauccugaagccuaaugaugccauaaacuuugagucaaauggaaacuucauugcuccagaauacgcauacaaaaucgucaagaagggcuauauuccggaggcccccagggacggccaggcuuacgugcggaaagauggggaguggguacucuuaaguacauuucugcgcagcgacaagacccauacgugcccuccaugucccgccccugaacuuuugggagguccaucuguuuuccuguuucccccgaaaccuaaggauacucuaaugaucuccagaacccccgaggugacaugcgucgugguggacgucucacacgaagacccagagguuaaauucaauugguauguggauggcguagaagugcacaacgcgaagacuaaaccuagggaggagcaguacaauagcaccuaucgggucgugaguguucucacagugcugcaucaagacuggcuuaacgggaaggaauacaaguguaaagucucuaauaaggcacugcccgccccaaucgagaaaaccauuuccaaggcuaaaggacagccccgcgaaccucagguguauacguugccaccgagccgagaggaaaugacuaagaaccagguaucgcucacaugccugguuaagggcuuuuaccccucugauauagccguggagugggaguccaauggucaaccugaaaacaauuacaaaaccacuccacccgucuuagacucagaugggaguuucuuccuguauagcaagcucacaguggacaaauccagauggcagcagggaaacgucuuuucuuguagcgugaugcacgaggcacuucauaaucacuacacccaaaagucacugaguuuguccccuggcaaa

SEQ ID NO: 28253 - RNA, 1413 nt, Artificial Sequence; identical to SEQ ID NO: 28252
  derived and/or modified sequence opt3 from anti-influenza_Chain

SEQ ID NO: 28254 - RNA, 1416 nt, Artificial Sequence
  derived and/or modified sequence opt3 from anti-influenza_Chain
auggacuggaccuggagauuccuguuuguggucgccgcugcaacaggcguucagugccaagugcagcucguacagagcggggccgaggugaagaugcccggauccucugucaaagugucauguaagacgagugguguuuucuuuagcucccacgcgaucucuugggugaggcaggcuccuggccaagggcuugaauggaugggaggcauuucgccaauguucgguacuacccauuacgcccagaaauuucaggggcgggucacaauaacugcagaucagucaaccacaaccgccuauauggagcugacuagcuugacaagugaagacaccgcuguguacuauugcgcacgcgauggagccggcuccuacuauccguuaaacugguucgaccccuggggccaagggacgcugguaacuguuucuagcgcuuccaccaagggaccuucaguguuuccacuagcccccaguagcaaaucuacauccgguggcacugcggcacucgggugucuggucaaggauuacuucccugagccagugaccgugucauggaauagcggagcccuuacaaguggcguccacaccuuucccgcuguucugcagucuuccgguuuguauagccucucgucugugguaacggugccuuccucaagucuggggacucagacauacaucugcaacgucaaucauaagccaagcaacaccaaaguggacaagcgaguugaaccgaaauccugugauaagacucacacaugucccccuugcccagcccccgagcugcucggaggcccuucuguguucuuauuuccacccaaaccgaaggacacccugaugauuagccguacgccugagguuaccugcgugguaguugaugugucacaugaagaccccgaggucaaguucaauugguacguggauggcgucgaagugcacaacgcaaaaacaaagccaagagaggagcaguauaauaguacuuacaggguuguguccguacuuaccgucuugcaccaagacuggcugaacgggaaagaauauaaguguaaagugagcaauaaggcucuaccugcccccaucgagaaaacaauuucuaaggcgaagggacagccacgggaaccccagguuuacacucucccuccaucacgcgaugagcugaccaaaaaccaagugagucuuacaugccuggucaaggguuuuuauccgagcgacaucgccguggaaugggaguccaauggccagcccgagaacaauuacaaaaccacuccuccaguauuggacucugaugggucguucuuccucuauagcaagcugacgguggacaaauccagauggcagcagggaaacgucuuuucauguagugucaugcaugaaggcuuacacaaucauuacacacaaaagucucugagccucucccccgguaag

SEQ ID NO: 28255 - RNA, 1416 nt, Artificial Sequence; identical to SEQ ID NO: 28254
  derived and/or modified sequence opt3 from anti-influenza_Chain

SEQ ID NO: 28256 - RNA, 1416 nt, Artificial Sequence; identical to SEQ ID NO: 28254
  derived and/or modified sequence opt3 from anti-influenza_Chain

SEQ ID NO: 28257 - RNA, 1419 nt, Artificial Sequence
  derived and/or modified sequence opt3 from anti-influenza_Chain
augaccgagagcgccaugacauccagagcuggcagggggcggggagcagaccugguggccgcggucguucagggucacgcugccgcaucugaugccgcuggcgaccucucauuccccgauggguuuaucuggggagcagccacugcugccuaccaaauugaaggcgcguggcgcgaggacggucgagggcuuugggauguguucagucauacgccuggaaagguagcaagcggccacaccggcgacauagccugcgaucauuaucaccguuacgcugacgaugugagacugauggccggguugggagacagggucuaucgguuuuccguggcauggccacgcaucguuccggaugguucuggccccgugaacccugcuggguuagacuucuacgauagacuggucgacgaacuacucggacauggcauuacaccauaucccacucuguaccacugggaccuuccucagacccuggaggauaggggugggugggccgcgcgggacacagccuaucgcuuugcagaauacgcuuuggccgugcaccgaagacucggagauaggguacgguguuggaucacccugaaugagccauggguugcugccuuccuggcaacucaucguggcgcccccggcgcugcggacgugccucgcuuuagagcaguccaccaucucuuacuggggcacggacuugguuugaggcugcggucggccggcgcugggcagcuaggacucacacugucacuuagcccagugauugaggcccgaccgggcgugcgcggugggggcagaagggucgaugcacuggccaaccggcaguucuuggaccccgcucuccgcggaagauacccugaagagguucugaaaaucauggccggccacgcaagguuagggcauccaggacgugaucuggaaaccauacaccaacccguggaccuccuugguguaaauuauuacagucaugugcggcuggcggcugagggcgagccugccaaccgauugccaggguccgaaggaaucagauuugagaggcccacggcagucacugccuggccgggcgaucgcccugacggucuacggacccugcuccugagacuuucuagggauuaucccggggugggccugauuaucacagaaaauggagcugccuucgacgaccgcgcagauggcgaccgaguucacgauccagagcggauucguuacuugacugcuacccucagagccgugcaugacgcgaucauggccggggcugaucugaggggauauuuugucuggagcguguuagacaacuucgaaugggcauacgguuaucacaagcgcggcauaguauacguugauuacacaaccaugcggaggauuccuagagaguccgcccugugguaucgagacgugguccgccggaaugggcuaagaaacggagag

SEQ ID NO: 28258 - RNA, 1419 nt, Artificial Sequence; identical to SEQ ID NO: 28257
  derived and/or modified sequence opt3 from anti-influenza_Chain

SEQ ID NO: 28259 - RNA, 1422 nt, Artificial Sequence
  derived and/or modified sequence opt3 from anti-influenza_Chain
cugagcagaaucaaccacuucgagaagauucagauaauccccaaauccucuuggucagaccaugaagccaguagcggcguguccucugcuugcccuuaccaagggaccccaucguuuuucaggaaugucguuuggcucauuaagaaaaacaauacauauccgacuaucaagcggucauacaacaauacgaaccaggaggaucuucugauuuuguggggaauccaccauagcaaugacgcagccgaacagaccaaauuauaucagaaccccacaacuuacauaaguguggguaccuccacacugaaucaacgccuaguaccuaagaucgcgacccgaucuaaggugaacggccagaaugggcguauggauuucuucuggacuauucucaaaccaaacgacgcuaucaauuuugagagcaacggaaauuucauugcccccgaauaugcauacaagaucgucaaaaagggcgauuccgccauagugaaaucagagguugaguaugguaacuguaacacaaagugccagaccccuauuggggcuaucaauaguagcaugccauuucacaacauucauccccugacgaucggagaauguccuaaguacgugaaaucuaauaaacuuguccuggcaacuggcuugagaaacuccccacucggcuacaucccggaggcccccagggacgggcaggcuuaugugcggaaagauggagaauggguacugcugucaaccuuccuccgcagcgacaagacacacacuugcccuccaugucccgccccugaguuacuggguggcccaaguguuuuucuuuuucccccgaaaccuaaggauaccuugaugauuucuagaacacccgaggugaccugcgucgugguggacgucucccacgaagauccagagguuaaauuuaauugguacguggacgggguagaagugcauaacgcgaagacgaagccuagggaggaacaauauaauagcacuuaccgggucgugucgguucugacagugcuacaccaggauuggcucaacggaaaagaguauaaguguaaagucucuaauaaggcacugcccgccccaauagagaaaaccaucuccaaggcuaagggccagccccgcgaaccucagguguacacucuuccaccgucacgagaggaaaugacaaagaaccaaguaagucugaccugcuugguuaaggguuucuaucccagcgacauugccguggagugggaauccaaugggcagccugagaacaauuacaaaacgaccccacccguccucgacucugauggcagcuuuuuccuguacucaaaguuaacaguggacaaaaguagauggcagcaaggaaacgucuucuccuguagcgugaugcaugaggcacugcacaaucacuauacucagaagucucucucacuuaguccuggcaag

SEQ ID NO: 28260 - RNA, 1422 nt, Artificial Sequence; identical to SEQ ID NO: 28259
  derived and/or modified sequence opt3 from anti-influenza_Chain

SEQ ID NO: 28261 - RNA, 1428 nt, Artificial Sequence
  derived and/or modified sequence opt3 from anti-influenza_Chain
auggaguucggccugagcuggguguuucucgucgcccuucugagagggguucagugccaagugcaguugguagaauccggagguggcgugguccagcccgggaggucuuuacggcugucaugugcugcaaguggauucaccuuuagccgcuucggcauccacugggugcgacaggccccugguaaggggcuagaguggauggcgguuauuugguacgacggauccaacaaauuuuaugcugauucugugaagggccguuucacaauaucgagagacaauucaaagaacacugucuaccuccaaaugaauagccugagggccgaagauacggcaguguauuacugcgccaaggacagucggggcuauuguuccucuaucauuugcuuugaagggggacuugauaacuggggucagggcacccugguaacaguuagcuccgcuucaacuaaagggccaaguguguucccguuggcacccagcucuaaguccaccucaggaggcacagccgcucucgguugucuggucaaggacuacuuuccugagccagugaccgugagcuggaauaguggggcccugacuucuggaguccauacauuccccgcgguucuccaguccagcggcuuauauucgcugucuuccgugguaaccgugccuucaaguagccuuggcacgcagacuuacaucugcaacgucaaucacaaaccauccaacaccaagguggauaaacgcguugagcccaagucuugugacaaaacacauacuugcccuccauguccggcacccgaguugcucgggggaccuagcguguuucuauucccacccaagccuaaggauacccucaugauuucaagaacaccagaagugaccugcgucguaguugacgugagucacgaggaucccgaagucaaauuuaauugguacguggacggugucgaggugcauaacgccaagacgaaaccgagggaggaacaauauaauuccacuuaccggguugugagcguacugacaguccuucaccaggauuggcugaacggcaaggaguauaaauguaaggugucuaauaaagccuugccugcucccaucgaaaagaccauaucaaaggcaaaagggcagccacgcgagccucagguuuacacucugcccccaagucgagacgaacugacaaagaaccaagugagcuuaaccugccuggucaaaggauucuaucccuccgacaucgcuguggagugggagucuaauggccagccugaaaacaacuacaagacgaccccaccgguacucgauucggacgguagcuucuuucuuuauuccaaacugacaguggauaagucaagauggcagcaagggaauguuuucaguugcucugucaugcacgagggcuugcauaaccacuacacucagaaaagccuaucccugucacccggaaaa

SEQ ID NO: 28262 - RNA, 1428 nt, Artificial Sequence; identical to SEQ ID NO: 28261
  derived and/or modified sequence opt3 from anti-influenza_Chain

SEQ ID NO: 28263 - RNA, 1428 nt, Artificial Sequence; identical to SEQ ID NO: 28261
  derived and/or modified sequence opt3 from anti-influenza_Chain

SEQ ID NO: 28264 - RNA, 1440 nt, Artificial Sequence
  derived and/or modified sequence opt3 from anti-influenza_Chain
augcccagcgugaagaucggcauuauaggggccggauccgcugucuucucucugagacucguuucagaccuuugcaaaaccccuggucugaguggcagcacagugacuuugauggauaucgacgaggaaagguuagaugcaauucugacgaucgccaagaaauacguagaggaagugggggcggaccuaaaguuugagaaaaccaugaaccucgaugacgucauuaucgaugcugacuucgugauaaauacagccaugguuggaggccacacuuaucuggaaaaggugcggcagaucggugagaaguacggguauuaccgcggaauugaugcacaagaguuuaacauggucuccgacuauuacaccuucucuaauuauaaccagcuuaaauacuuuguggauaucgcccgaaagauugaaaaacugucgccaaaggcuugguacuugcaggcagccaauccgaucuucgagggcacaacccucguaacucguacaguucccauaaaagcugugggcuuuugucaugggcacuauggagucauggaaauuguggagaagcugggucuggaggaagagaagguggacuggcaggucgccggcguuaaccaugggaucuggcucaauagauucagguacaacggaggcaaugcguauccuuuacuggauaaauggauugaagagaagucaaaagacuggaagccagaaaaccccuuuaaugaccaacuuagcccugcagccaucgauauguaccgguucuauggugugaugccaaucggggacaccguacgcaacaguuccuggagauaccacagggauuuggagacgaaaaagaaaugguauggagagcccuggggcggcgcugacucugaaauuggguggaagugguaccaggauacucugggaaaggugaccgagauaacuaaaaaggucgccaaauuuaucaaggaaaauccuagcgugcggcuauccgaccucgguucaguucugggcaaagaucuuagugagaagcaguucgugcuggaagucgagaagauuuuggacccagagcgcaaaagcggggaacagcauaucccguuuauagaugcacuccugaacgacaauaaggcucgauucgugguaaacauucccaacaaaggaaucauccacggcauugaugacgacguuguggucgaggugccugccuuagucgauaagaaugguauccacccagagaaaauugaacccccucugccagacagagugguuaaguacuaucucaggccccggauaaugcguauggaaauggcgcuugaggccuuccugacaggggauauccgcauuaucaaggaguugcuauacagagacccgaggaccaaaucugaugaacaaguggagaagguaaucgaagagauucuggcacucccugagaacgaagagaugcggaaacauuaucugaagcga

SEQ ID NO: 28265 - RNA, 1440 nt, Artificial Sequence; identical to SEQ ID NO: 28264
  derived and/or modified sequence opt3 from anti-influenza_Chain

SEQ ID NO: 28266 - RNA, 1443 nt, Artificial Sequence
  derived and/or modified sequence opt3 from anti-influenza_Chain
augaaguuccccaaagacuuuaugaucggcuacagcuccucuccuuuccaguuugaggccgggauuccaggaucagaagauccgaacagugacugguggguguggguccacgaucccgagaauaccgcugcaggucugguuagcggcgacuucccugaaaacgggccaggauauuggaaucucaaccaaaaugaucaugaccuugccgagaagcugggcgugaacacaauaagaguagguguggaaugguccaggaucuuucccaaaccuacuuucaaugucaaggugccaguugagcgggaugagaacgggucuauugugcacgucgacguggaugacaaagcgguagaacgcuuggaugaguuagcuaauaaggaagccguuaaccauuacguggagauguauaaggacugggucgagcgaggacguaaacugauccuaaaucucuaccacuggccccugccucuuuggcugcauaacccaauuauggugagaaggaugggcccggaucgggcacccucgggcugguugaaugaagagucaguggucgaauuugccaaguaugcugcauacaucgccuggaaaaugggggagcucccuguuauguggagcacgaugaacgaaccaaaugugguauaugagcagggauacauguucgugaaggguggcuuucccccuggguaccugagucuggaggcugccgacaaagcgcgcagaaacaugauacaggcacacgccagggcuuaugacaacaucaagcgguucuccaagaaaccagucggacucauuuacgccuuucagugguucgaauuacuggagggccccgcagaaguguuugauaaguucaaaucuagcaaacuuuauuacuucaccgacaucguuuccaaggguucaaguauuaucaauguggaguaucgccgagauuuggcuaacagacuggacuggcuaggggucaauuacuauagcaggcucguguacaagauaguagaugacaaaccgauuauccugcacggauacggcuuucuuugcacaccuggcgggauuucucccgccgaaaacccauguuccgauuucggaugggagguuuauccugagggucuguacuugcuccugaaggaauuauauaaucgguacggcguggaccugaucgucacugagaacggggugucagauagccgugacgcgcuccgccccgccuaucuugucagucauguguacucuguuuggaaggcagcuaaugaaggaaucccagugaaaggcuaucugcacugguccuugaccgauaacuacgagugggcccaagguuuuagacagaaguucgggcuaguaauggucgacuuuaaaacaaagaaaagguaccugcggcccagcgcucucguguuccgagaaauugccacccauaauggcauaccugacgagcugcagcaccuuacucugauccag

SEQ ID NO: 28267 - RNA, 1443 nt, Artificial Sequence; identical to SEQ ID NO: 28266
  derived and/or modified sequence opt3 from anti-influenza_Chain

SEQ ID NO: 28268 - RNA, 1464 nt, Artificial Sequence
  derived and/or modified sequence opt3 from anti-influenza_Chain
cacgcccaggacauccuggagaagacccauaacggcaaacucugcgaucuugacggggugaagccccugauuuugagagauuguagcgucgcuggaugguuacuggguaauccuaugugcgacgaguucauaaacguuccagaaugguccuacaucguggaaaaagcaaauccggccaacgaucuauguuaucccggcaauuuuaacgacuacgaggaacucaagcaucugcuuucuaggauuaaucacuucgagaaaauccaaauuaucccuaagucaaguuggagcgaucacgaggcguccucugggguaucgucagcuugcccauaucagggaacacccagcuuuuuccggaacguggucuggcugauaaagaaaaauaacacuuacccuacgaucaagcgcaguuauaauaacaccaaucaggaagacuugcucauucuguggggcauccaucacuccaacgaugccgcagagcagacaaaacuguaccaaaauccaacuaccuauauuucuguggguacaagcacccucaaccagcgauuaguucccaagaucgccacucguuccaaagugaacgggcagaauggaagaauggacuuuuucuggacaauacugaagccuaacgaugcuauuaauuuugaaucaaacggcaauuucaucgcaccagaguacgccuacaagauugucaaaaagggcuauaucccggaggcucccagggacgggcaggccuacgugcggaaagauggagaauggguacuuuugaguaccuuucugcgcagcgacaagacgcacacuuguccuccaugccccgcgccugagcuacucgguggcccaucuguuuuccuguuucccccgaaaccuaaggacacccuuaugaucuccagaacacccgaagugacuugugucgugguggaugucucacaugaggacccagaaguuaaauucaacugguauguggaugggguagaggugcacaaugcaaagaccaagccuagggaggaacaauacaacagcacauaucgggucgugaguguucugaccguguugcaucaggacuggcucaauggaaaagaguacaagugcaaagucucuaacaaggcccugcccgcuccaauugagaaaacgauauccaaggccaagggccagccccgcgaaccucagguguauacuuuaccaccgagccgagaagagaugaccaaaaaucaaguaucgcugacaugucucguuaaggguuuuuaccccucugauaucgcaguggagugggaauccaacgggcagccugagaauaacuacaaaacuacaccacccguccuugacucagauggaaguuucuuccuguauagcaaguugaccguggacaaauccagauggcagcaaggcaaugucuuuucuugcagcgugaugcacgaagcucuacacaaccauuacacgcagaagucacugagucucuccccuggcaag

SEQ ID NO: 28269 - RNA, 1464 nt, Artificial Sequence; identical to SEQ ID NO: 28268
  derived and/or modified sequence opt3 from anti-influenza_Chain

SEQ ID NO: 28270 - RNA, 1473 nt, Artificial Sequence
  derived and/or modified sequence opt3 from anti-influenza_Chain
augcugagcuuccccaagggcuuuaaauucggguggucccagucuggauuucaaucagagauggguaccccuggcagugaagacccaaacagcgauuggcacguguggguccaugacagagagaauaucguuucccaggugguaucuggggaucucccggaaaacggacccggcuacugggguaauuauaagagguuccacgacgaggccgagaaaauugggcuuaacgcugugcggauaaaugucgaguggucgcgcaucuuuccucgaccacugcccaagccugagaugcagacaggaacugauaaagaaaacucaccagugauuagcguugacuugaaugagaguaaguuacgugaaauggauaacuacgcaaaucaugaggcccugucccacuauagacagauccuagaggaccucaggaaccggggcuuccauauugugcugaauauguaccacuggacgcuucccaucuggcugcacgauccuauacgcgucagaaggggcgacuuuaccgggccaacaggaugguugaacucucggacuguguaugaguucgcgcgcuuuagcgcuuacguagccuggaagcucgaugaccuggcauccgaauaugccaccaugaaugaaccgaacguuguguggggugcuggcuacgcauucccccgagccggguuuccuccaaauuaccugucauucagacucagugagaucgcuaaauggaacauuauccaagcccaugcgagggcauaugaugccauuaagagcgucucuaaaaaguccgugggaaucauauacgcuaacacaucauauuaccccuuacggccucaggacaaugaagccguggagauugcagagcgucugaaccgcuggagcuuuuucgacaguaucauuaaaggcgaaaucaccucugagggucagaaugucagagaagaucuuaggaaccgguuggacuggaucgggguuaauuauuacacucgaacagugguaaccaaggcugaguccggauaucugacgcuaccaggcuacggcgaucgcugcgaaagaaacagccucucgcuggccaaucuucccacuucugacuucgggugggaguuuuucccggagggacuguacgauguguugcucaaguauuggaacagguacggucugccuuuauaugucauggaaaauggcauugcggacgaugccgacuaccagcggcccuauuaccuggugucccacauauaucaaguucaucgcgcacucaacgaggggguggaugucagaggauaccuucacuggucacuggcugacaauuacgaauggaguagcggcuuuuccaugagguucgguuugcuaaaaguggauuaucugaccaagcgucucuacuggcggccaucugcccugguauaucgagagaucacaagaagcaacgggauuccugaagaacuugagcaccugaauaggguucccccaaucaaacccuugcgccau

SEQ ID NO: 28271 - RNA, 1473 nt, Artificial Sequence; identical to SEQ ID NO: 28270
  derived and/or modified sequence opt3 from anti-influenza_Chain

SEQ ID NO: 28272 - RNA, 1494 nt, Artificial Sequence
  derived and/or modified sequence opt3 from anti-influenza_Chain
auggccagccagggcaccaagagauccuacgagcaaauggaaacagacggggagaggcagaacgcuacugaaauccgggcaucugugggaaaaaugauugguggcauagggcgcuucuauauccagaugugcacggagcugaagcucucagauuacgaaggacgacuuauucagaauagucugaccaucgagcguauggucuugagcgccuuugacgagagaaggaacaaauauuuagaagaacaccccuccgcgggcaaggauccuaaaaagacaggugggccaauuuaccggcgcguuaauggaaaguggaugagagaacugauccuauaugacaaagaggagauaaggcggaucuggcgccaagcuaacaauggcgaugacgccacugcaggccucacccauaugaugauuuggcacucuaaccugaaugaugccacauaccagcgaaccagagcucuugugaggacugggauggacccgcggauguguucgcugaugcagggaucaacauugccccgucgcagcggugcagccggcgcugccguaaagggggugggaaccauggucauggaacucgugagaaugaucaaaaggggcauuaacgaucggaauuucuggcgaggugagaacgggcgcaagacgagaaucgcguaugaaaggaugugcaauauacugaaaggaaaguuucagacugcagcccaaaaggcuaugauggaccagguucgggagagucgcgauccuggcaacgccgaguucgaggaccugaccuuucucgcaagauccgcuuuaauucugaggggcucuguggcccauaaaagcugucuuccagcgugcgucuacgggcccgccguggcauccggauacgauuucgagcgugaagguuauucauugguaggcaucgacccuuuucggcugcuacagaauagucagguuuacagccucauucgaccaaacgagaaucccgcucacaagucucaacugguguggauggccugucauuccgcugccuucgaagaccuuagaguccugucauuuaucaaagggacaaagguggugccuaggggaaaauugagcacucgcggcguccagaucgcaaguaacgagaacauggaaaccauggagucuuccacacucgagcugcggagcagauauugggccauuaggacccgcucgggugggaauacgaaccagcaacgagcuucugcgggccagauauccauccagccaacuuucucaguucagcggaauuuaccguuugaucguacaaccgugauggcagccuucacuggaaacacagaaggcagaaccagugacaugaggacggagauuauccgcaugauggaaagcgcucggcccgaggauguauccuuucaagggagaggaguguucgaacugucugacgagaaggccgcaagcccuauagucccaucauucgauaugaguaaugaggguuccuacuuuuucggcgacaacgccgaagaguaugauaau

SEQ ID NO: 28273 - RNA, 1494 nt, Artificial Sequence
  derived and/or modified sequence opt3 from anti-influenza_Chain
auggccagccagggcaccaagagauccuacgagcaaauggaaacagacggggagaggcagaacgcuacugaaauccgggcaucugugggaaaaaugauugaugguauaggccgcuucuauauccagaugugcacggagcugaagcucucagacuacgaagggcgacuuauucagaauagucugaccaucgagcguauggucuugagcgccuuugaugagagaaggaacaaauauuuagaggaacaccccuccgcgggaaaggacccuaaaaagacaggcgguccaauuuacaagcggguugaugggaaauggaugcgcgaacuggugcuauaugacaaggaggagaucagaaggauauggcggcaagcuaauaacggagaugacgccacugcaggccucacccauaugaugaucuggcacucuaaucugaacgauacaaccuaccagcgcacucgagcccuuguaagaacaggcauggacccgaggauguguucgcugaugcaggggucaaccuugccccggcguagcggagcugccggugcagcugugaaaggcgucgggacgauggugauggaacucauucgcaugaucaagagaggaauuaaugauaggaacuucuggcggggcgagaauggucgaaaaacucgcagugccuaugaaagaaugugcaacauccugaaggggaaguuucagaccgcggcacaaagggccaugauggaccagguucgggagucccgcaauccuggaaacgcugaaauagaggaucugauuuuccucgccagaucugcauuaauccugaggggcagcguggcucauaaauccugucuuccagccugcgucuacggccccgcgauugccucaggguacaauuuugagaaggaaggauauaguuugguggguaucgacccuuucaaacugcuacagaacagccagguauacucucucauccguccaaaugagaaccccgcacacaagucccaacugguuuggauggcuuguaacucagccgcuuuugaagaccuucgggugcugagcuucauucgaggcacaaaagucaguccuagagggaaguugucuacuaggggagugcagauagccuccaaugagaacauggauaccauggaaagcucgacacucgagcugcgcucucgguauugggcaaucagaaccagguccggcgguaauacgaaccagcaacgcgccucagcugggcagauuagugugcagccagcguuuagcguccagcgaaauuuaccguucgacaaacccacuaucauggcagccuuuacaggcaacaccgagggacggacuuccgauaugcgugcugaaauaauuagaaugauggagggcgccaagccugaagagaugucuuuccaagggaggggaguuuuugaacugagcgacgagaaggcaacaaauccaaucgugcccucauucgauaugaguaacgaggguuccuacuucuuuggcgacaaugccgaagaguaugauaac

SEQ ID NO: 28274 - RNA, 1494 nt, Artificial Sequence
  derived and/or modified sequence opt3 from anti-influenza_Chain
auggccagccagggcaccaagagauccuacgagcaaauggaaacagggggagagaggcagaacgcuacugaaauccgggcaucugugggucgcauggucggcgggauuggacgauucuauguucagaugugcacggagcugaaacucucagaccaggaaggccgucuuauacaaaauaguaucaccauugagagaauggugcugagcgccuuugaugagaggcggaaccgcuacuuggaggaacaccccuccgcggguaaggacccuaaaaagacagggggaccaaucuauagaaggcgggauggcaaauggguacgcgaauuaauucuguacgacaaggaggagauccgaagaauauggaggcaggcuaauaacggcgaagaugccacugcagggcuaacccauaugaugaucuggcacucuaaucucaacgacgccacauaucagcggacccgugcucuggugcgcacuggaauggauccgagaauguguucgcuuaugcaggguucaacacugcccaggcggagcggcgcagccggggcugccauuaagggagucggcaccauggugauggaguugauccgaaugauuaaacgcgguaucaaugacagaaacuucuggaggggagauaaugggcggcgcacgagaauagcguacgaaaggaugugcaacauucucaagggcaaauuucaaacugcagcccagcgugcuaugauggaccagguucgggagagucgaaauccuggcaacgccgaaaucgaggaucugauuuuccuggcaagauccgcucucaucuuaagggggucuguggcccauaagagcugucugccagcgugcgucuauggacuugccguggcauccgguuacgacuuugagcgcgaaggcuacucauugguagggaucgaucccuuccggcugcuacagaauagucaaguuuuuagccucauuagaccuaacgagaauccagcucacaaaucucagcugguguggauggccugucauuccgcugccuucgaagaccuuagggucagcucauuuauacgcggaacccgagugaucccccggggccagcugaguacacguggugugcaaauugcaucuaacgagaacgucgaagccauggacuccagcacuuuggagcucagaucgagguauugggcuauccgcacccggucugggggcaauacaaaccagcagagagcguccgcaggacagauaucaguucaaccuaccuucagugugcagaggaaucugccauuugagcgaccgacgauuauggccgcuuucaagggcaacacugaagggcgcacaagcgauaugcggaccgagaucaucagaaugauggaauccgccaggcccgaggacguaucuuuucagggacgugguguguucgaauuaagcgaugagaaggcaacuaauccuauugucccaucauucgacaugaguaacgagggcuccuacuuuuucggggauaaugccgaagaguaugacaac

SEQ ID NO: 28275 - RNA, 1494 nt, Artificial Sequence; identical to SEQ ID NO: 28272
  derived and/or modified sequence opt3 from anti-influenza_Chain

SEQ ID NO: 28276 - RNA, 1494 nt, Artificial Sequence; identical to SEQ ID NO: 28273
  derived and/or modified sequence opt3 from anti-influenza_Chain

SEQ ID NO: 28277 - RNA, 1494 nt, Artificial Sequence; identical to SEQ ID NO: 28274
  derived and/or modified sequence opt3 from anti-influenza_Chain

SEQ ID NO: 28278 - RNA, 1530 nt, Artificial Sequence
  derived and/or modified sequence opt3 from anti-influenza_Chain
auguuccccgagaaguuucuguggggcguggcccagagcggguuccaauuugaaaugggagacaaacucagaaggaacaucgauaccaauacagacugguggcacuggguccgggauaagacuaacauugagaaaggucuuguuuccggcgaccugccugaagaggggauaaauaacuacgaauuguaugagaaggaucaugagaucgcucgcaaauuaggacugaaugcauaccgaauuggcaucgaauggucucguauuuucccauggccgacgaccuuuaucgacguggauuauucauacaacgagaguuauaaucuaauagaagacguaaagaucacaaaggauacucucgaggagcuggacgaaauugccaacaaaagagagguggcguacuauaggagcgucaucaauucccuucggucuaaggguuucaaagugauuguuaaccugaaucacuuuaccuugcccuacuggcuccaugauccuaucgaagcucgcgagagagcccugacaaacaagaggaaugggugggugaacccacggaccgucauagaauuugcaaaauacgccgcuuauauugcauacaaguuuggagacaucguggauauguggucgacuuucaaugagcccaugguaguuguggagcugggcuaucucgccccuuacucaggcuuuccacccggggucuuaaacccugaagcugccaagcuggcgauucuucacaugaucaacgcacaugccuuggcuuaucgccagaucaaaaaguucgacacagagaaagccgacaaggauagcaaagaaccagcagaggugggaauuauauacaauaacaucgguguggcuuauccgaaggaccccaaugauaguaaagacgucaaggccgcggaaaacgauaauuucuuccacuccggccuguucuuugaggccauucacaaggggaaacuaaacaucgaguucgacggagaaaccuuuauagaugcaccuuaccucaagggcaaugacuggauugguguuaacuacuauacgcgagaggugguaacuuaccaggaaccaauguuccccucuaucccucugaucaccuuuaaaggggugcagggauauggcuacgcuugcagaccaggcacacuuagcaaggaugacaggcccgucuccgauauugggugggagcuguauccggaaggaauguacgacucaaucguggaggcccauaaauaugguguuccuguguacgucacugagaauggcauugcugacaguaaggauauauugcggcccuacuauaucgccagccacauuaagaugaccgaaaaagcauucgaggacggguacgaagugaagggauauuuucauugggcccucacagauaacuucgagugggcucugggcuuucguaugcgcuucgguuuauacgagguaaaucugaucaccaaagaaagaaucccaagggagaagucuguuuccauuuuucgggaaauaguggcgaacaauggggucacgaaaaagaucgaggaggaacuccuucgaggc

SEQ ID NO: 28279 - RNA, 1530 nt, Artificial Sequence; identical to SEQ ID NO: 28278
  derived and/or modified sequence opt3 from anti-influenza_Chain

SEQ ID NO: 28280 - RNA, 1536 nt, Artificial Sequence
  derived and/or modified sequence opt3 from anti-influenza_Chain
augaagagaaaagugaagaaaauggccgcuauggcaaccagcaucauuauggccauaaugaucauucugcacuccauccccguccucgcgggcaggauuaucuacgacaacgagacagggacucauggagguuaugauuacgaacuuuggaaggacuauggcaauacgauaauggagcugaacgaugggggaaccuucucuugccaguggucaaauaucggcaacgcuuuguuucggaaaggucgcaaguucaauagugacaagacauaccaagaauuaggggauauuguuguggaguauggaugugacuacaacccuaauggcaacagcuaucugugcguauacggcuggacucgaaauccgcuaguggaauacuauaucgucgaguccugggggucuuggcguccacccggagccaccccuaaagguacaauuacccaguggauggcaggcacuuacgagaucuaugaaacaaccagagugaaccagccaucgauagaugggacggccacuuuucagcaauacuggucaguuaggaccagcaagcggacaaguggaacuauuuccgugaccgagcacuucaaacagugggaacgcaugggcaugagaauggguaagauguaugaggucgcucucacaguggagggguaccagucuagcggauaugcaaauguauacaaaaacgaaaucaggauuggcgccaaucccaccccugcuccaucccagucacccauccggcgcgacgccuuuaguaucauugaggcggaagaguacaacagcacuaauucuuccacgcugcaaguuauaggcacaccuaacaacgggcgaggaaucgguuauauugaaaauggcaacaccgugacuuacucaaauaucgauuucgggagcggagcaacaggcuuuagugccaccgucgcuacggaggugaacaccucuauacagauuagauccgacagcccaacagguacucuucuggggaccuuguaugugucgucuacaggcuccuggaauacuuaccagaccgucucaacaaacaucaguaagaucaccggaguucaugauauugugcucguauucagcggcccggugaaugucgacaacuuuaucuucuccaggucuagccccgugccugccccaggggauaauacucgggacgcauauucaauuauacaggcugaggacuacgauaguuccuauggacccaaccugcaaaucuuuagccugccugguggcgggucugccauuggauacaucgaaaauggcuacucaacgacauauaagaacaucgacuucggugauggggcgaccaguguuacugcccguguggcaacccagaaugcuacaaccauucagguccgccucggcagcccauccggaacuuuacugggcacaauauacguggggucuacgggaucguuugacaccuauagagauguaagcgccacuaucuccaacacagcugguguuaaagacauugugcuugucuucucaggccccgugaaugucgauugguucguguuuaguaagucugggacc

SEQ ID NO: 28281 - RNA, 1536 nt, Artificial Sequence; identical to SEQ ID NO: 28280
  derived and/or modified sequence opt3 from anti-influenza_Chain

SEQ ID NO: 28282 - RNA, 1539 nt, Artificial Sequence
  derived and/or modified sequence opt3 from anti-influenza_Chain
aucugcauuggcuaccacgccaacaauagcaccgaacagguggacacaauaauggaaaagaacgucacuguuacgcaugcucaagauauccuggagaaaacccacaaugggaagcucugugaccuugauggagugaaaccccugauuuugagagacugcuccguagcagguugguuacugggcaacccuaugugugaugaguucaucaaugugccagaguggucuuauauugucgaaaaggccaacccggcgaaugaccuaugcuaccccgggaacuuuaaugauuaugaggagcucaaacaucugcuuucaaggaucaaccacuucgaaaagauacagaucauuccuaagaguagcugguccgaccaugaggcuucuucgggagugucaagcgccuguccauaccagggcacacccuccuuuuuccggaauguuguguggcugaucaaaaagaacaauacuuauccuaccauuaaacgcaguuacaacaauacaaaccaggaagauuugcucauccugugggguauacaccacucuaacgacgcagccgagcaaaccaagcuguaucagaauccaacuacauacauuagcgucgggaccuccacgcucaaccagcgauuagugcccaaaaucgcuacucguucaaagguaaauggacagaacggcagaauggacuuuuucuggaccauucugaagccuaaugaugcaaucaacuuugagaguaauggcaacuucaucgccccagaauacgcuuauaaaauuguuaagaaaggguacauaccggaggcccccagggauggacaagcguaugugcggaaggacggugaauggguccuuuugagcacauuucugcgcucugacaaaacucauaccugcccuccaugucccgcaccugagcuacucggcgggccauccguguuccuguuucccccgaagccuaaagauacacuuaugaucucaagaacccccgaagugacgugcgucguuguggacguaagccacgaggauccagaggugaaguucaauugguacgucgacggaguggaaguucauaacgccaagacuaaaccuagggaggaacaguauaauaguacauaccggguggucucugugcugaccguauugcaccaggauuggcucaacggcaaggaguauaaauguaagguuuccaauaaagcucugcccgccccaauugaaaagacuaucagcaaggcaaaaggucagccccgcgagccucaaguguacacauuaccaccgucgcgagaggaaaugaccaagaaccaggucucucugacgugccucgugaaaggguuuuaccccuccgacauagcugucgagugggaaucaaauggacagccugagaacaacuauaagaccacaccacccgugcuugauagugacggcagcuucuuccuguacuccaaauugacuguugauaagucuagauggcaacagggcaauguguuuagcuguucaguaaugcacgaagcccuacauaaccacuauacccagaagagucugucccucagcccugggaaa

SEQ ID NO: 28283 - RNA, 1539 nt, Artificial Sequence; identical to SEQ ID NO: 28282
  derived and/or modified sequence opt3 from anti-influenza_Chain

SEQ ID NO: 28284 - RNA, 1593 nt, Artificial Sequence
  derived and/or modified sequence opt3 from anti-influenza_Chain
acccugugcaucggcuaccacgccaacaauagcacagacacuguggauacgguccucgagaagaacguuaccgugacacauuccguaaaucuucuggaagacaaacacaacgggaaguuguguaaauuaagaggaguggcuccccugcaucuagguaagugcaauauugcaggcuggauacucgggaacccugagugugaaucucugucaacugccaguagcugguccuauaucgucgagaccucuucgucagauaauggaacaugcuacccaggcgacuucauugauuaugaggagcuuagggagcagcugagcaguguguccucuuuugaacgguucgagaucuuuccgaaaaccagcuccuggcccaaccacgacucaaauaaggguguuacugcggcuuguccucaugccggggcaaagaguuucuacaaaaacuugauuuggcucgugaagaaaggaaauagcuauccaaagcugucuaaauccuacaucaacgauaagggcaaggaaguccuggugcucuggggcauacaccaccccucaacaagcgccgaccaacagaguuuauaucagaaugcugaugcauacguauuuguugggaccucucgcuacuccaaaaaguucaaaccugagaucgccauucgaccaaaggugcgugaccaggagggaagaaugaacuauuacuggacgcuggucgaacccggugauaaaaucacuuuugaggcuaccggcaaucuuguggugccuagguaugccuucgcgauggaacgggacgcagggagcggaauuaucauaucggauacaccaguccaugacugcaacacuaccugucaaacaccgaagggcgccauuaacaccucuuugcccuuucagaauauccacccuauuacgaucgguaaaugcccaaaguacguuaaguccacuaaacugcgccuagcuacagggcucagaaacgugcccucaauccagaguaggggacuguucggcgccauugcaggcuuuauagaagggggauggaccgguaugguagacggcugguauggguaccaucaccagaaugaacaaggaagcggcuaugcugccgaucuuaaguccacucagaacgcgaucgacgagauuacaaauaaagugaacucugucaucgagaagaugaauacccaguucacggccguggguaaagaauuuaaccaccuggagaagcggauagaaaauuugaacaagaaaauugaugacggguuccucgauaucuggaccuacaaugcagagcuguuaguucugcucgaaaacgagcgcacacuugacuaccaugauagcaaugugaagaaccuguaugagaaaguccgaucacaguugaagaauaacgcuaaagaaaucggcaacggauguuucgaguuuuaccacaagugcgacaauacuuguauggaaagugugaagaacggcaccuaugauuacccuaaauauuccgaggaagccaagcuaaauagagaggagauugacgggguaaaacuggaaagcacaaggaucuaccaaauucucgcuauauauucuacuguugccucaagucuggugcuugucgugagccugggagca

SEQ ID NO: 28285 - RNA, 1593 nt, Artificial Sequence
  derived and/or modified sequence opt3 from anti-influenza_Chain
acccugugcaucggcuaccacgccaacaauagcacagacacuguggauacgguccucgagaagaacguuaccgugacacauuccguaaaucuucuggaagacaaacacaacgggaaguuguguaaauuaagaggaguggcuccccugcaucuagguaagugcaauauugcaggcuggauacucgggaacccugagugugaaucucugucaacugccaguagcugguccugcaucgucgagaccucuucgucagauaauggaacauguuauccaggcgacuucauugauuacgaggagcuuagggagcagcugagcaguguguccucuuuugaacgguucgagaucuuuccgaaaaccagcuccuggcccaaccacgacucaaauaaggguguuacugcggcuugcccucaugccggggcaaagaguuucuauaaaaacuugauuuggcucgugaagaaaggaaauagcuacccaaagcugucuaaauccuauaucaacgauaagggcaaggaaguccuggugcucuggggcauacaccaccccucaacaagcgccgaccaacagaguuuauaccagaaugcugaugcauauguauuuguugggaccucucgcuacuccaaaaaguucaaaccugagaucgccauucgaccaaaggugcgugaccaggagggaagaaugaacuacuauuggacgcuggucgaacccggugauaaaaucacuuuugaggcuaccggcaaucuuguggugccuagguacgccuucgcgauggaacgggacgcagggagcggaauuaucauaucggauacaccaguccaugacuguaacacuaccugccaaacaccgaagggcgccauuaacaccucuuugcccuuucagaauauccacccuauuacgaucgguaaauguccaaaguauguuaaguccacuaaacugcgccuagcuacagggcucagaaacgugcccucaauccagaguaggggacuguucggcgccauugcaggcuuuauagaagggggauggaccgguaugguagacggcugguacggguaucaucaccagaaugaacaaggaagcggcuacgcugccgaucuuaaguccacucagaacgcgaucgacgagauuacaaauaaagugaacucugucaucgagaagaugaauacccaguucacggccguggguaaagaauuuaaccaccuggagaagcggauagaaaauuugaacaagaaaauugaugacggguuccucgauaucuggaccuauaaugcagagcuguuaguucugcucgaaaacgagcgcacacuugacuaccaugauagcaaugugaagaaccuguacgagaaaguccgaucacaguugaagaauaacgcuaaagaaaucggcaacggaugcuucgaguuuuaucacaagugugacaauacuugcauggaaagugugaagaacggcaccuacgauuauccuaaauacuccgaggaagccaagcuaaauagagaggagauugacgggguaaaacuggaaagcacaaggaucuaucaaauucucgcuauauacucuacuguugccucaagucuggugcuugucgugagccugggagca

SEQ ID NO: 28286 - RNA, 1593 nt, Artificial Sequence
  derived and/or modified sequence opt3 from anti-influenza_Chain
acccugugcaucggcuaccacgccaacaauagcacagacacuguggauacgguccucgagaagaacguuaccgugacacauuccguaaaucuucuggaagacaaacacaacgggaaguuguguaaauuaagaggaguggcuccccugcaucuagguaagugcaauauugcaggcuggauacucgggaacccugagugugaaucucugucaacugccaguagcugguccuauaucgucgagaccucuucgucagauaauggaacaugcuacccaggcgacuucauugauuaugaggagcuuagggagcagcugagcaguguguccucuuuugaacgguucgagaucuuuccgaacaccagcuccuggcccaaucacgacucaaacaaagguguuacugcggcuuguccucaugccggggcaaagaguuucuacaagaauuugauuuggcucgugaaaaagggaaacagcuauccaaaacugucuaaguccuacaucaaugauaaaggcaaggaaguccuggugcucuggggcauacaccaccccucaacaagcgccgaccaacagaguuuauaucagaacgcugaugcauacguauuuguugggaccucucgcuacuccaagaaauucaagccugagaucgccauucgaccaaaagugcgugaccaggagggaagaaugaauuauuacuggacgcuggucgaacccggugauaagaucacuuuugaggcuaccggcaaccuuguggugccuagguaugccuucgcgauggaacgggacgcagggagcggaauuaucauaucggauacaccaguccaugacugcaacacuaccugucaaacaccgaaaggcgccauuaauaccucuuugcccuuucagaacauccacccuauuacgaucgguaagugcccaaaauacguuaaguccacuaagcugcgccuagcuacagggcucagaaaugugcccucaauccagaguaggggacuguucggcgccauugcaggcuuuauagaagggggauggaccgguaugguagacggcugguauggguaccaucaccagaacgaacaaggaagcggcuaugcugccgaucuuaaauccacucagaaugcgaucgacgagauuacaaacaaggucaauucugugaucgagaaaaugaacacccaguucacggccguggguaaggaauuuaaucaccuggagaaacggauagaaaacuugaauaagaagauugaugacggguuccucgauaucuggaccuacaacgcagagcuguuaguucugcucgaaaaugagcgcacacuugacuaccaugauagcaacgugaaaaaucuguaugagaagguccgaucacaguugaaaaacaacgcuaaggaaaucggcaauggauguuucgaguuuuaccacaaaugcgacaacacuuguauggaaagugugaagaauggcaccuaugauuacccuaaguauuccgaggaagccaaacuaaacagagaggagauugacgggguaaagcuggaaagcacaaggaucuaccaaauucucgcuauauauucuacuguugccucaagucuggugcuugucgugagccugggagca

SEQ ID NO: 28287 - RNA, 1593 nt, Artificial Sequence
  derived and/or modified sequence opt3 from anti-influenza_Chain
acccugugcaucggcuaccacgccaacaauagcacagacacuguggauacgguccucgagaagaacguuaccgugacacauuccguaaaucuucuggaagacaaacacaacgggaaguuguguaaauuaagaggaguggcuccccugcaucuagguaagugcaauauugcaggcuggauacucgggaacccugagugugaaucucugucaacugccaguagcugguccuauaucgucgagaccucuucgucagauaauggaacaugcuacccaggcgacuucauugauuaugaggaacuuagggagcagcugagcaguguguccucuuuugaacgguucgagaucuuuccgaaaaccagcuccuggcccaaccacgacucaaauaaggguguuacugcggcuuguccucaugccggggcaaagaguuucuacaaaaacuugauuuggcucgugaagaaaggaaauagcuauccaaagcugucuaaauccuacaucaacgauaagggcaaggaaguccuggugcucuggggcauacaccaccccucaacaagcgccgaccaacagaguuuauaucagaaugcugaugcauacguauuuguugggaccucucgcuacuccaaaaaguucggaccugagaucgccauucgaccaaaagugcgugaccaggaggguagaaugaacuauuacuggacgcuggucgaacccggcgauaagaucacuuuugaggcuaccgggaaucuuguggugccuagguaugccuucgcgauggaacgggacgcaggaagcggcauuaucauaucggauacaccaguccaugacugcaacacuaccugucaaacaccgaaaggugccauuaacaccucuuugcccuuucagaauauccacccuauuacgaucgggaagugcccaaaauacguuaaguccacuaagcugcgccuagcuacaggacucagaaacgugcccucaauccagaguaggggccuguucggcgccauugcaggguuuauagagggagguuggaccggcaugguagacgggugguauggauaccaucaccagaaugaacaaggcagcgguuaugcugccgaucuuaaauccacucagaacgcgaucgacgagauuacaaauaaggugaacucugucaucgagaaaaugaauacccaguucacggccguggggaaggaauuuaaccaccuggagaaacggauagaaaauuugaacaagaagauugaugacggcuuccucgauaucuggaccuacaaugcagagcuguuaguucugcucgaaaacgagcgcacacuugacuaccaugauagcaaugugaaaaaccuguaugagaagguccgaucacaguugaaaaauaacgcuaaggaaaucggaaacggcuguuucgaguuuuaccacaaaugcgacaauacuuguauggaaagugugaagaacgggaccuaugauuacccuaaguauuccgaggaagccaaacuaaauagagaggagauugacggaguaaagcuggaaagcacaaggaucuaccaaauucucgcuauauauucuacuguugccucaagucuggugcuugucgugagccugggugca

SEQ ID NO: 28288 - RNA, 1593 nt, Artificial Sequence; identical to SEQ ID NO: 28284
  derived and/or modified sequence opt3 from anti-influenza_Chain

SEQ ID NO: 28289 - RNA, 1593 nt, Artificial Sequence; identical to SEQ ID NO: 28285
  derived and/or modified sequence opt3 from anti-influenza_Chain

SEQ ID NO: 28290 - RNA, 1593 nt, Artificial Sequence; identical to SEQ ID NO: 28286
  derived and/or modified sequence opt3 from anti-influenza_Chain

SEQ ID NO: 28291 - RNA, 1593 nt, Artificial Sequence; identical to SEQ ID NO: 28287
  derived and/or modified sequence opt3 from anti-influenza_Chain

SEQ ID NO: 28292 - RNA, 1605 nt, Artificial Sequence
  derived and/or modified sequence opt3 from anti-influenza_Chain
gccaacgcugacacccugugcaucggcuaccacgcaaauaacagcacagauacuguggacacgguccucgagaagaauguuaccgugacacauuccguaaaccuucuggaagauaaacacaaugggaaguuguguaaauuaagaggaguggcgccccugcaucuagguaagugcaacauugccggcuggauacucgggaauccugagugugaaucucugucaacugcuaguagcugguccuauaucgucgagaccucuucgucagacaacggaacaugcuacccaggcgauuucauugacuaugaggagcuuagggagcagcugagcaguguguccucuuuugaacgguucgagaucuuuccgaaaaccagcuccuggcccgaucacgacucaaauaaggguguuacugccgcauguccucaugccggggcuaagaguuucuacaaaaacuugauuuggcucgugaagaaaggaaauagcuauccaaagcugucuaaauccuacaucaacgauaagggcaaggaaguccuggugcucuggggcauacaccaccccucaacaagcgcagaccaacagaguuuauaucagaaugccgaugcuuacguauuuguugggaccucucgcuacuccaaaaaguucaaaccugagaucgccauucgaccaaaggugcgugaccaggagggaagaaugaacuauuacuggacgcuggucgaacccggugauaaaaucacuuuugaggcgaccggcaaucuuguggugccuagguaugcauucgccauggaacggaacgcugggagcggaauuaucauaucggacacaccaguccaugacugcaacacuaccugucaaacaccgaagggcgccauuaauaccucuuugcccuuucagaacauccacccuauuacgaucgguaaaugcccaaaguacguuaaguccacuaaacugcgccuagcaacagggcucagaaaugugcccucaauccagaguaggggacuguucggcgcuauugccggcuuuauagaagggggauggaccgguaugguagauggcugguauggguaccaucaccagaacgaacaaggaagcggcuaugcggccgaccuuaaguccacucagaaugcaaucgauaaaauuacaaacaagguaaauucugucaucgagaaaaugaacacccaguucacggcuguggguaaggaguuuaaucaccuggaaaagcggauagagaacuugaauaaaaagguugacgauggguuccucgacauuuggaccuacaacgccgaacuguuagugcugcucgagaaugaacgcacacuugauuaccaugacagcaacgucaaaaaucuguaugagaaggugcgaucacaguugaaaaacaacgcuaaggagaucggcaauggauguuucgaauuuuaccacaagugcgauaacacuuguauggagagugugaaaaauggcaccuaugacuacccuaaguauuccgaagaggccaaacuaaacagagaagagaucgaugggguuaagcuggagagcacaaggauuuaccaaauccucgcaauuuauucuacuguggccucaagucugguccuuguggucagccugggagcu

SEQ ID NO: 28293 - RNA, 1605 nt, Artificial Sequence
  derived and/or modified sequence opt3 from anti-influenza_Chain
gccaacgcugacacccugugcaucggcuaccacgcaaauaacagcacagauacuguggacacgguccucgagaagaauguuaccgugacacauuccguaaaccuucuggaagauaaacacaaugggaaguuguguaaauuaagaggaguggcgccccugcaucuagguaagugcaacauugccggcuggauacucgggaauccugagugugaaucucugucaacugcuaguagcugguccuauaucgucgagaccucuucgucagacaacggaacaugcuacccaggcgauuucauugacuaugaggaacuuagggagcagcugagcaguguguccucuuuugaacgguucgagaucuuuccgaaaaccagcuccuggcccaaucacgauucaaacaaggguguuacugccgcauguccucgcgccggggcuaagggauucuacaaaaauuugauuuggcucgugaagaaaggcaacaguuauccaaagcugaauaaaagcuacaucaacgacaagggcaaggaaguccuggugcucugggggauacaucaccccucuacaaccgcagaucaacaguccuuauaucagaaugccgacacguacguauuuguuggaacuucacgauacagcaaaaaguucaaaccugagaucgagauucguccaaaggugagagaucaggaagguaggaugaacuauuacuggacccuggucgagcccggcgacaaaaucacauuugaagcuacugggaaccuuguggugccucgguaugccuucgcgauggagcgcaaugcaggaaguggcauuaucauaucugauaccccaguccacgacugcaacacaaccugucaaacgccgaagggugccauuaauacuuccuugcccuuucagaacauccauccuauuacaaucgggaaaugcccaaaguacguuaagagcaccaaacugagacuagcuacuggacucaggaaugugcccucgauccagucucggggccuguucggcgccauugcaggguuuauagaaggagguuggacaggcaugguagacgggugguauggauaccaccaucagaacgagcaaggcuccgguuaugcugccgaucuuaagucaacccagaaugcgaucgacaaaauuacgaacaaggugaauagugucaucgagaaaaugaacacccaguucacagccguggauaaggaauuuaaucaccuggagaagcgcauagaaaacuugaauaaaaagguugacgauggguuccucgacauuuggacuuacaacgcagagcuguuagugcugcucgaaaaugagcgaacccuugauuaccacgacagcaacgucaaaaaccuguaugagaaggugagaaaucaguugaaaaacaaugcuaaggaaaucggcaacggauguuucgaguuuuaccauaagugcgauaauacauguauggaauccguuaaaaacggcacuuaugacuacccuaaguauucugaggaagccaaacuaaauagggaggagaucgaugggguaaagcuggaaagcacccggauuuaccaaauccucgcuauuuauucaacaguggccaguucccugguccuuguggucagccugggagca

SEQ ID NO: 28294 - RNA, 1605 nt, Artificial Sequence; identical to SEQ ID NO: 28292
  derived and/or modified sequence opt3 from anti-influenza_Chain

SEQ ID NO: 28295 - RNA, 1605 nt, Artificial Sequence; identical to SEQ ID NO: 28293
  derived and/or modified sequence opt3 from anti-influenza_Chain

SEQ ID NO: 28296 - RNA, 1644 nt, Artificial Sequence
  derived and/or modified sequence opt3 from anti-influenza_Chain
cagaagcugcccggcaacgacaauagcaccgccacacucugccuugggcaccaugcugugccuaacggaacuaucgucaaaacgauuaccaaugaucaaauagagguuacaaacgcaacugaacuggugcaguccucuucaaccggugagaucugugacaguccacaccagauuuuggauggcgaaaauugcacauuaaucgacgcccugcuaggggauccgcagugugacggauuccaaaacaagaaaugggaucucuuuguagagagaagcaaggcguacuccaauugcuaucccuacgacgugccugauuaugcuucucugaggucgcuugucgccucaagcggcacccuggaguucaacaaugaaaguuuuaacuggacuggugugacacagaaugggaccuccucugcauguauucggcgcagcaacaauuccuucuuuucacgauugaacuggcucacgcaucugaaauucaaguacccagcccugaauguuacuaugcccaacaacgagaaguuugacaaacucuauaucuggggagugcaccauccuggcaccgauaaugaccagauauucccauacgcucaggcaaguggccguaucacagucagcacuaagagaucucaacagaccgugauucccaacaucggguccaggccucggguacgcaauauuccaucaagaaucagcauauauuggacaauuguuaaaccgggagauaucuuacugauuaacaguaccgguaaucuuaucgcccccaggggcuacuuuaagauccggucugggaaauccagcauuaugcgcucggacgcuccuauaggaaagugcaacucugaauguaucacgccaaauggcuccauucccaacgacaagccuuuccagaaugugaaccgaaucacuuacggugccugcccaagauaugucaaacagaauacauugaagcuggcgaccgggaugaggaacgugcccgagaaacaaacucggggaauauuuggcgcaauugccggcuucaucgaaaaugggugggagggaaugguggaugguugguacggcuuucgucaccagaacucagaggggaucggacaggcugccgaccuaaagaguacacaagcagcuauugaucagaucaauggcaaacucaaccgccugauugguaagaccaacgaaaaauuccaccagauagagaaggaguucagcgaagucgaagggagaauccaggaccuugagaaguauguugaggauacgaaaauugaccugugguccuacaaugccgaauugcucguggcgcuggagaaccaacauaccaucgauuuaacagacucugaaaugaauaagcuguuugagaaaacuaagaaacagcucagggaaaacgccgaggauaugggcaauggauguuucaagaucuaucacaagugcgacaacgcauguauuggcagcauacggaaugggaccuacgaucaugacguauaucgagacgaggcucuuaacaaucgcuuucagaucaaaggaguggaacugaagucagguuacaaagauuggauuuuguggaucaguuucgccauuuccugcuuucuacugugcgucgcucuccugggcuucaucaugugggccugucagaaggggaacauaagaugcaauauc

SEQ ID NO: 28297 - RNA, 1644 nt, Artificial Sequence; identical to SEQ ID NO: 28296
  derived and/or modified sequence opt3 from anti-influenza_Chain

SEQ ID NO: 28298 - RNA, 1647 nt, Artificial Sequence
  derived and/or modified sequence opt3 from anti-influenza_Chain
augcugaccuuccacagaaucauuaggaagggcuggauguuucuccuugccuuccuguugacagcuuuacuguuuugccccacugggcagccugcaaaagccgcggcuccauucaacggaacgaugaugcaauacuuugagugguaucuaccggacgaugguacccucuggacaaagguggccaaugaagcaaacaaucugagcucccuuggcauaacugcccugugguugcccccugcuuacaaagggaccucucggucagacgucggauauggcguuuacgaucucuaugaccugggugaguucaaccagaagggggcagugcgcacaaaauacggaaccaaggcccaguaucugcaggcuauccaagccgcgcaugcagccggcaugcagguauacgcugauguggucuuugaccacaagggcggggccgauggaacugaauggguggacgcaguugaggugaauccaagugaucgaaaccaggaaauuagcgguacauaccagauccaggcuuggaccaaauucgacuuucccggccgugggaauacguauuccucuuucaaguggagaugguaccauuuugauggagucgacugggaugagucgaggaaacucucacggauuuauaaguuccgcggcaucgguaaagccugggacugggagguggacacugaaaacgggaauuacgauuauuuaauguacgcggaccuggauauggaccacccugagguaguuaccgaacuuaagagcuggggaaagugguaugugaacacaacuaauauagauggcuuuagauuggacgccgucaaacauaucaaguucaguuucuuuccagauuggcuguccgacgugaggucucaaaccggcaaaccccuauucacagugggggaguacuggagcuacgauauuaacaagcuccacaauuauaucaugaaaaccaacggaacgaugucccuguuugacgcaccucuucacaauaaguucuacacugcuucaaaaagugguggcacauuugauaugcggacccugaugacuaacacauugaugaaggaccagccaacccucgccgucacguucguugacaaccaugauaccgagccggggcaggcucugcaaagcuggguggaccccugguuuaagccuuuagccuaugcauucauucugacacgccaggaaggauacccauguguauuuuauggcgauuacuaugguaucccccaguacaauauaccuucucucaaauccaagauugacccacuucugaucgcccgaagagauuacgcuuaugggacucaacacgacuacuuggaucauucagacauuaucggcuggaccagggagggagugacagaaaaacccggcagcgggcuagcggcacugaucacugauggaccggguggcaguaaguggauguaugucgggaaacagcacgccggaaagguguucuacgaccucaccggcaaccggucugauacaguuaccauuaauuccgacgguuggggcgaguuuaaggugaacgggggaagcgucucgguguggguaccucguaaaacuacgguuucuacaauagcuugguccaucaccacucgccccuggaccgaugaguucgugagauggacagaaccaaggcuggucgccuggccu

SEQ ID NO: 28299 - RNA, 1647 nt, Artificial Sequence
  derived and/or modified sequence opt3 from anti-influenza_Chain
aucugcauuggcuaccacgccaacaauagcaccgaacagguggacacaauaauggaaaagaacgucacuguuacgcaugcucaagauauccuggagaaaacccacaaugggaagcucugugaccuugauggagugaaaccccugauuuugagagacugcuccguagcagguugguuacugggcaacccuaugugugaugaauuuaucaaugugccagaguggucuuauauugucgaaaaggccaacccggcgaaugaccuaugcuaccccgggaacuuuaaugauuaugaggagcucaaacaucugcuuucaaggaucaaccacuucgaaaagauacagaucauuccuaagaguagcugguccgaccaugaggcuucuucgggagugucaagcgccuguccauaccagggcacacccaguuucuuccggaauguuguguggcugaucaaaaagaacaauacuuauccuaccauuaaacgcuccuacaacaauacaaaccaggaagauuugcucauccugugggguauacaccacucuaacgacgcagccgagcaaaccaagcuguaucagaauccaacuacauacauuagcgucgggaccuccacgcucaaccagcgauuagugcccaaaaucgcuacucguucaaagguaaauggacagaacggcagaauggacuuuuucuggaccauucugaagccuaaugaugcaaucaacuuugagaguaauggcaacuucaucgccccagaauacgcuuauaaaauuguuaagaaaggggauagcgccauagugaagucugaggucgaauacggaaauugcaacacaaaaugucaaacuccgaucggugcgauuaauuccucaaugcccuuucauaacauccacccucuuaccauaggcgagugcccaaaguaugugaaaagcaauaaguuggugcuggcaacagggcuaaggaacaguccccuccggucugacaagacccauacguguccuccaugccccgccccggaacugcuuggaggcccuuccgucuuccuguuucccccaaaaccuaaggacacuuugaugauuagccgcacacccgagguuaccugugugguaguggaugucucgcacgaggacccagaagugaaauucaauugguacguugaugguguggagguccacaacgcuaagacuaaacccagagaggagcaguauaacucuacauacagggugguauccguucucaccgugcugcaucaggacugguuaaaugggaaggaauauaagugcaaagucucaaacaaggcccugccugcaccaaucgagaaaacgaucaguaaggcuaaaggacagccgcgggagccccaaguguacacccucccuccaagccgcgaagagaugacaaagaaucaggucucccuuacuugccuggugaagggcuuuuaccccucugauauugccguugaaugggagagcaacggccagccugaaaauaacuauaaaaccacaccacccguguuggacucagaugggaguuucuuccuauacuccaagcugacuguagacaaaagccgauggcaacagggaaaugucuuuucuuguucagugaugcacgaggcgcuccauaaccacuauacccagaagagucugagccuuuccccggguaaa

SEQ ID NO: 28300 - RNA, 1647 nt, Artificial Sequence; identical to SEQ ID NO: 28299
  derived and/or modified sequence opt3 from anti-influenza_Chain

SEQ ID NO: 28301 - RNA, 1647 nt, Artificial Sequence; identical to SEQ ID NO: 28298
  derived and/or modified sequence opt3 from anti-influenza_Chain

SEQ ID NO: 28302 - RNA, 1650 nt, Artificial Sequence
  derived and/or modified sequence opt3 from anti-influenza_Chain
gaccagaucugcauuggcuaccacgccaacaauagcaccgagcaaguggauacaauaauggaaaagaacgucacuguuacgcaugcucaggacauccuggagaaaacccacaaugggaagcucugugaucuugacggagugaaaccccugauuuugagagauugcuccguagcagguugguuacugggcaacccuaugugugacgaauuuaucaaugugccagaguggucuuauauugucgaaaaggccaacccgacaaaugaucuaugcuaccccgggucauuuaacgacuaugaggagcucaaacaucugcuuaguaggaucaaucacuucgaaaagauacagaucauuccuaagagcuccuggucugaucaugaggcgucgucaggagugagcagugcuuguccauaccugggcucccccucuuucuuccggaacguugugugguugaucaaaaagaauagcacuuauccuaccauuaaaaaguccuacaacaauacaaaccaggaagaccuccugguccugugggguauccaccacccaaaugaugccgcagagcaaacccgccucuaucagaaccccacuacauacauaucaauugggaccaguacguuaaaccagcgacuggugccuaaaaucgccacucguagcaagguaaauggacagucuggcagaauggaguuuuucugggcuauucuuaagccaaacgacgcaaucaauuuugaauccaacggcaauuucaucgccccggaguacgcuuauaaaauuguuaagaaaggggauucagccauaaugaaaagcgaauuggaguacggaaacugcaauaccaagugucaaacacccaugggugcgaucaacaguucuaugccuuuucauaauauucacccacugacuaucggcgaaugccccaaguaugugaaauccaacaggcuaguccucgcaaccgggcugcggaauagcccucagcgcgagucgagaaggaagaagcggggacuuuucggcgccauagcugguuuuauugaagggggauggcagggcaugguggacggcugguacggguaucaucacucuaacgaacagggauccgguuacgccgcagacaaagagucaacacaaaaggcuaucggcgugaccaauaaagucaacaguaucauugauaagaugaauacgcaguucgaagccguugggcgcgaguuuaacaaccuggaacgaagaaucgagaauuugaacaaaaagauggaggacggauuccucgauguguggacuuauaaugcggaacuguuaguacugauggagaacgaaaggacacucgacuuccacgauagcaaugugaagaaccuuuacgacaaaguccggcugcaguugcgugauaaugccaaggagcuaggcaacgguuguuuugaguucuaccauaaaugcgacaaugaguguauggaguccauucgcaacgggaccuauaauccacaauacucugaagaggcaagacugaagagggaagagauaagcggcgugaaacucgagucaaucggaacuuaucagauucugaguaucuacuccacaguugcuagcucucuugcccuggcuaucaugauugccggcuugucacucuggaugugcaguaacgggagccugcagugccggauauguauc

SEQ ID NO: 28303 - RNA, 1650 nt, Artificial Sequence; identical to SEQ ID NO: 28302
  derived and/or modified sequence opt3 from anti-influenza_Chain

SEQ ID NO: 28304 - RNA, 1656 nt, Artificial Sequence
  derived and/or modified sequence opt3 from anti-influenza_Chain
augaacauccagauucuggccuucauagcuugcgugcucaccggcgcaaagggggacaaaaucugucuuggacaccaugccgucgcgaaugguacaaagguuaacacucugacggagaaaggcauugaagugguaaaugcuaccgagacaguggaaacugccgaugucaagaaaaucugcacccaagggaagagagcaacagacuugggaagguguggcuuacuggguacccuaauugggcccccucagugcgaucaguuucucgaguucagcuccgaccugaucauagaacggcgcgagggaacugauguguguuacccaggccgauuuacaaacgaggaaucucuucgucagauccugagaaggucaggcgggauuggaaaggagaguauggguuucaccuauagcggcauccggacgaauggggccgcuuccgcaugcacucgcucuggaucgucauuuuacgccgaaaugaaaugguugcucagcaacagugacaauuccgcuuucccgcaaaugaccaaggccuauagaaaccccaggaauaaaccugcgcugauuaucuggggcguucaccauucugagagcgcauccgagcagacaaagcuguacgguucagggaacaaacucauaacugugcggaguagcaaguaucagcagucuuuuaccccaucccccggaacacgccgaauugauuuccacugguuacugcuugacccuaaugauaccgucacguuuacuuucaacggcgccuuuaucgcuccagacagagccucauucuuuaggggcgagagcuugggggugcaaagugaugcaccccuggacucuuccugucggggagauugcuuccauagcgguggcacaauuguaucgucucuaccuuuccagaauaucaacucccguaccguugggcgcuguccaagauacgugaagcagaaaucacuccugcuugcuacuggaaugaggaaugucccggaaaagcccaaaccucggggccuguuuggugccaucgcgggguucauugaaaacggcugggagggauugauaaacggcugguauggguuucgacaccagaaugcccaaggagaagguacagcagcugacuacaagaguacccagagcgccaucgaccagauuacgggcaaacucaaccgccugaucgggaagaccaaucaacaguucgaguuaauagauaacgaguuuaaugaaauugagcagcagaucggaaacgugaucaauuggacaagagacgcuaugacugaaauuugguccuacaacgccgagcugcucguggcaauggaaaaucaacacaccaucgaucuugccgacucugagaugagcaaacuguaugagagggucaagaagcaguugcgggaaaacgcugaggaagauggcacagguugcuucgagauuuuucauaaaugugacgaucagugcauggaaucaauacgcaauaacacuuacgaccacacccaguauagaacagagagucuacaaaauaggauccagauugauccaguuaagcuguccagcggguacaaagacaucauccucugguucucuuuuggcgcgucaugcuucauucugcuugcaauagccaugggacugguguuuaucuguauuaagaacggcaauaugcagugcaccaucuguauu

SEQ ID NO: 28305 - RNA, 1656 nt, Artificial Sequence
  derived and/or modified sequence opt3 from anti-influenza_Chain
augaacacccagauccuggccuucauugcuugcgugcucacaggcgucaagggggacaaaauaugucuuggacaccaugcaguugccaaugguacuaaggugaacacgcugaccgagaaaggcaucgaaguagugaaugcgacagagacugucgaaaccgcugaugugaagaaaauuugcacacaagggaagagagccaccgacuugggaagguguggcuuacuggguacucuaaucgggcccccucagugcgaucaguuucucgaguucagcuccgaccugauuaucgaacggcgcgagggaacagauguuuguuacccaggccgauuuaccaacgaggaaucucuucgucagauacugagaaggucaggcgggaucggaaaggagaguauggguuucacguauagcggcauucggacuaauggggcaaccuccgccugcacacgcucuggaucgucauuuuacgcugaaaugaaaugguugcucagcaacagugacaauuccgcauucccgcaaaugacuaaggccuauagaaaccccaggaauaaaccugcucugaucauuuggggcgugcaccauucugagagcgucuccgagcagaccaagcuguacgguucagggaacaaacucaucacagugcggaguagcaaguaucagcagucuuuuaccccaucccccggagcccgccgaauagauuuccacugguuacugcuugacccuaaugauacgguaacuuuuacauucaacggcgcguuuauugcaccagacagagccucauucuuuaggggcgagagcuuggggguucaaagugaugugccccuggacucuuccugucggggagauugcuuccauagcgguggcaccaucgucucgucucuaccuuuccagaauauuaacucccguacuguggggaaguguccacgcuacgugaaacagaagucacuccugcuugcuacaggaaugagaaaugucccggaaaaacccaagccuaggggccuguuuggugccaucgcaggguucaucgaaaacggcugggagggauugauuaacggcugguauggguuucggcaccagaaugcucaaggagaagguaccgccgcggacuacaaaaguacgcagagcgccauagaccagaucaccggcaagcucaaccgacugauugggaaaacaaaucaacaguucgaguuaaucgauaacgaguuuaaugaaauagagcagcagauuggaaacguuaucaauuggacucgcgacgcaaugaccgaaaucugguccuacaacgcugagcugcucguggccauggaaaaucaacacacaauugaucuugcugacucugagaugagcaagcuguaugagagaguaaagaaacaguugagggaaaacgccgaggaagauggcacugguugcuucgagaucuuucauaagugugacgaucagugcauggaaucaauucggaauaacaccuacgaccacacacaguaucgcaccgagagucuacaaaauagaauacagaucgauccagugaaacuguccagcggguacaaggacauuauccucugguucucuuuuggcgcaucaugcuuccugcuucuggccaucgcuaugggauuggucuuuauuuguaucaaaaacggcaauaugcagugcacuauauguauu

SEQ ID NO: 28306 - RNA, 1656 nt, Artificial Sequence
  derived and/or modified sequence opt3 from anti-influenza_Chain
augaacauccagauucuggccuucauagcuugcgugcucaccggcgcaaagggggacaaaaucugucuuggacaccaugccgucgcgaaugguacaaagguuaacacucugacggagaaaggcauugaagugguaaaugcuaccgagacaguggaaacugccaacaucaagaaaauuugcacccaagggaagagacccacagauuugggacaguguggcuuacuggguacccuaaucgggccuccacagugcgaccaguuucucgaguucagcuccgaucugauaaucgaaaggcgggagggaacugacgucuguuacccgggcaaguuuacaaaugaggaaucucuucgccaaauucugcgacguucaggcgggaucggaaaagagaguauggguuucaccuauagcggcauuagaacgaacggggcaacuuccgccugcaccaggucuggaucgucauuuuacgcugaaaugaagugguugcucagcaauagugauaacgcagccuucccccagaugacaaaauccuaucggaauccucgcaacaagccagcucugaucauauggggcgugcaccauucugagagcguuuccgagcagacuaaacuguacgguucagggaauaagcucauuaaggugagaaguagcaaauaucagcaaucuuuuacccccaacccuggagccaggcggaucgacuuccacugguuacugcuugauccaaaugacacagucaccuuuacguucaacggcgcguuuauugcacccgaucgcgccuccuucuuucgaggcgaaucaaucggggugcagagcgacgcuccuuuggauaguucuuguggagguaauugcuuccauaacggcgggacuaucguauccagccugccauuccagaacauuaauccgagaacaguuggaaagugucccagguacgugaaacagaagucgcuacuccuggccaccggcaugcggaacgucccugagaaaccaaagaaacguggucuuuuuggggcaauagcuggcuucaucgaaaauggaugggagggccugauuaacgggugguauggauuucgccaccaaaaugcccagggugaaggcacugcggccgacuacaagucuacacaguccgcaaucgaucaaauaaccgggaaguugaacagacucauuggaaaaacgaaucagcaguucgagcugaucaacaaugaguuuaacgaaguggagcagcaaaucggcaaugugauuaacuggacccaggacgcuaugacagaagucuggucauacaaugccgaguuacugguugcuauggaaaaccagcacacuaucgaccucaccgauagugagaugagcaaacuuuaugagagggugcggaagcagcugcgagaaaaugccgaggaagacgguacagggugcuucgagauuuuucauaagugugaugaccacugcauggaauccauacgcaacaacacuuacgaucauacccaauauagaacagagucuuugcagaauaggauccagauugaccccguaaaacuaagcggcggauacaaggauaucauccugugguucucauuuggcgcaaguugcuuccuccugcuugccauugcuauggggcugguguuuauauguaucaagaacggaaauaugcagugcaccauuuguauc

SEQ ID NO: 28307 - RNA, 1656 nt, Artificial Sequence
  derived and/or modified sequence opt3 from anti-influenza_Chain
gaccagaucugcauuggcuaccacgccaacaauagcaccgagcaaguggauacaauaauggaaaagaacgucacuguuacgcaugcucagaauauccuggagaaaacccacaacgggaagcucugugaccuugauggagugaaaccccugauuuugagagacugcuccguagcagguugguuacugggcaauccuaugugugaugaguuccuaaacgugccagaauggucuuauaucgucgaaaagauuaauccggccaacgaccucugcuaccccgggaauuuuaacgauuaugaggagcugaaacaucuucugucaaggaucaaucacuucgaaaagauacagaucauuccuaagaguagcugguccgaccaugaggcgucuucgggagugucaagcgcuuguccauaccagggccggaguuccuuuuuccgcaacguugugugguugaucaaaaaggauaaugccuaucccacaauuaaacgaucuuacaacaauacuaaccaagaagaccuccugguccugugggguauccaccacccuaacgaugcagccgagcagacccgucucuaucagaauccaacaaccuacauaagcguggggacuuccacauuaaaccagagacugguacccaagauugcuaccaggucaaaaguuaauggacaaaguggccggauggaguuuuucuggacgauccuuaagccuaacgacgcaauuaauuuugaaagcaacggcaauuucaucgccccagagaacgcuuacaagaucgugaaaaagggggauucuacuauuaugaaauccgaauuggaguauggaaauugcaacaccaagugucagacaccgauaggugccaucaauucaagcaugcccuuucauaacauucacccucugacuaucggcgaaugcccaaaauacgucaagaguaauaagcuagugcucgcgaccgggcugcgcaacucuccccagggagagagaaggcggaaaaagcgcggccuuuucggugcaauagccggguuuauugagggaggcuggcagggcaugguggacgggugguauggauaccaucacuccaaugaacaagguagcggcuaugcugccgacaaagagucgacacagaaggcaaucgauggggucaccaacaaaguuaacucuaucauugacaagaugaauacgcaguucgaagcugugggacgagaguuuaacaaucuggaaagaaggaucgagaacuugaauaaaaagauggaggauggcuuccucgacguauggacuuacaacgccgaacuguuagugcugauggagaaugaacggacacucgauuuccacgacuccaacgucaagaaucuuuaugauaaaauucgucugcaauugcgcgacaacgcgaaggagcuagguaauggguguuuugaguucuaccauagaugcgauaacgaauguauggagucagugaggaauggcaccuacgacuauccucaguacagugaagaggcccggcugaaacgagaagagauaagcggaguuaagcucgaguccaucggcacuuaucagauucugucuaucuacagcacaguggcaucaagucuuacccuggcuaucauggucgccggguugucccucuggaugugcagcaacggaucucugcagugccgcauuuguaua

SEQ ID NO: 28308 - RNA, 1656 nt, Artificial Sequence
  derived and/or modified sequence opt3 from anti-influenza_Chain
gaccagaucugcauuggcuaccacgccaacaauagcaccgagcaaguggauacaauaauggaaaagaacgucacuguuacgcaugcucaggacauccuggagaaaacccacaaugggaagcucugugaucuugacggagugaaaccccugauuuugagagauugcuccguagcagguugguuacugggcaacccuaugugugacgaauuuaucaaugugccagaguggucuuauauugucgaaaaggccaacccgacaaaugaucuaugcuaccccgggucauuuaacgacuaugaggagcucaaacaucugcuuaguaggaucaaucacuucgaaaagauacagaucauuccuaagagcuccuggucugaucaugaggcgucgucaggagugagcagugcuuguccauaccugggcucccccucuuucuuccggaacguugugugguugaucaaaaagaauagcacuuauccuaccauuaaaaaguccuacaacaauacaaaccaggaagaccuccugguccugugggguauccaccacccaaaugaugccgcagagcaaacccgccucuaucagaaccccacuacauacauaucaauugggaccaguacguuaaaccagcgacuggugccuaaaaucgccacucguagcaagguaaauggacagucuggcagaauggaguuuuucuggaccauucuuaacccaaaugacgcuaucaacuuugaauccaauggcaacuucaucgcaccggaguacgccuauaagauuguuaaaaagggggauucagcuauaaugaaaagcgaauuggaguacggaaauugcaacacaaagugucaaacucccaugggugccaucaauaguucuaugccuuuucauaacauucacccacugaccaucggcgaaugccccaaauaugugaaguccaauaggcuaguccucgcgacagggcugcggaacagcccucagcgcgagucgagaaggaaaaagcggggacuuuucggcgcaauagccgguuuuauugaagggggauggcagggcaugguggacggcugguacggguaucaucacucuaaugaacagggauccgguuacgcugccgacaaggagucaacccaaaaagcaaucgauggcgugacgaacaaggucaauaguaucauugacaaaaugaacacucaguucgaagcuguugggcgcgaguuuaacaaucuggaacgaagaaucgagaacuugaauaagaaaauggaggauggauuccucgacguguggacauauaacgccgaacuguuaguacugauggagaaugaaaggacccucgauuuccacgacagcaacgugaagaaucuuuacgauaagguccggcugcaguugcgugacaacgcgaaagagcuaggcaaugguuguuuugaguucuaccauaagugcgauaacgaguguauggaguccauucgcaaugggacuuauaacuacccacaauauucugaagaggccagacugaaaagggaagagauaagcggcgugaagcucgagucaaucggaacauaccagauucugaguaucuauuccaccguugcaagcucucuugcucuggccaucaugauggcuggcuugucacucuggaugugcaguaaugggagccugcagugccggauuuguaua

SEQ ID NO: 28309 - RNA, 1656 nt, Artificial Sequence; identical to SEQ ID NO: 28304
  derived and/or modified sequence opt3 from anti-influenza_Chain

SEQ ID NO: 28310 - RNA, 1656 nt, Artificial Sequence; identical to SEQ ID NO: 28305
  derived and/or modified sequence opt3 from anti-influenza_Chain

SEQ ID NO: 28311 - RNA, 1656 nt, Artificial Sequence; identical to SEQ ID NO: 28306
  derived and/or modified sequence opt3 from anti-influenza_Chain

SEQ ID NO: 28312 - RNA, 1656 nt, Artificial Sequence; identical to SEQ ID NO: 28307
  derived and/or modified sequence opt3 from anti-influenza_Chain

SEQ ID NO: 28313 - RNA, 1656 nt, Artificial Sequence; identical to SEQ ID NO: 28308
  derived and/or modified sequence opt3 from anti-influenza_Chain

SEQ ID NO: 28314 - RNA, 1680 nt, Artificial Sequence
  derived and/or modified sequence opt3 from anti-influenza_Chain
augagcaacauggacaucgauuccauuaauaccggcacaauagacaagacucccgaggaacugacgccugggaccucuggagccacaagaccaaucauuaaaccggcuacucucgcacccccuucaaacaagaggacccggaauccaagucccgagcgcacaaccacuagcuccgaaacagauaucggucgaaaaauucagaagaaacaaaccccuacggagaucaagaagucuguguacaaaauggucguuaaacuuggcgaauuuuauaaccagaugauggugaaagccgggcugaaugacgauauggagcguaacuugauacagaaugcgcaggcuguagagagaaucuuacuggccgcaacugacgauaagaaaaccgaauaccaaaagaagaggaacgcccgggacgugaaagagggaaaggaagagauugaucacaauaaaacaggcgguacuuuuuauaagaugguccgcgacgauaaaaccaucuacuucucgccaauuaagaucacauuucuaaaagaggaagugaagaccauguauaagacgacuauggggucagacggauucagcggccucaaccauauaaugauuggccacagucagaugaaugauguuugcuuucagagauccaaagggcugaagagggugggacuugaccccucucugaucagcacauucgcugguuccaccuugccucggcgcucaggcacuacaggggucgcaauuaaaggaggcgguacccucguggacgaggccauccgauuuaucgggagagcuauggccgauaggggacugcugcgggacauuaaggcgaaaacggcauacgaaaagauacucuuaaaccugaagaauaaauguagugccccacagcaaaaggcucuuguagaucagguuaucggcagccguaacccgggcauugccgacaucgaggauuugacccugcuagcacgcucuaugguggucgugagacccuccguggcuucaaaagucguucucccuauaagcauuuaugccaagaucccacagcugggguucaauacagaagaguacaguauggugggauacgaggcgauggcccuuuauaacauggcaacucccguaucuauccugaggaugggugacgaugcuaaagacaagucccaguuguuuuucaugagcugcuuuggcgccgcuuacgaagaucuccgggugcugucggccuuaaccgggacagaguucaagccucgaucugcacugaaauguaagggauuucaugucccagccaaagaacaaguggagggcaugggugcugcgcucauguccauuaaacuucaguucugggcacccaugacucgcucagggggcaacgaaguuaguggagagggcgggagcggacagaucuccugcucuccgguguucgccgucgagagaccuauugcucugagcaagcaagccgugaggcggauguugucaaugaauguagaaggucgcgacgcagauguuaagggcaaccuacugaagaugaugaaugacaguauggccaaaaagaccuccgggaacgcuuuuauaggaaagaagauguuccagaucagcgacaaaaauaaggugaaccccauugagaucccaaucaaacagacaauuccuaauuucuucuuuggcagagauaccgccgaagacuaugaugaccucgauuac

SEQ ID NO: 28315 - RNA, 1680 nt, Artificial Sequence
  derived and/or modified sequence opt3 from anti-influenza_Chain
augaacacccagauccuggcccucauugcuuacaugcuuauaggcgcaaagggggacaaaaucugccugggacaccaugccguggcgaaugguacaaaggucaacacuuugacggagagaggcauugaaguugugaaugcuaccgagacaguagaaacugugaacaucaaaaagauuuguacccaagggaaaaggcccacagauuuaggacagugcggccugcuagguacccucaucgggccuccacagugugaccaguuccuggaguuugaugccgaccuuauaaucgaacggcgcgagggaacugaugucugcuauccgggcaaguucacaaaugaggaaagccugcgacaaauuuugcguggcuccgggggaaucgacaaggagucuauggguuuuaccuacucaggcauuagaacgaacggggugaccagugcauguaggcggagcggauccucuuucuaugccgaaaugaaauggcuccugucuaauucagauaacgcugcauuuccccagaugacuaagagcuaccgcaauccuagaaacaaaccagcccugaucauauggggcguucaccauagugguuccgcuacagagcagacuaagcucuaugggucuggaaauaaauuaauuaccgugggcagcuccaaguaccagcaaucauucacacccaguccuggcgccaggccacaggucaacgggcagagcggacggaucgacuuucacuggcugcuuuuggaucccaaugacaccgugacguucacuuuuaacggugcguucauugcaccugaucgcgccucguuuuuccgaggcgagucccuggggguacagucagacguuccacuagauagcggaugcgaaggcgacuguuuucauaguagagguacaaucgugucuucccucccguuccaaaauaucaaccccaggaccgucgggaagugcccucgguaugugaaacagacuagccugcuucuggcuacaggcaugcguaacgugccagagaaucccaagacccgcggauuguucggcgccauugcaggguuuauagaaaacggaugggagggucucaucgacggcugguacggguucagacaccagaaugcucaaggagaaggcacggccgcggauuacaaaucgacccagucugccauugaccagaucacagguaagcugaacagguuaauagauaaaacuaaucagcaauuugagcugauugacaacgaguucuccgaaaucgagcagcagaucgggaaugucauuaacuggacccgggauucaaugacagaaguuuggaguuauaaugcagagcuccuuguggcuauggaaaaccagcacacuaucgaccuggccgauagcgagaugaauaaguuguacgagcgaguacgcaaacaacuaagagaaaacgcugaggaagacggcaccggauguuuugagauuuuccauaagugcgaugaccaguguauggaauccauaaggaauaacacauaugaucacacccaguaccggacugagucucugcagaaucgcauccaaauugacccugugaagcucagcucaggcuauaaagacaucauccugugguuuaguuucggggccuccugcuuucuucuguuggcaauugccaugggacucgucuucauaugcaucaagaacgguaacaugagauguacgauuugcauc

SEQ ID NO: 28316 - RNA, 1680 nt, Artificial Sequence
  derived and/or modified sequence opt3 from anti-influenza_Chain
augaacacccagauccuggcccucauugcuugcaugcuuauaggcgcaaagggggacaaaaucugucugggacaccaugccguggcgaaugguacaaaggucaacacuuugacggagagaggcauugaaguugugaaugcuaccgagacaguagaaacugccaacaucaaaaagauuugcacccaagggaaaaggcccacagauuuaggacaguguggccugcuagguacccucaucgggccuccacagugcgaccaguuccuggaguuugaugcagaccuuauaaucgaacggcgcgagggaacugauguguguuacccgggcaaguucacaaaugaggaaagccugcgacaaauuuugcguggcuccgggggaaucgacaaggagucuauggguuuuaccuauucaggcauuagaacgaacggggccaccagugcuugcaggcggagcggauccucuuucuacgcagaaaugaaauggcuccugucuaauucagauaacgccgcuuuuccccagaugacuaagagcuaucgcaauccuagaaacaaaccagcccugaucauauggggcguccaccauagugguuccgcgacagagcagacuaagcucuacgggucuggaaauaaauuaauuaccgugggcagcuccaaguaucagcaaucauucacacccaguccuggcgcaaggccacagguuaacgggcagagcggacggaucgacuuucacuggcugcuuuuggaucccaaugacaccgugacguucacuuuuaacggugccuucauugcuccugaucgcgccucguuuuuccgaggcgggucccugggaguccagucagacgugccacuagauagcggcugugagggugacugcuuucauagugggggcacaaucguaucuucccucccguuccaaaauaucaaccccagaaccguuggaaaguguccuagguacgugaaacagacuagccugcuucuggcaacaggcaugcggaacgucccagaaaaucccaagacccguggguuguucggagcuauugccgguuuuauagagaacggcugggaagggcucaucgacggaugguauggcuuccgccaccagaaugcgcaaggugaggggacggccgcagauuacaaaucgacccagucugcuauugaccagaucacaggcaagcugaacagauuaauagauaaaacuaaucagcaauuugaacugauugacaacgaguucaaugagaucgaacagcagaucggaaacgugauuaauuggaccagggauuccaugacagagguguggucauacaacgccgaacuccuugucgcuauggagaaucagcacacuaucgaccuggccgauagugaaaugaacaaguuguaugagcggguucgaaaacaacuacgcgagaaugcagaagaggacggcaccgggugcuuugaaauuuuccauaagugugaugaccagugcauggagagcauaagaaacaauacauacgaucacacccaguauaggacugaaucccugcagaaccggauccaaauuaacccugugaagcucucuagcggauacaaagacaucauccugugguuuucauucggugccaguugcuuucuucuguuggcuauugcgaugggccucguauucauauguaucaagaaugggaacaugcgcugcacgauuuguauc

SEQ ID NO: 28317 - RNA, 1680 nt, Artificial Sequence
  derived and/or modified sequence opt3 from anti-influenza_Chain
auggagagaaucgugcugcuccuugccauugucagccugguuaaguccgaccagauaugcaucggcuaccacgcuaacaauucuaccgaacaaguggauacaauuauggagaaaaacguaacugugacgcaugcacaggacaucuuggaaaagacccacaaugggaaauuaugugaucuggacggagucaagccccuaauucucagggauugcucaguggccgguuggcugcuuggcaacccuaugugugacgaguuccugaauguuccagaauggaguuauaucguggagaaaauaaacccggcgaaugauuugugcuaccccgggaacuuuaaugacuaugaggaacucaagcaucugcugagccggaucaaccacuucgagcgcauucagaucauuccuaaguccucuuggucggaucaugaagcuaguagcggagucaguuccgccuguccauaccagggccgaucuagcuuuuuccguaaugugguauggcucaucaaaaagaacaaugcauaucccacaauaaaaagauccuacaacaauacuaaccaagaggacuuacugguucuuugggguauucaccacccuaacgaugccgcugagcagaccagguuguaucagaauccaacaaccuacaucucaguggggacuucaacacugaaccagcggcuaguccccaagauugcaacccgcagcaaagugaauggacaaucuggcagaauggaauuuuucuggacgauccucaagccuaacgacgccaucaauuuugaguccaacggcaauuucauugcuccagaaaacgccuacaagaauugccagaaaggggauucaacuauaaugaaaagcgagcuggaauauggaaacuguaauaccaagugccagacaccgaucggugcgauuaacaguucuaugcccuuucauaauauccacccucuuacuauaggcgaguguccaaaguacgugaaauccaacaggcuggucuuggcaaccgggcuccggaauagcccccagggagagcgccgaagaaagaaaaggggccuguucggugccauugcuggguuuaucgaaggaggcuggcaaggcaugguugacgggugguauggauaccaucacucgaacgagcaggguucuggcuaugccgcagacaaggaauccacacagaaggcuaucgauggggugaccaacaaaguaaauucaauuaucgacaagaugaacacgcaauucgaggccgugggacgggaauuuaauaacuuagagcgucgcauugagaaucugaacaaaaagauggaagauggcuuccucgacgucuggacuuacaaugcggagcuucugguguugauggaaaacgagagaacacuagauuuccacgacaguaauguuaaaaaccuguaugauaaggugaggcuccagcugcgggacaaugccaaggaacuugguaacgggugcuuugaguucuaccaucgaugugauaaugagugcauggaaagcguccgcaacggcaccuacgacuauccucaguacuccgaggaagcaagacugaaaagggaggagauaucuggagugaaguuggaaagcaucggcacuuaucagauucucucaaucuacaguacaguagcuuccagccuggccuuagcuaucaugguugccgggcugucucuauggaugugcucaaaugga

SEQ ID NO: 28318 - RNA, 1680 nt, Artificial Sequence; identical to SEQ ID NO: 28314
  derived and/or modified sequence opt3 from anti-influenza_Chain

SEQ ID NO: 28319 - RNA, 1680 nt, Artificial Sequence; identical to SEQ ID NO: 28315
  derived and/or modified sequence opt3 from anti-influenza_Chain

SEQ ID NO: 28320 - RNA, 1680 nt, Artificial Sequence; identical to SEQ ID NO: 28316
  derived and/or modified sequence opt3 from anti-influenza_Chain

SEQ ID NO: 28321 - RNA, 1680 nt, Artificial Sequence; identical to SEQ ID NO: 28317
  derived and/or modified sequence opt3 from anti-influenza_Chain

SEQ ID NO: 28322 - RNA, 1686 nt, Artificial Sequence
  derived and/or modified sequence opt3 from anti-influenza_Chain
augcccagagcccugaggcgggugccuggcagccgcgucaugcuccgaguuggggugguaguggcuguccuugcacugguggccgcguuggcuaacuuagccguuccacguccggcaagagccgcuggagguggcuacuggcacaccuccgggagggagauccuggacgcaaauaacgugcccguccggauugccggaauaaauugguucggcuuugaaacaugcaacuaugugguacauggucuauggucucgcgauuacagaucaaugcucgaccagaucaagagucugggguauaauacuauuaggcuuccuuacagcgaugacauccugaaaccaggaacgaugcccaacuccauuaauuucuaucaaaugaaccaggauuugcagggccucaccucucugcagguuauggacaagaucguggcuuacgccggccaaauagggcugcggaucauucucgaucgccaccgaccugacuguucgggacagucagcguuaugguauacaagcagugucuccgaggcaacuuggaucucugaucugcaggcccuugcucagagauacaaagguaauccaaccguggugggcuuugacuugcauaacgaaccccacgauccugccugcuggggguguggagacccaagcauugauuggaggcuggcagcugagcgggccggcaaugcgguccuauccguuaacccgaaucuccugaucuucguggaagguguacaaucauacaacggggacaguuauugguggggaggcaaucuucagggcgccgggcaguaccccgugguccugaacgugccuaaccguuugguuuauagcgcacaugacuacgcuacaucuguguauccacagaccugguuuuccgaucccacuuucccuaauaacaugccaggaauauggaauaagaacugggguuaccucuuuaaucaaaacauugcccccgucuggcugggcgaguucgggacaaccuuacagucaacgacugaccagaccuggcugaaaacacucgugcaauaucuucgcccgacugcucaguacggagccgauagcuuucaguggaccuucuggaguuggaauccugacucuggcgauacaggugggauccugaaggacgauuggcagaccguagacacgguuaaggauggcuacuuggcacccauuaaauccagcaucuuugacccagugggagccucggcuucuccuuccucacaacccaguccaagcgucucccccucuccuagcccaucaccgagugcguccagaacucccacaccuaccccaacucccacagcaagcccuaccccaacgcuaacccccacagccacuccgaccccuacagcuucuccaacucccucaccuaccgccgcaaguggcgccaggugcacagcuagcuaucaggugaacuccgauugggggaauggauucaccgucacuguggccguuacgaacucugguucgguggcaacaaagaccuggacuguaagcuggaccuuuggcgggaaucagacaaucaccaacuccuggaaugcggcugucacucagaacggacaaucagugacagcccggaauaugaguuacaacaacguuauucagcccggccagaauacgaccuucgguuuccaggcaucuuauacugggagcaacgccgcuccaacaguggccugugcagcuucc

SEQ ID NO: 28323 - RNA, 1686 nt, Artificial Sequence
  derived and/or modified sequence opt3 from anti-influenza_Chain
auggagagagugugguggaaggaagccgucguuuaccagaucuaucccaggagcuucuacgacuccaacggcgaugggauuggagacauacgggguaucauugcuaaacuggauuaucucaaggagcuuggcguggacguaguguggcugucuccugucuacaaaucaccaaaugaugacaacggguaugauaucagugacuaccgcgauauuauggacgaauuuggaaccauggcagauuggaagacaauguuggaggaaaugcacaaacgaggcaucaaguuagugauggaccugguugugaaucauacuagcgaugagcacccgugguucauagagucccguaagucuaaagacaaccccuauagagacuacuacaucuggaggccugguaagaaugggaaagaaccaaacaauugggagucggucuuuucaggaagcgccugggaauaugaugagaugacgggcgaguacuaucuacaucucuucaguaagaaacaacccgaccugaacugggaaaauccuaaggugcggcgcgagguauacgaaaugaugaaguuuuggcuugauaaaggcguugacggguucagaauggaugugauuaacaugaucuccaaggucccagagcugcccgacggagaaccucagucugguaaaaaguaugcgagcggcuccagguacuauaugaaugggccacgggugcacgaguuuuugcaggagaugaaccgcgaagugcucucaaaauacgauauuaugaccgucggagagacaccgggcguuacucccaaggaagguauccuguacaccgacccuagucgaagagagcugaauaugguguuccaguuugaacauauggaucucgacagcgggccaggaggcaaaugggauauaaggcccuggucuuuagcugaccugaagaagacaaugaccaaauggcaaaaggagcuugagggcaaaggguggaacuccuuguaucugaauaaccacgaccagccucgggccguaucacguuucggagaugacgguaaguaccgcguggaaagcgcaaaaaugcuagccacuuuucuccacaugaugcagggcacaccauauauuuaccagggggaggaaaucggaaugaccaacgucagauuccccaguauugaggauuauagggacaucgaaacgcugaauauguacaaggagcggguggaggaauauggcgaggauccgcaagaaguuauggagaagaucuacuacaaaggucgagacaacgcucgcacuccuaugcagugggaugacucugagaaugcaggguuuaccgccggcacacccuggauuccagugaacccuaauuauaaggaaauaaacgucaaagcugcccuugaggaucccaauuccguguuccauuacuauaagaaacugauccaguugagaaagcagcacgacauuaucguauacggaacuuaugaucucauacuggaagacgauccauacauuuauagguacacccggacauuaggcaacgagcaacugaucguuaucaccaauuucagcgaaaagacgcccguguuucgccucccugaccauauuaucuacaaaacuaaggagcuucugauuucgaacuaugacgucgaugaggcggaagaguugaaagaaauaagacuaaggccaugggaggcacguguguacaagauccggcugccg

SEQ ID NO: 28324 - RNA, 1686 nt, Artificial Sequence; identical to SEQ ID NO: 28322
  derived and/or modified sequence opt3 from anti-influenza_Chain

SEQ ID NO: 28325 - RNA, 1686 nt, Artificial Sequence; identical to SEQ ID NO: 28323
  derived and/or modified sequence opt3 from anti-influenza_Chain

SEQ ID NO: 28326 - RNA, 1689 nt, Artificial Sequence
  derived and/or modified sequence opt3 from anti-influenza_Chain
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaaagcacaaugggaaauugugugauuuagacggagucaagccccugauucuaagagauugcucaguggccgguuggcuccugggcaacccuaugugugacgaauuuaucaauguuccagaauggaguuauauaguggagaaggcgaacccggucaaugaucuuugcuaccccggggacuucaacgauuaugaggaacugaaacauuugcucagcaggaucaaucacuuugagaagauucagaucauuccuaaauccucuuggucgucacaugaagcuagccugggagugaguuccgccuguccauaccagggcaagaccucuuucuuucggaacguaguuuggcugaucaaaaagaauagcacauaucccacuauaaagcgcuccuacaacaauaccaaccaagaggaccucuuagugcugugggguauucaccacccuaaugaugcagccgagcagacaaaacuuuaucagaacccaaccacuuacaucucagucgggacaaguaccuugaaccagcgacuggugccccguauugcuacgagaagcaaggugaauggacaaucuggcaggauggaguucuuuuggacuauccuaaaaccuaacgacgcaaucaauuucgaauccaacggcaauuuuauugccccagaauacgcuuauaagauagucaaaaagggggauucaaccaucaugaaaagcgagcucgaauacggaaacugcaauacaaagugucagacuccgaugggugccauuaacaguucuaugcccuuccauaauauccacccucugaccauaggcgagugcccaaaguauguuaaauccaaccggcuugugcuggcgacaggguugcgcaauagcccccagagagagaccaggggacucuuuggcgcaauugccgguuucaucgaagggggauggcagggcaugguagacggcugguacggguaucaucacucgaacgagcaaggaucugguuacgcugccgacaaggaauccacgcagaaagcaaucgauggcgugacuaauaaggucaacucaauuaucgacaaaaugaauacacaguuugaggcuguggggcgggaguucaacaaccuggaacgccgaauugagaauuuaaacaagaagauggaagauggauuccuggacguuuggaccuauaaugccgagcuccuugugcugauggaaaacgagagaacuuuggauuuucacgacaguaaugucaaaaaccuauacgauaaggugaggcugcaacuccgggacaaugcgaaagaacugggcaacgguuguuucgaguuuuaccauaagugcgauaaugaguguauggaaagcguacguaacgggacauaugacuacccucaguauuccgaggaagcccgccuuaaaagagaggagauaucuggcguuaagcuggaaagcaucggaauuuaccagaucuugucaaucuauaguaccguggcauccagccucgcucuggccauuauggucgcuggcuuaucucuguggaugugcucaaaugggagucuacagugcaggauaugu

SEQ ID NO: 28327 - RNA, 1689 nt, Artificial Sequence; identical to SEQ ID NO: 28326
  derived and/or modified sequence opt3 from anti-influenza_Chain

SEQ ID NO: 28328 - RNA, 1692 nt, Artificial Sequence
  derived and/or modified sequence opt3 from anti-influenza_Chain
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguuguguucauuaaacggagucaaaccccugauucuaagagauugcaguguggccgguuggcuccugggcaauccuaugugugacgaguuucuuaacguuccagaauggagcuauaucguggagaaggauuccccgauaaaugggcugugcuaccccggagacuucaacgauuaugaggaauugaagcaucuccugucuucgacaaaucacuuugagaaaauccagauuaucccuaggucaagcuggagugaccaugaugcguccucuggcgucagcuccgcuuguccauacaacggucggucaaguuucuuucgcaaugugguauggcugauuaagaaaaacaaugccuaucccacuaucaagcgaaacuacaauaacaccaaccaggaagaccucuuaguucugugggggauacaccacccuaaugaugcaacagagcaaaccaaacuuuaucagaacccaacuacauacgugagcgucggaaccucuacguugaaucagcguuccgugcccgagauugccacuagaccuaaggugaacggccagucaggcaggaucgaguucuuuuggaccauucugaagccaaaugacgcuaucaacuucgaaagcaaugggaacuuuaucgcaccggaauacgccuauaaaauugcuaagaaaggagauagugccauaaugaagucuggucuagaguacggcaauugcaacacaaaaugucaaacucccaugggggcgaucaauuccagcaugccuuuccauaacauucacccacucaccaucggagaaugcccccgguaugucaagucggaccgccugguucuugcaacaggccugagaaaugugccucagagggagacccgggguuuguuuggggccauagcuggauucauugagggcggcuggcaggggaugguagacggaugguacgguuaucaucacucuaacgaacagggcuccggguacgccgcagauaaagagucaacgcaaaaggcuaucgacggaaucacuaauaaggugaacaguauuaucgauaaaaugaacacacaguuugaagccgucggcaaggaguucaauaaccucgaacgccgaauugagaaucugaacaaaaagauggaggacgguuucuuagauguguggaccuauaaugcggaacugcucguucuuauggagaacgaaagaacucuggacuuucacgauagcaaugugaaaaacuuguacgacaaggucaggcuacagcugcgggauaaugccaaggagcucgggaacggcuguuucgaauuuuaccauaaaugcgacgaugaguguauggaguccgugcguaauggaacauaugacuacccacaauauucugaagaggcacgccugaacagagaagagauaagcggcguaaaacuugagucaaucgggaccuaccagauucugaguaucuauuccacgguugcuagcucuuuggcccucgcuaucaugguggccggacugucauucuggaugugcaguaaugguagcuuacagugcaggauuuguaua

SEQ ID NO: 28329 - RNA, 1692 nt, Artificial Sequence; identical to SEQ ID NO: 28328
  derived and/or modified sequence opt3 from anti-influenza_Chain

SEQ ID NO: 28330 - RNA, 1695 nt, Artificial Sequence
  derived and/or modified sequence opt3 from anti-influenza_Chain
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggagaaaaagcacaaugggaaauugugugauuuagacggagucaagccccugauucuaagagauugcucaguggccgguuggcuccugggcaacccuaugugugacgaauuuaucaauguuccagaauggaguuauauaguggagaaggcgaacccggucaaugaucuuugcuaccccggggacuucaacgauuaugaggaacugaaacauuugcucagcaggaucaaucacuuugagaagauucagaucauuccuaaauccucuuggucgucacaugaagcuagccugggagugaguuccgccuguccauaccagggcaagucuagcuucuuucggaacguaguuuggcugaucaaaaagaacuccaccuaucccacaauaaagcgcucauacaauaauacuaaccaagaggaccucuuagugcugugggguauucaccacccuaaugaugcagccgagcagaccaaacuuuaucagaacccaacaaccuacaucagugucgggacuagcacauugaaccagcgacuggugccccguauugcuaccagaucuaaggugaauggacaauccggcaggauggaguucuuuuggacgauccuaaaaccuaacgacgcaaucaauuucgaaucaaacggcaauuuuauugccccagaauacgcuuauaagauagucaaaaagggggauagcacuaucaugaaaagugagcucgaauacggaaacugcaauaccaagugucagacaccgaugggugccauuaacucuuccaugcccuuccauaauauccacccucugacuauaggcgagugcccaaaguauguuaaaagcaaccggcuugugcuggcgaccggguugcgcaauucgccccagagagagaggcggcgcaagaaacgaggacucuuuggcgcaauugccgguuucaucgaagggggauggcagggcaugguagacggcugguacggguaucaucacucuaacgagcaaggauccgguuacgcugccgacaaggaaucaacacagaaagcaaucgauggcgugaccaauaaggucaacaguauuaucgacaagaugaauacgcaguuugaggcuguggggagagaguucaacaaccuggaaaggcggauugagaauuuaaacaaaaagauggaagauggauuccuggacguuuggacuuauaaugccgagcuccuugugcugauggaaaacgagcguacauuggauuuucacgacagcaaugucaaaaaccuauacgauaaggugcgccugcaacucagagacaaugcgaaagaacugggcaacgguuguuucgaguuuuaccauaagugcgauaaugaguguauggaauccguaaggaacgggaccuaugacuacccucaguauucugaggaagcccggcuuaagcgagaggagauaagcggcguuaaacuggaaucaaucggaauuuaccagaucuugaguaucuauuccacuguggcaagcucucucgcucuggccauuauggucgcuggcuuaucacuguggaugugcaguaaugggagccuacagugccgc

SEQ ID NO: 28331 - RNA, 1695 nt, Artificial Sequence
  derived and/or modified sequence opt3 from anti-influenza_Chain
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagcuagccugggagugaguuccgccuguccauaccagggcaaaucuagcuucuuucggaacguaguuuggcugaucaagaaaaauuccacauaucccacuauaaagcgcucauacaacaauaccaaccaagaggaccucuuagugcugugggguauucaccacccuaaugaugcagccgagcagacaaaacuuuaucagaacccaaccacuuacaucagugucgggacaagcaccuugaaccagcgacuggugccccguauugcuacgagaucuaaagugaauggacaauccggcaggauggaguucuuuuggacuauccuaaagccuaacgacgcaaucaauuucgaaucaaacggcaauuuuauugccccagaauacgcuuauaaaauagucaagaaaggggauagcaccaucaugaagagugagcucgaauacggaaacugcaauacaaaaugucagacuccgaugggugccauuaacucuuccaugcccuuccauaauauccacccucugaccauaggcgagugcccaaaguauguuaagagcaaccggcuugugcuggcgacaggguugcgcaauucgccccagagagagaggcggcgcaaaaagcgaggacucuuuggcgcaauugccgguuucaucgaagggggauggcagggcaugguagacggcugguacggguaucaucacucuaacgagcaaggauccgguuacgcugccgacaaagaaucaacccagaaggcaaucgauggcgugacgaauaaagucaacaguauuaucgacaagaugaauacucaguuugaggcuguggggagagaguucaacaaccuggaaaggcggauugagaauuuaaacaagaaaauggaagauggauuccuggacguuuggacauauaaugccgagcuccuugugcugauggaaaacgagcguaccuuggauuuucacgacagcaaugucaagaaccuauacgauaaagugcgccugcaacucagagacaaugcgaaggaacugggcaacgguuguuucgaguuuuaccauaaaugcgauaaugaguguauggaauccguaaggaacgggacuuaugacuacccucaguauucugaggaagcccggcuuaagcgagaggagauaagcggcguuaagcuggaaucaaucggaauuuaccagaucuugaguaucuauuccacaguggcaagcucucucgcucuggccauuauggucgcuggcuuaucacuguggaugugcaguaaugggagccuacagugccgc

SEQ ID NO: 28332 - RNA, 1695 nt, Artificial Sequence
  derived and/or modified sequence opt3 from anti-influenza_Chain
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcaaaucuagcuuuuuccggaaugugguauggcugaucaagaaaaacuccucauaucccacaauaaagcgcaguuacaauaacacuaaucaagaggaccucuuaguucugugggguauucaccacccuaacgaugccgcugagcagacccgacuuuaucagaacccaacaaccuacaucagcguggggacuucuacauugaaucagcgucugguccccaagauugcaaccagauccaaagugaacggacaaucaggcaggauggaauuuuucuggacgauccuaaagccuaaugacgccaucaacuuugagagcaauggcaacuucauugcuccagaauacgccuauaaaauagugaagaaaggggauagugcgaucaugaagucugagcucgaauacggaaauugcaacacuaaaugucagaccccgaugggugcaauuaauuccagcaugcccuuucauaacauccacccucugacaauaggcgagugcccaaaguaugucaagucgaaucggcuuguucuggccacuggguugcgcaacucuccccagagagagaggcggcgcaaaaagcgaggacucuucggcgcuauugccgguuuuaucgaagggggauggcagggcaugguggacggcugguacggguaucaucacuccaaugagcaaggaucagguuacgcagcugacaaagaaaguacccagaaggccaucgauggcguaacaaacaaagugaauagcauuaucgacaagaugaacacccaguucgaggcggucgggagagaauuuaacaaucuggagaggcggauugagaacuuaaauaagaaaauggaagauggauuccuggacguguggacguauaacgccgagcuccuuguucugauggaaaaugagcguacuuuggauuuccacgacuccaacgugaagaaucuauacgauaaaguccgccugcaacucagagacaacgcaaaggaacugggcaaugguuguuuugaguucuaccauaaaugcgauaacgaguguauggaaucugugaggaaugggacauaugacuacccucaguauagcgaggaagcucggcuuaagcgagaggagauaucaggcguaaagcuggaaaguaucggaauuuaccagaucuuguccaucuauagcaccguugccucuucacucgcucuggccauuaugguggcaggcuuaagucuguggaugugcagcaacgggucccuacagugccgc

SEQ ID NO: 28333 - RNA, 1695 nt, Artificial Sequence
  derived and/or modified sequence opt3 from anti-influenza_Chain
augagcgacagaaggcagaaccggaagacccccgaugagcaacgcaaagcaaaugcucugaucauuaacgaaaauauagaggcauacaucgccauuugcaaggaagugggccucaacggggacgagaugcuuauccuggaaaauggaauugcgaucgagaaagcuauacgaaucuguugcgaugguaaguaucaggagaaacgugaaaagaaggccagagaggcacagagggccgacuccaacuucaaugcugauucuauuggcauccgguuggucaaacgcgcagggucaggaacaaacauuacuuaccacgccguuguggaauuaacgaguagaagcaggaucguacagauacugaagucccauuggggcaaugagcuaaaccgggcuaaaauugccgguaagcgccucggguuuucugcgcuguucgcaucgaaucuugaggccaucauuuaucaacgaggaagaaacgcugccaggcggaauggcucagcagaacuguuuaccuugacacagggcgcugggaucgagacucguuacaaauggaucauggaaaagcacauuggaauaggugugcucaucgccgacgcgaagggccugauuaacgggaaacgcgagggaaagagaggcgucgaugccaaugugaaacugagggcagguaccacagggagcccucucgaacgggcuaugcagggaaucgagaagaaagccuucccaggcccguuacgagcucuggcccgcagaguugugaaggcaaacuauaacgacgccagggaggcucuuaaugucauagcggaagcaaguuugcugcuaaaaccccagauuaccaacaagaugacuaugccuugguguauguggcucgccgcucggcugacacuuaaggaugaguuugccaauuucugcgcauacgccggccgcagagcuuuugaaguguucaacaucgccauggagaaaaucgggauuuguuccuuucaaggaaccaucaugaaugacgaugaaauugagucuauagaggacaaggcacagguacugaugauggcgugcuucgguuuggcuuaugaagauuuuagccucguuuccgccauggugucacauccacugaaauuaaggaaccguaugaagaucggcaauuuccgggucggggagaaagugaguacggugcugagcccccuccuucgauuuacuagaugggcagaguucgcccagagguucgcucugcaggccaacaccucucgcgagggagcacaaauuuccaauucagcugucuuugccguugaacggaagaucacaacugacgugcagagaguagaggaguugcuaaacaaggugcaggcgcacgaagacgagccucugcaaacccucuacaaaaaggucagggaacagaucagcauuauaggccgcaauaaaagugagaucaaggaguuccuggguucuuccauguacgaucuuaacgaccaggaaaaacagaauccaauuaacuuucgaagcggggcccaucccuucuuuuucgaguuugauccugacuauaauccaauccgggugaagcguccgaagaaacccauugcuaagagaaacucgaacaucucuaggcuggaagaggaaggcauggaugaaaauuccgagauaggacaagccaaaaagaugaaaccuuuggaccagcucacaucaaccaguagcaacaucccaggcaagaau

SEQ ID NO: 28334 - RNA, 1695 nt, Artificial Sequence
  derived and/or modified sequence opt3 from anti-influenza_Chain
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuaccauuggacccuucuggagccaggugacacaauuaucuuugaagccaauggcaacuugauugcuccgagguaugccuucacucucucucggggguuuggauccggcaucauaaauagcaacgcgcccauggauaagugugacgcaaaaugccagaccccucaaggugccauuaauucgucucugccauuccagaacguucaccccgugacaaucggggaguguccuaaguacguacgcuccgcuaaauuaagaauggugaccggacugaggaauauuccaucaauccagagucggggccucuuuggcgccaucgcaggguucauugaaggagguuggacgggcauggucgaugggugguauggauaccaccaucagaacgagcaaggcagcgguuaugcugccgaccagaaguccacucagaaugcgauaaacgggaucacaaauaaagugaacucuguuauugaaaagaugaauacccaguuuacugccgugggcaaggaguucaacaaacuugagcgccgaauggaaaaccugaauaagaaagucgaugacggauucaucgauauauggacauacaacgcagaguugcuagugcugcucgaaaaugagagaacccuggacuuucacgacagcaacguaaagaaucuuuacgaaaaaguuaagucacaacugaagaacaaugcuaaagagauuggcaacgggugcuucgaguuuuaucauaaguguaaugaugaaugcauggagagugugaaaaacggaacguacgacuaucccaaguacuccgaagagagcaaauugaauagggagaagaucgauggugucaagcucgaaucuaugggcguguaucagauccuggccauuuacucaaccgucgcuaguagcuuagugcugcuaguuucccucggggccaucucuuucuggaugugcucgaacggaagccugcagugucggauuugcaua

SEQ ID NO: 28335 - RNA, 1695 nt, Artificial Sequence
  derived and/or modified sequence opt3 from anti-influenza_Chain
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaaacgcuguaccauacugagaaugccuacgucuccguggugucaagccacuauagucgcaaguucacccccgaaauagcuaagcgaccuaaaguccgugaucaggagggaagaaucaacuacuauuggacacuucuggagccaggugacacuauuaucuuugaagcaaauggcaacuugauugccccgagguacgcuuucgcccucucucggggguuuggauccggcaucauaaauagcaacgcgcccauggauaagugugacgcaaaaugccagaccccucaaggugccauuaauucgucucugccauuccagaacguucaucccgugacaaucggggaguguccuaaguauguacgcuccgcuaaauuaagaauggugaccggacugaggaauauuccaucaauccagagucggggccucuuuggcgccaucgcaggguucauugaaggagguuggacgggcauggucgaugggugguacggauaucaccaccagaacgagcaaggcagcgguuacgcugccgaccagaaguccacucagaaugcgauaaacgggaucacaaauaaagugaacucuguuauugaaaagaugaauacccaguuuacugccgugggcaaggaguucaacaaacuugagcgccgaauggaaaaccugaauaagaaagucgaugacggauucaucgauauauggacauacaacgcagaguugcuagugcugcucgaaaaugagagaacccuggacuuucaugacagcaacguaaagaaucuuuaugaaaaaguuaagucacaacugaagaacaaugcuaaagagauuggcaacgggugcuucgaguuuuaccacaaguguaaugaugaaugcauggagagugugaaaaacggaacguaugacuaccccaaguauuccgaagagagcaaauugaauagggagaagaucgauggugucaagcucgaaucuaugggcguguaccagauccuggccauuuauucaaccgucgcuaguagcuuagugcugcuaguuucccucggggccaucucuuucuggaugugcucgaacggaagccugcagugucggauuugcaua

SEQ ID NO: 28336 - RNA, 1695 nt, Artificial Sequence
  derived and/or modified sequence opt3 from anti-influenza_Chain
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaagugcuaguucucuggggcgugcaccacccuccagacaucggggaucagaaaacgcuguaccauacugagaacgccuacgucuccguggugucaagccacuauagucgcaaguucacccccgaaauagcuaagcgaccuaaaguccgugaccaggagggaagaaucaauuacuauuggacacuucuggagccaggugauacuauuaucuuugaagcaaacggcaauuugauugccccgagguacgcuuucgcccucucucggggguuuggauccggcaucauaaacagcaaugcgcccauggacaagugugaugcaaaaugccagaccccucaaggugccauuaacucgucucugccauuccagaauguucaucccgugacaaucggggaguguccuaaguauguacgcuccgcuaaauuaagaauggugaccggacugaggaacauuccaucaauccagagucggggccucuuuggcgccaucgcaggguucauugaaggagguuggacgggcauggucgacgggugguacggauaucaccaccagaaugagcaaggcagcgguuacgcugccgaucagaaguccacucagaacgcgauaaaugggaucacaaacaaaguaaauucuguuauugaaaagaugaacacccaguuuacugccgugggcaaggaguucaauaaacuugagcgccgaauggaaaaccugaacaagaaagucgacgauggauucaucgacauauggacauacaaugcagaguugcuagugcugcucgaaaacgagagaacccuggacuuucaugauagcaauguaaagaaccuuuaugaaaaaguuaagucacaacugaagaauaacgcuaaagagauuggcaaugggugcuucgaguuuuaccacaaguguaacgacgaaugcauggagagugugaaaaauggaacguaugauuaccccaaguauuccgaagagagcaaauugaacagggagaagaucgacggugucaagcucgaaucuaugggcguguaccagauccuggccauuuauucaaccgucgcuaguagcuuagugcugcuaguuucccucggggccaucucuuucuggaugugcucgaauggaagccugcagugucggauuugcaua

SEQ ID NO: 28337 - RNA, 1695 nt, Artificial Sequence
  derived and/or modified sequence opt3 from anti-influenza_Chain
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacgccaaaugccagacuccucaaggugcuauuaauucgucucugccauuccagaacguucaucccgugaccaucggggaguguccuaaguauguacgcuccgccaaauuaagaauggugacaggacugaggaauauuccaucaauccagagucggggccucuuuggcgcaaucgcuggguucauugaaggagguuggaccggcauggucgaugggugguacggauaucaccaccagaacgagcaaggcagcgguuacgccgcggaccagaaguccacgcagaaugccauaaacgggaucacuaauaaagugaacucuguuauugaaaagaugaauacacaguuuaccgcagugggcaaggaguucaacaaacuugagcgccgaauggaaaaccugaauaagaaagucgaugacggauucaucgauauauggacuuacaacgcugaguugcuagugcugcucgaaaaugagagaacacuggacuuucaugacagcaacguaaagaaucuuuaugaaaaaguuaagucacaacugaagaacaaugccaaagagauuggcaacgggugcuucgaguuuuaccacaaguguaaugaugaaugcauggagagugugaaaaacggaaccuaugacuaccccaaguauuccgaagagagcaaauugaauagggagaagaucgauggugucaagcucgaaucuaugggcguguaccagauccuggcuauuuauucaacggucgccaguagcuuagugcugcuaguuucccucggggcaaucucuuucuggaugugcucgaacggaagccugcagugucggauuugcaua

SEQ ID NO: 28338 - RNA, 1695 nt, Artificial Sequence
  derived and/or modified sequence opt3 from anti-influenza_Chain
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggagaguuccuggccaaaucauacagugaccggugucucugcaagcugcucccacaacgggaagucaaguuuuuaccggaauuuacuguggcuuacgggcaaaaacggauuguaucccaaucugagcaagucuuacgugaacaauaaagaaaaggaggugcuaguucucuggggcgugcaucacccuccaaacaucgggaaccagcgcgcccuguaccacacugaaaaugcuuaugucuccguggugucaagccauuacagucgacguuucacccccgagauagcaaaaagaccuaaggucagggaucaggaaggacggaucaacuauuacuggacacuucuggagccaggugacacuauuaucuuugaggccaauggcaacuugauugcuccgugguaugccuucgcgcucucucgcggguuuggauccggcaucauaaccagcaaugcacccauggaugaaugugacgccaagugccagacaccucaaggugcuauuaacucgucucugccauuccagaauguucaccccgugaccaucggggaguguccuaaauacguaagauccgccaaguuaaggauggugacgggacugcggaacauuccaucaauccagagucgcggccucuuuggcgcaaucgcuggguucauugaaggagguuggacuggcauggucgaugggugguauggauaccaucaccagaaugagcaaggcagcgguuacgccgcggaccagaaauccacacagaacgccauaaaugggaucaccaacaagguaaauucuguuauugaaaagaugaacacucaguuuacagcagugggcaaagaguucaauaaacuugagcgaagaauggaaaaccugaacaagaaggucgaugacggauucuuggauaucuggaccuauaaugcugagcuacuggugcuccuggaaaacgagaggacgcuugacuuucacgacagcaauguuaaaaaccuguacgaaaagguaaaaucacaauugaagaauaacgccaaagagauaggcaaugggugcuucgaguuuuaucauaaguguaacaaugaaugcauggagagugugaagaacggaaccuacgauuaucccaaauacuccgaagagagcaagcucaaucgggagaaaauugacggugucaagcuggaaucuaugggcguguaucagaucuuagcuaucuacucaacagucgccaguagccuggugcuacucguuucccugggggcaauuucuuucuggaugugcucgaacggaagccuucagugucguaucugcauu

SEQ ID NO: 28339 - RNA, 1695 nt, Artificial Sequence
  derived and/or modified sequence opt3 from anti-influenza_Chain
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggagaguuccuggccaaaucacacuacaaccggugucucugccagcugcucccauaacggggaaucaaguuuuuauaagaauuuacuguggcuuacgggaaagaacggcuuguaccccaaucugagcaagucuuaugcaaacaauaaagagaaggaagugcuaguacucuggggcguucaccacccuccaaacaucggggaucagcgcgcccuguaccauaaagagaacgcuuacguguccgucgugucaagccacuauagucgaaaguucacucccgaaauagcaaagcguccuaaagugagagaccaggagggaaggaucaauuacuauuggacccuucuggagccaggugauacaauuaucuuugaagccaacggcaauuugauugcuccgcgguacgccuucgcgcucucucgcggguuuggauccggcaucauaaacagcaaugcacccauggacgagugugaugccaagugccagacuccucaaggugcuauuaacucgucucugccauuccagaauguccaucccguuaccaucggggaauguccuaaauaugugagauccgccaaguuaaggaugguaacaggacugcggaacauuccaucaauccagagucgcggccucuuuggcgcaaucgcuggguucauugagggagguuggaccggcaugguggacgggugguacggauaucaccaccagaaugaacaaggcagcgguuacgccgcggaucagaaauccacgcagaacgccauaaaugggaucacuaacaaggucaauucugugauugagaaaaugaacacacaguuuaccgcaguuggcaaggaguucaauaaacuugaacgaagaauggagaaccugaacaaaaagguggacgauggauucaucgacauauggacuuacaaugcugaauugcuaguccugcucgagaacgaaaggacacuggacuuucaugauagcaaugugaaaaaccuuuaugagaagguaaaaucacaacugaagaauaacgccaaggagauuggcaaugggugcuucgaauuuuaccacaaauguaacgacgagugcauggaaaguguuaagaauggaaccuaugauuaccccaaauauuccgaggagagcaaguugaaccgggagaaaaucgacggugugaagcucgaaucuaugggcgucuaccagauccuggcuauuuauucaacgguggccaguagcuuaguccugcuagugucccucggggcaaucucuuucuggaugugcucgaauggaagccugcagugucguauuugcaua

SEQ ID NO: 28340 - RNA, 1677 nt, Artificial Sequence
  derived and/or modified sequence opt3 from anti-influenza_Chain
gacaagaucugcauuggcuaccagagcaccaacuccacagagacuguggauacgcugaccaaaacaaauguccccguuacucaagccaaggaacuccuucacaccgagcauaacgggaugcugugugcuacaaauuugggacacccuuuaauacuggauaccugcacuaucgaaggucuaauuuauggcaacccaucuugugaccuccugcuugggggaagagaguggucauacaucguggaaaggccgagugcaguaaauggcaugugcuaucccgguaacguggagaaucuggaggaauugcggcuccuguucagcuccgccucuucguaccagcgcguccagauuuuuccugacacaaucuggaacgugaccuauucagggacgagcagugcguguuccaauucuuucuaccgaagcaugcguuggcugacucagaaagauaacaccuauccaguucaagacgcucaguacacaaauaacagaggaaaguccauacucuuuauguggggcaucaaucaucccccuacugauaccgugcagacaaacuuauacaccaggacggacacuacaaccucagucacuacagaggauauuaaucgggccuucaaaccagugaucggcccccgcccucugguaaacgggcuucagggaagaauugacuauuacuggaguguuuugaagccaggucaaacccugagggugcggagcaacggcaaucuaaucgcaccgugguaugggcacauacucucuggagaaucccauggccgcauucugaagucagaucuuaacagcgguaauugcgucgugcagugucagacggagcgagggggacugaacaccacauugcccuuucacaaugugaguaaauacgccuucggcaacugcccuaaguaugucggcguuaaaucucucaagcuggcuguggggaugagaaauguaccagcaagguccagccggggauuauuuggugccaucgcuggcuucauugaagggggauggcccggccugguggccgguugguacggguuucagcacucgaacgaccaaggcgucggaauggcggcagaucgugacucuacucagaaagccaucgacaagaucaccuccaaggugaauaacauuguugauaaaaugaauaagcaguaugagauaaucgaccaugaguucucagaaauugagacacgccucaacaugaucaauaacaaaauagaugaccaaauucaggauaucugggcuuacaaugccgaacuucugguguugcuagagaaccagaagacucuggacgagcacgaugcaaacgucaauaaccucuacaauaaagugaagagagcucugggcaguaacgccauggaagacgggaaaggauguuuugagcuuuaucauaagugcgaugacagguguauggaaaccauccggaaugguacauacaaccgaggcaaguauaaagaggaaagccgccuggagagacagaagauugaggggguaaaauuggaauccgagggaaccuacaagucuggcaggcucguuccucgggguagcccagggucaggcuauauccccgaagcgccgcgcgauggacaagccuacgugagaaaagacggcgaguggguccuguuaaguacuuuccuggggaagccuauucccaauccacuacucggacuggacuccacgggu

SEQ ID NO: 28341 - RNA, 1677 nt, Artificial Sequence; identical to SEQ ID NO: 28340
  derived and/or modified sequence opt3 from anti-influenza_Chain

SEQ ID NO: 28342 - RNA, 1695 nt, Artificial Sequence; identical to SEQ ID NO: 28333
  derived and/or modified sequence opt3 from anti-influenza_Chain

SEQ ID NO: 28343 - RNA, 1695 nt, Artificial Sequence; identical to SEQ ID NO: 28330
  derived and/or modified sequence opt3 from anti-influenza_Chain

SEQ ID NO: 28344 - RNA, 1695 nt, Artificial Sequence; identical to SEQ ID NO: 28331
  derived and/or modified sequence opt3 from anti-influenza_Chain

SEQ ID NO: 28345 - RNA, 1695 nt, Artificial Sequence; identical to SEQ ID NO: 28332
  derived and/or modified sequence opt3 from anti-influenza_Chain

SEQ ID NO: 28346 - RNA, 1695 nt, Artificial Sequence; identical to SEQ ID NO: 28334
  derived and/or modified sequence opt3 from anti-influenza_Chain

SEQ ID NO: 28347 - RNA, 1695 nt, Artificial Sequence; identical to SEQ ID NO: 28335
  derived and/or modified sequence opt3 from anti-influenza_Chain

SEQ ID NO: 28348 - RNA, 1695 nt, Artificial Sequence; identical to SEQ ID NO: 28336
  derived and/or modified sequence opt3 from anti-influenza_Chain

SEQ ID NO: 28349 - RNA, 1695 nt, Artificial Sequence; identical to SEQ ID NO: 28337
  derived and/or modified sequence opt3 from anti-influenza_Chain

SEQ ID NO: 28350 - RNA, 1695 nt, Artificial Sequence; identical to SEQ ID NO: 28338
  derived and/or modified sequence opt3 from anti-influenza_Chain

SEQ ID NO: 28351 - RNA, 1695 nt, Artificial Sequence; identical to SEQ ID NO: 28339
  derived and/or modified sequence opt3 from anti-influenza_Chain

SEQ ID NO: 28352 - RNA, 1698 nt, Artificial Sequence
  derived and/or modified sequence opt3 from anti-influenza_Chain
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaagcaucggaaguaggccccggauacgcgauguuccuucuagaauuuccaucuacuggaccauugugaaaccaggugacauccugcuaaucaacagcacgggcaaucucauugccccgaggggguacuuuaagauacggucgggaaagucuuccaucaugcgcucagacgcgcccauuggcaaauguaacagugagugcaucacuccuaaugguagcauaccaaacgauaagcccuuccagaaugucaaccgaauuacauauggggcauguccuagauacgugaaacagaauacccugaaacuugccacuggaaugaggaacgugccagaaaaacaaacacggggcaucuuuggcgcuaucgccggguucauugagaauggaugggaagguauggucgacggcugguauggguuucgucaccagaacuccgagggaaccggccaggcagcugaucugaagucuacgcaagccgcgaucaaucagauuaacgguaaauugaaucgccucauagggaagaccaacgagaaguuccaccagaucgaaaaagaguucagcgaaguugagggcaggauucaggaccuggaaaaguacguggaggauacaaaaaucgacuuauggucauauaacgccgagcugcucguagcacuugaaaaucaacauacuaucgaucugaccgacagugagaugaacaaguuguuugaaagaacaaagaagcagcuacgggagaaugcugaagauaugggaaacggcugcuucaagauuuaccacaaaugugacaaugccugcauaggguccauccgaaacggaacuuaugaucaugacguguaccgcgacgaggcucugaauaacagauuucagauuaagggugucgagcucaaaagcggcuacaaggauuggauccuguggauuucuuucgccaucucaugcuuucuucuguguguggcauugcucggguucauaaugugggccugccagaaaggaaauaucagguguaacauuugcauc

SEQ ID NO: 28353 - RNA, 1698 nt, Artificial Sequence
  derived and/or modified sequence opt3 from anti-influenza_Chain
augaagaccaucauugcccugagcuacauacucugccuuguguccgcucagaaauuccccggcaacgacaauucuacagcaacucuguguuuggggcaccaugccgucccuaacggaacgaucguuaagaccauuacaaaugaucaaaucgaggugacuaacgcgaccgaauuaguacagucaaguagcacaggugagauuugcgacuccccacaccagauccuggauggcgaaaauuguacccuaauagacgcucuccugggggauccgcagugcgacggauuucaaaacaaaaagugggaucuuuucguggagagaucuaaagccuauucgaauuguuaccccuaugacgucccugauuacgcaucacugaggagcuugguggccaguuccggcacucucgaauuuaacaaugagucuuucaacuggacagguguuacccagaaugggacgagcuccgcuugcauccggcgcucaaacaauagcuuuuucagccgacugaacuggcugacucaucucaaguuuaaguauccagcauuaaaugugaccaugcccaacaacgaggaguucgacaaacuguacauuuggggaguccaccauccuggcacagauaaugaccagaucuuucuuuaugcccaggcuucuggccguauuacuguguccaccaagagaucacaacagacaguaaucccaaacauaaggagccggccccgcguuagaaauauuccuaguaggaucucuauuuacuggaccaucgugaaaccaggggauaucuugcugauuaacuccacgggaaaucuaauagccccgcgggguuacuucaagauccgcagcggcaaaucgucuauuaugcgauccgacgcgcccaucgggaaguguaacucagaaugcauaacuccuaauggaaguauuccaaacgacaagcccuuucagaaugucaacagaaucacauauggcgcauguccuagguacgugaaacagaauacccucaagcuggccacugguaugcggaacgugccagaaaaacaaacacgugggaucuucggagcuauugccggcuuuaucgagaauggcugggaggggauggucgauggaugguaugguuuccgccaccagaacagcgaaggcauugggcaggcagcugaccuuaaguccacccaagccgcgauagaucagaucaauggaaaacugaacagauugauuggcaagacgaacgagaaauuccaccagaucgaaaaggaguuuucugaaguugaggguaggauccaggaccucgagaaguacguggaagauaccaaaauugaccuguggagcuauaaugccgaguuacugguagcacucgaaaaccaacauacaauagaucuuacugacucagagaugaauaagcuguucgagaaaaccaagaaacaguugcgggaaaacgcugaggauauggggaauggcugcuuuaagaucuaccacaagugugacaacgccugcauuggaaguauccgaaauggcacauaugaucaugacguguaccgcgacgaagcucuaaacaauagauuccagauuaaaggggucgagcugaaguccggauacaaagauuggauccucuggauaaguuuugccaucucuugcuuccugcuuuguguggcacuguuggguuuuauuaugugggccugccagaagggcaacaucagguguaauauuugcauc

SEQ ID NO: 28354 - RNA, 1698 nt, Artificial Sequence
  derived and/or modified sequence opt3 from anti-influenza_Chain
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaagaacgaguccuucaauuggacagguguuacccagaacgggacgucuagcgcuugcauccggcgcuccaauaacucauuuuucagucgacugaauuggcucacucauuuaaaguuuaaauauccagcacugaacgugaccaugcccaauaaggagaaauucgacaaacuuuacauuuggggaguccaccauccuggcacagauaacgaccagaucuuuuuguaugcccaggcuagcggccguauuacugugucuaccaagagaucccaacagacaguaaucccaaacauagggucaaggcugcggguucgcgauauucccagcagaaucaguauuuacuggaccaucgugaagccuggagacauccuacucauuaauucuacggguaaccugauagccccaaggggcuacuucaagauccgguccgggaaaagcucgauuaugcgcucugacgcgccgaucggaaaguguaauuccgaaugcauaacucccaacggcucaauuccuaaugauaaaccauuucagaacgucaaucgaaucacauauggugcaugucccagauacgugaagcagaacacccuuaaacuggccacugggaugaggaaugugccugagaagcaaacacggggaaucuucggcgcuauugccggcuuuaucgaaaacgggugggagggaauggucgacgguugguauggcuuccgucaccagaauagugaggggaccggacaggcagcugauuugaaaagcacgcaagccgcgauugaccagauaaacggcaagcucaaucgccugaucgguaagaccaacgaaaaauuccaccagauugagaaggaauuuuccgagguugaagggagaauccaggauuuagagaaauacguggaggacacaaagaucgaucuguggucuuauaaugccgaacuccuuguagcacuggagaaccaacauacuauugacuugaccgauagcgaaaugaacaaacuauucgagaagacaaagaaacagcugagggaaaaugcugaggacaugggcaacggaugcuuuaagauauaccacaaaugugauaaugccugcaucggcucaauucggaacgggacuuaugaccaugacguguaccgagaugaggcucucaauaaccgcuuccagaucaagggagucgaacugaaaagugguuacaaggacuggauucuuuggaucuccuuugccauaagcugcuuccuguuguguguggcacuccugggcuuuaucaugugggccugccagaaggggaauauuagauguaacaucugcauu

SEQ ID NO: 28355 - RNA, 1698 nt, Artificial Sequence
  derived and/or modified sequence opt3 from anti-influenza_Chain
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaaguguuaccccuaugacgucccugauuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaaguuuaaauauccagcacugaacgugaccaugcccaauaacgagaaguucgacaaacuuuacauuuggggaguccaccauccuggcacagauaacgaccagaucuuuuuguaugcccaggcuagcggccguauuacugugucuaccaagagaucccaacagacaguaaucccaaauauagggucaaggccccggguucgcgauauuccuagcagaaucaguauuuacuggaccaucgugaaaccaggagacauccugcuaauuaacucuacggguaaucucauagccccgaggggcuacuucaagauccgguccggaaagagcucgauuaugcgcucugacgcgcccaucgggaaauguaacuccgaaugcauaacuccuaauggcucaauuccaaacgauaagcccuuucagaaugucaaccgaaucacauauggugcauguccuagauacgugaaacagaauacccugaagcuggccacugggaugaggaacgugccagagaaacaaacacggggaaucuucggcgcuauugccggcuuuaucgaaaaugggugggagggaauggucgacgguugguauggcuuccgucaccagaacagugaggggauuggacaggcagcugaucuuaagagcacccaagccgcgauagaccagaucaauggcaaauugaaccgccucauugguaagacgaaugaaaaguuccaccagaucgagaaagaauuuuccgagguugaagggagaauccaggaucuggagaaguacguggaggacaccaaaauugauuuauggucuuauaacgccgaacugcucguagcacuugagaaccaacauacaauagaccugacugauagcgaaaugaauaaguuguucgagaaaaccaagaagcagcuaagggaaaacgcugaggacaugggcaauggaugcuuuaaaaucuaccacaagugugauaacgccugcauuggcucaauccggaaugggacauaugaccaugacguguaccgagaugaggcucugaacaaucgcuuccagauuaaaggagucgaacucaagagugguuacaaagacuggauccuguggauauccuuugccaucagcugcuuccuucuguguguggcauugcucggcuuuauuaugugggccugccagaaggggaacaucagauguaauauuugcauc

SEQ ID NO: 28356 - RNA, 1698 nt, Artificial Sequence
  derived and/or modified sequence opt3 from anti-influenza_Chain
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuuuccgagguugaagggagaauccaggaccuggagaaauacguggaggauaccaagauugacuuauggucuuauaaugccgaacugcucguagcacuugagaaccaacauacaauagaucugacugacagcgaaaugaauaaauuguucgagaagaccaaaaagcagcuaagggaaaacgcugaggauaugggcaauggaugcuuuaagaucuaccacaaaugugacaacgccugcauuggcucaauccggaaugggacauaugaucaugacguguaccgagacgaggcucugaacaaucgcuuccagauuaagggagucgaacucaaaagugguuacaaggauuggauccuguggauauccuuugccaucagcugcuuccuucuguguguggcauugcucggcuuuauuaugugggccugccagaaagggaacaucagauguaauauuugcauc

SEQ ID NO: 28357 - RNA, 1698 nt, Artificial Sequence
  derived and/or modified sequence opt3 from anti-influenza_Chain
augaagaccaucauugcccugagcuacauacucugccuuguguucucccagaaacugcccggcaacgacaauucuacagcuacuuuguguuuagggcaccaugcagucccuaacggaacgaucguuaagaccauuacaaaugaucaaaucgaggugacuaacgccaccgaacugguacagucaaguagcacagguggcauuugcgacuccccacaccagauccuagauggggagaauuguacccucauagacgcgcugcuuggagauccgcagugcgacggcuuucaaaacaaaaagugggaucuguucguggaaagaucuaaggcuuauucgaauuguuaccccuaugacgucccugauuacgccucauugaggagccucguggcaaguuccgguacucuggaguuuaacaaugaaucuuucaacugggccgggguuacacagaauggaaccagcuccgcuugcaagcggcgcucaaacaagagcuuuuucagucgacugaauuggcucacgcauuuaaaauauaaguacccagcacugaacgugacuaugcccaauaacgagaaauuugacaaacuuuauaucuggggcguccaccauccugugaccgauucugaccagauuuccuuguacgcccaggcuucaggccguaucacaguaagcacuaaaagaagucaacagaccguuauuccaaacaucggguacaggccccgggugcgcgauauaucuuccagaauuagcaucuauuggacaauugucaagccuggagacauccugcuaaucaauucgaccgguaaccucauugccccaaggggcuacuucaagauacggucugggaaauccucaaucaugcgcagugacgcgccgauuggaaaguguaauagcgagugcaucacgcccaacggcuccauaccuaaugauaaaccauuucagaacgugaaucgaauuacuuauggugcaugucccagauacgugaagcagaacacacugaaacuugccaccgggaugaggaaugucccugaaaagcaaacucggggaaucuucggcgcuaucgccggcuuuauugagaacgggugggaaggaaugguugacgguugguauggcuuccgucaccaaaauucugaggggacaggacaggcagcugaucugaaaagcacccaggccgcgaucaaccagauuaauggcaaguugaaccgccucauagguaagacgaaugagaaauuucaccagaucgaaaaggaguucucagaaguggaggggaggauucaggaccuggaaaaauacguagaggauaccaagaucgacuuauggaguuauaacgccgagcugcucguggcacuugaaaaccaacauacaaucgaucugacugacuccgagaugaauaaauuguucgaaagaaccaagaagcagcuacgggagaacgcugaagauaugggcaauggaugcuuuaaaauuuaccacaagugugacaacgccugcauagagagcauccgaaauggcacauacgaucaugacgucuaucgcgacgaggcucugaacaauagauuccagauuaaagggguggaacucaagucuggauacaaagauuggauccuguggauuucauuugccaucaguugcuuccuucuguguguugcauugcucgguuuuauaaugugggccugccagaagggcaacaucagguguaauauuugcauc

SEQ ID NO: 28358 - RNA, 1698 nt, Artificial Sequence
  derived and/or modified sequence opt3 from anti-influenza_Chain
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacgacgaauccuucaauuggacagggguuacccagaacggaacgucuagcuccugcaagcggcgcucaaauaacagcuuuuucagccgacugaauuggcucacucauuuaaaguuuaaauauccagcucugaacgugaccaugcccaauaacgagaaguucgauaaacuuuacaucuggggcguccaccauccugugacagacaacgaucagauuuuucuuuaugcacaggccucuggccguaucacuguauccaccaagagaucacaacagacaguuauuccaaauaucgggagcaggccccggauacgcaacauuccuaguagaaucucuauuuacuggaccaucgugaaaccaggagacauccugcuaauuaauuccacggguaaccucauagcuccgaggggcuacuucaagauccggagcgggaagucgucuauuaugcgcuccgacgcccccaucggaaaauguaauucagagugcauaacuccuaacggcaguauuccaaaugauaagcccuuucagaacgucaaucgaaucacauauggugcguguccuagauacgugaaacagaacacccugaaguuggcaacugggaugaggaaugugccagaaaaacaaacacggggaaucuucggcgccauugcuggcuuuaucgagaacgggugggaaggaauggucgacgguugguauggcuuccgucaccagaauagcgaggggauuggacaggccgcagaucugaaguccacccaagcugccauaaaccagaucaauggcaaauugaaccgccucauugguaagacgaacgagaaguuccaccagaucgaaaaagaguuuucugaaguugaggggagaauccaggaccuggaaaaguacguggaggauaccaaaauugacuuauggagcuauaaugcggagcugcucguagcccuugaaaaccaacauacaauagaucugacugacucagagaugaauaaguuguucgaaaggaccaaaaagcagcuacgggagaacgcagaagauaugggcaauggaugcuuuaagaucuaccacaaaugugacaacgcuugcauuggcaguauccgaaaugggacauaugaucaugacguguaccgcgacgaggcccugaacaauagauuccagauuaagggagucgagcucaaauccgguuacaaggauuggauccuguggauaaguuuugcuaucucuugcuuccuucuguguguggccuugcucggcuuuauuaugugggcaugccagaaagggaacaucagguguaauauuugcauc

SEQ ID NO: 28359 - RNA, 1698 nt, Artificial Sequence
  derived and/or modified sequence opt3 from anti-influenza_Chain
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucaucaauguuccagaauggaguuauauaguggagaaggcgaacccgacaaaugaucugugcuaccccgggagcuuuaacgacuaugaggaauugaagcaucuccuguccaggaucaaucacuucgagaaaauucagaucauuccuaagucuucguggucagaucaugaagcuagcaguggagucuccucugccuguccauaccugggcagccccuccuuuuuccggaacgugguauggcucaucaaaaagaacucaacuuauccuaccauuaaaaagaguuacaauaauacaaaccaggaggacuuacugguucuuugggguauacaccacccaaaugaugcagccgagcaaacccgcuuguaucagaaccccacuacauacaucagcauugggaccucuacgcugaaccagcggcuagugccuaagaucgcuacucguuccaaagucaauggacagucaggcagaauggaauuuuucugggcaauccucaagccaaacgacgccauuaauuuugagagcaacggcaauuucauagcuccggaauacgccuauaaaaucgugaagaaaggggauagugcgauuaugaagucugagcuggaauacggaaacugcaauaccaaaugucaaacacccaugggugcaaucaacuccagcaugccuuuucauaauauacacccacuuacuauuggcgagugccccaaguaugugaagucgaacaggcuggucuuggccaccgggcuccgaaauucuccucagcgcgaguccagaaggaaaaagcggggacuguucggcgcuaucgccgguuuuaucgaagggggauggcagggcaugguugacggcugguacggguaucaucacucaaacgagcagggaagugguuacgcagcugacaaagaaagcacacaaaaggccauuggcgugaccaauaaaguaaacuccaucauugauaagaugaauacgcaguucgaggcgguggggcgcgaauuuaacaacuuagagcgaagaauagagaaucugaacaagaaaauggaagacggauuccucgaugucuggacuuauaaugccgagcuucugguguugauggaaaacgagaggacacuagacuuccacgauucuaauguuaagaaccuguacgacaaagugcggcuccagcugcgugauaaugcaaaggaacuuggcaacgguuguuuugaguucuaccauaaaugcgacaaugaguguauggaaagcauccgcaacgggaccuauaauccacaauacucagaggaagcuagacugaagagggaggagauuaguggcgucaaguuggaauccaucggaacuuaucagauccucagcauuuacucuacaguggccucaagucuggcuuuagccauaaugaucgcaggccugagccuauggaugugcuccaacgggucucuccagugccggauuuguauc

SEQ ID NO: 28360 - RNA, 1698 nt, Artificial Sequence
  derived and/or modified sequence opt3 from anti-influenza_Chain
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguauc

SEQ ID NO: 28361 - RNA, 1698 nt, Artificial Sequence
  derived and/or modified sequence opt3 from anti-influenza_Chain
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaucccccuacgucagcugaucaacagagcuuguaccagaacgccgacgcguacguguucgucgggaguucucgcuauuccaagaaauuuaagccagagauugcaauccgacccaaagugcgugaucaggagggaagaaugaauuacuauuggacucugguggaaccuggugacaagauuaccuucgaggccacaggcaaccuagucguuccaagguacgcuuuugccauggaacggaacgcagggagcggaaucauaauuucggauacuccggugcacgacugcaauaccacaugucaaacccccaaaggcgcuaucaacacgucucucccuuuccagaauauucacccaaucacuaucgguaagugccccaaguauguaaaauccacaaagcugcgccuugccaccgggcugagaaacauuccuucaauacagaguaggggauuguuuggcgcgaucgccggcuucauugaagggggauggacugguaugguggacggcugguacggguaucaucaccagaaugaacaaggaagcggcuacgcagcugaucucaaauccacacagaacgccaucgacgagauaaccaauaaggucaacucugugauugagaaaaugaauacgcaguuuaccgcuguugguaaggaguucaaccaccuggaaaagcggaucgaaaauuuaaacaaaaagguggaugacggguuccuggauaucuggacauacaaugccgagcuccuuguccuguuggaaaacgagcgcacucuagacuaucaugauagcaaugugaaaaaccuguacgagaagguacgaucacagcucaaaaacaaugcaaaggaaauuggcaacggauguuuugaguucuaucacaagugcgacaauaccuguauggaaaguguuaaaaacggcacauacgauuauccaaaguacuccgaggaagccaaacugaauagagaggagaucgacggggugaaacuugaaagcacuaggauuuaucaaauacuggcuaucuacucuaccgucgcgucaaguuuggugcucgucgugagccugggagcaauuuccuuuuggaugugcucuaacgguucguuacagugccggaucuguauc

SEQ ID NO: 28362 - RNA, 1698 nt, Artificial Sequence; identical to SEQ ID NO: 28359
  derived and/or modified sequence opt3 from anti-influenza_Chain

SEQ ID NO: 28363 - RNA, 1698 nt, Artificial Sequence; identical to SEQ ID NO: 28352
  derived and/or modified sequence opt3 from anti-influenza_Chain

SEQ ID NO: 28364 - RNA, 1698 nt, Artificial Sequence; identical to SEQ ID NO: 28360
  derived and/or modified sequence opt3 from anti-influenza_Chain

SEQ ID NO: 28365 - RNA, 1698 nt, Artificial Sequence; identical to SEQ ID NO: 28361
  derived and/or modified sequence opt3 from anti-influenza_Chain

SEQ ID NO: 28366 - RNA, 1698 nt, Artificial Sequence; identical to SEQ ID NO: 28353
  derived and/or modified sequence opt3 from anti-influenza_Chain

SEQ ID NO: 28367 - RNA, 1698 nt, Artificial Sequence; identical to SEQ ID NO: 28354
  derived and/or modified sequence opt3 from anti-influenza_Chain

SEQ ID NO: 28368 - RNA, 1698 nt, Artificial Sequence; identical to SEQ ID NO: 28355
  derived and/or modified sequence opt3 from anti-influenza_Chain

SEQ ID NO: 28369 - RNA, 1698 nt, Artificial Sequence; identical to SEQ ID NO: 28356
  derived and/or modified sequence opt3 from anti-influenza_Chain

SEQ ID NO: 28370 - RNA, 1698 nt, Artificial Sequence; identical to SEQ ID NO: 28357
  derived and/or modified sequence opt3 from anti-influenza_Chain

SEQ ID NO: 28371 - RNA, 1698 nt, Artificial Sequence; identical to SEQ ID NO: 28358
  derived and/or modified sequence opt3 from anti-influenza_Chain

SEQ ID NO: 28372 - RNA, 1683 nt, Artificial Sequence
  derived and/or modified sequence opt3 from anti-influenza_Chain
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagcuagccugggagugaguuccgccuguccauaccagggcaaaucuagcuucuuucggaacguaguuuggcugaucaagaaaaauuccacauaucccacuauaaagcgcucauacaacaauaccaaccaagaggaccucuuagugcugugggguauucaccacccuaaugaugcagccgagcagacaaaacuuuaucagaacccaaccacuuacaucagugucgggacaagcaccuugaaccagcgacuggugccccguauugcuacgagaucuaaagugaauggacaauccggcaggauggaguucuuuuggacuauccuaaagccuaacgacgcaaucaauuucgaaucaaacggcaauuuuauugccccagaauacgcuuauaaaauagucaagaaaggggauagcaccaucaugaagagugagcucgaauacggaaacugcaauacaaaaugucagacuccgaugggugccauuaacucuuccaugcccuuccauaauauccacccucugaccauaggcgagugcccaaaguauguuaagagcaaccggcuugugcuggcgacaggguugcgcaauucgccccagagagagaggcggcgcaaaaagcgaggacucuuuggcgcaauugccgguuucaucgaagggggauggcagggcaugguagacggcugguacggguaucaucacucuaacgagcaaggauccgguuacgcugccgacaaagaaucaacccagaaggcaaucgauggcgugacgaauaaagucaacaguauuaucgacaagaugaauacucaguuugaggcuguggggagagaguucaacaaccuggaaaggcggauugagaauuuaaacaagaaaauggaagauggauuccuggacguuuggacauauaaugccgagcuccuugugcugauggaaaacgagcguaccuuggauuuucacgacagcaaugucaagaaccuauacgauaaagugcgccugcaacucagagacaaugcgaaggaacugggcaacgguuguuucgaguuuuaccauaaaugcgauaaugaguguauggaauccguaaggaacgggacuuaugacuacccucaguauucugaggaagcccggcuuaagcgagaggagauaagcggcguuaagcuggaaucaaucggaauuuaccagauccagcacaguggcgggcgcuccagcuuggagggaccaagauucgaacaaaaacucaucucugaggaagaucugaauaugcauacaggu

SEQ ID NO: 28373 - RNA, 1683 nt, Artificial Sequence
  derived and/or modified sequence opt3 from anti-influenza_Chain
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcaaaucuagcuuuuuccggaaugugguauggcugaucaagaaaaacuccucauaucccacaauaaagcgcaguuacaauaacacuaaucaagaggaccucuuaguucugugggguauucaccacccuaacgaugccgcugagcagacccgacuuuaucagaacccaacaaccuacaucagcguggggacuucuacauugaaucagcgucugguccccaagauugcaaccagauccaaagugaacggacaaucaggcaggauggaauuuuucuggacgauccuaaagccuaaugacgccaucaacuuugagagcaauggcaacuucauugcuccagaauacgccuauaaaauagugaagaaaggggauagugcgaucaugaagucugagcucgaauacggaaauugcaacacuaaaugucagaccccgaugggugcaauuaauuccagcaugcccuuucauaacauccacccucugacaauaggcgagugcccaaaguaugucaagucgaaucggcuuguucuggccacuggguugcgcaacucuccccagagagagaggcggcgcaaaaagcgaggacucuucggcgcuauugccgguuuuaucgaagggggauggcagggcaugguggacggcugguacggguaucaucacuccaaugagcaaggaucagguuacgcagcugacaaagaaaguacccagaaggccaucgauggcguaacaaacaaagugaauagcauuaucgacaagaugaacacccaguucgaggcggucgggagagaauuuaacaaucuggagaggcggauugagaacuuaaauaagaaaauggaagauggauuccuggacguguggacguauaacgccgagcuccuuguucugauggaaaaugagcguacuuuggauuuccacgacuccaacgugaagaaucuauacgauaaaguccgccugcaacucagagacaacgcaaaggaacugggcaaugguuguuuugaguucuaccauaaaugcgauaacgaguguauggaaucugugaggaaugggacauaugacuacccucaguauagcgaggaagcucggcuuaagcgagaggagauaucaggcguaaagcuggaaaguaucggaauuuaccagauccagcacuccggcgggcgcagcucuuuggagggaccaagauuugaacaaaaacucaucucagaggaagaucugaacaugcauaccggu

SEQ ID NO: 28374 - RNA, 1701 nt, Artificial Sequence
  derived and/or modified sequence opt3 from anti-influenza_Chain
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggagaaaacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuuccaagucuucguggucagaucaugaagccagcaguggagucuccucugcauguccuuaccagggcacacccagcuuuuuccggaaugugguauggcugaucaaaaagaacaauacuuauccaaccauaaaacgcuccuacaacaauacaaaccaagaggaccucuuaauucugugggguauccaccacucaaacaaugccgcugagcagaccaagcuauaucagaacccuacuacauacauuaguguugggaccagcacguugaaucugcgacuugugccaaagaucgcaacucguucuaaagucaacggacaguccggcagaauggauuucuucuggaccauccucaagcccaaugacgccauuaacuuugaaucaaauggcaacuucauagcuccugaguacgccuauaaaaucgugaagaaaggggauagcgcgauuaugaagagugaaguggaguacggaaauugcaacacaaaaugucaaacuccaaucggugcaauaaauucuuccaugccguuucauaacauucacccccugaccaucggcgaaugcccuaaguaugucaagagcaauaaacuuguucuggccacaggguugaggaacucgccacuccgggagcgcagaaggaagcggggacuguucggcgcuaucgccgguuuuauugaagggggauggcagggcaugguggacggcugguacggguaucaucacucuaaugaacagggauccgguuacgcagcugacaaagagucaacccagaaggccaucgauggcguaacgaacaaagugaacaguauuauagacaagaugaauacucaauucgaagcggucgggcgcgaguuuaacaauuuagaacgaagaaucgagaaccugaauaagaaaauggaggauggauuccucgacguguggacauauaacgccgaacuucugguuuugauggagaaugaaaggacccuagauuuccacgacagcaacgugaagaaucuguacgauaaaguccggcuccagcugcgugacaacgcaaaggagcuuggcaaugguuguuuugaauuuuaccauaaaugcgauaacgaguguauggaguccgugcgcaaugggacuuaugacuacccccaguauucugaagaggcuagacugaagagggaagagauuagcggcguaaaguuggagucaaucggaacauaccaaauccucaguauuuauuccaccguugccagcucucuggcuuuagccauaaugguggcaggccugucacuauggaugugcaguaacgggagccuccagugccggaucuguauu

SEQ ID NO: 28375 - RNA, 1701 nt, Artificial Sequence
  derived and/or modified sequence opt3 from anti-influenza_Chain
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcacacccagcuuuuuccggaaugugguauggcugaucaaaaagaacaauacuuauccuaccauaaaacgcagcuacaacaauacaaaccaagaggaccucuuaauucugugggguauccaccacuccaacgaugccgcugagcagaccaaacuuuaucagaauccaacuacauacauuucaguugggaccaguacguugaaccagcgacuggugcccaagaucgcaacucguagcaaagucaauggacaaucuggcagaauggacuuuuucuggaccauccuaaagccuaacgaugccauuaauuuugaauccaacggcaauuucauagcuccagaguacgccuauaaaaucgugaagaaaggggacucagcgauugugaagucugaagucgaguacggaaacugcaauacaaaaugucagacuccgaucggugcaauaaacaguucuaugcccuuucauaauauucacccucucaccaucggcgaaugcccaaaguauguuaaguccaacaaacuggugcuugccacagggcugaggaauagccccuugcgggagcgcagaaggaagcggggacucuucggcgcuaucgccgguuuuauugaagggggauggcagggcaugguagacggcugguacggguaucaucacucgaacgaacagggaucugguuacgcagcugauaaagaguccacccaaaaggccaucgacggcgugacgaauaaagucaacucaauuauagauaagaugaacacucaguucgaagcgguggggcgcgaguuuaauaaccuggaacgaagaaucgagaauuuaaacaagaaaauggaggacggauuccuggauguuuggacauauaaugccgaacuccuugugcugauggagaacgaaaggaccuuggacuuccacgauaguaaugucaagaaccuauacgacaaagugcggcugcagcuccgugauaaugcaaaggagcugggcaacgguuguuuugaguucuaccauaaaugcgacaaugaguguauggagagcguacgcaacgggacuuaugauuacccucaauauuccgaagaggcuagacuuaagagggaagagauuucuggcguuaagcuggagagcaucggaacauaccagaucuugucaauuuauaguaccguggccuccagccucgcucuggccauaauggucgcaggcuuaucucuguggaugugcucaaaugggagucuacagugccggaucuguauu

SEQ ID NO: 28376 - RNA, 1683 nt, Artificial Sequence
  derived and/or modified sequence opt3 from anti-influenza_Chain
gacaagaucugccugggccaccaugccgugagcaacgggaccaaagucaauacacucacugagagaggaguugaagugguaaacgcuacggagaccguggaaaggacaaaugucccccggauuuguuccaaggguaaacgcacuguggaucuuggccagugcgggcuguugggaaccauaacaggcccuccacaaugugaccaguucuuagaguuuucugcagaucugaucauugaacgacgugaggguucagacguuugcuacccggggaaguucgugaacgaggaagcccuaagacagauccucagggagaguggaggcauugauaaagaaaccaugggcuuuacuuauagcgggauccggacaaauggaaccacguccgcgugucgcagaucugguucgucauucuacgcugagaugaaguggcugcuuagcaacacugacaaugccgcauuuccccagaugaccaagaguuauaaaaacacaaggaaggauccugcccugauaaucuggggcauucaccauuccgggucuacuaccgagcaaacaaaauuguacggaagcggcaauaagcucaucaccgucgguuccucaaacuaucagcagaguuucgugccaagccccggggcucggccucagguaaauggacaaucuggccgcauugacuuucacuggcugauccugaacccaaaugauacgguuacuuucuccuuuaacggcgcauucauagcccccgaccgagcuucauuucucagagggaaaagcauggguauucagagugaagugcaggucgaugccaauugcgagggagacuguuaccauucuggcgggacaaucauuuccaacuuaccuuuccagaacaucaauagcagggcggugggaaagugcccacgguaugugaagcaagaaucgcugcuuuuggcaaccggcaugaaaaacgucccggagauccccaagcgucgcagaaggggucuguuuggggccauugcuggcuucauagaaaauggaugggagggccuaaucgaugggugguacggauuccggcaccagaacgcccagggugagggcacugcagcugacuacaaaucuacacaauccgccauugaccagaucaccgggaagcucaaucgacugauagagaaaacgaaccagcaguuugaacuuauugauaaugaguucaccgaaguugaacgccaaaucggaaacgugaucaauuggacaagagacucaaugacugagguauggaguuauaacgcggagcuguugguggccauggaaaaucagcacaccauugaucucgcagacagcgagaugaacaagcuguacgaaagggucaaacggcaguuacgcgagaaugcugaagaggauggcacagguuguuuugagaucuuccauaagugcgacgaugacuguauggccuccauuagaaacaauacuuaugaucacucuaaguacagggaagaggcuauacagaaccguauccaaauugacccugugaaacugagcucaggguauaaggauaguggccggcucguuccacgaggaucccccggcagcggguacaucccugaagccccaagagacggacaggcauaugugaggaaagacggugaguggguccuucugucuaccuuuuugggcaagcccaucccgaacccucuacuggggcucgauucaacagga

SEQ ID NO: 28377 - RNA, 1701 nt, Artificial Sequence
  derived and/or modified sequence opt3 from anti-influenza_Chain
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcacacccagcuuuuuccggaaugugguauggcugaucaaaaagaacaauacuuauccuaccauaaaacgcucuuacaacaauacaaaccaagaggaccucuuaauucugugggguauccaccacuccaacgaugccgcugagcagaccaaacuuuaucagaauccaacuacauacauuucaguugggaccaguacguugaaccagcgacuggugcccaagaucgcaacucguagcaaagucaauggacaaaacggcagaauggacuuuuucuggaccauccuaaagccuaaugaugccauuaacuuugaaucuaauggcaacuucauagcuccagaguacgccuauaaaaucgugaagaaaggggacuccgcgauugugaagucagaagucgaguacggaaauugcaacacaaaaugucagacuccgaucggugcaauaaauagcaguaugcccuuucauaacauucacccucucaccaucggcgaaugcccaaaguauguuaagucuaauaaacuggugcuugccacagggcugaggaacucccccuugcgggagcgcagaaggaagcggggacucuucggcgcuaucgccgguuuuauugaagggggauggcagggcaugguagacggcugguacggguaucaucacagcaaugaacagggaucggguuacgcagcugauaaagagucuacccaaaaggccaucgacggcgugacgaacaaagucaacuccauuauagauaagaugaauacucaguucgaagcgguggggcgcgaguuuaacaaucuggaacgaagaaucgagaacuuaaauaagaaaauggaggacggauuccuggauguuuggacauauaacgccgaacuccuugugcugauggagaaugaaaggaccuuggacuuccacgauucaaacgucaagaaucuauacgacaaagugcggcugcagcuccgugauaacgcaaaggagcugggcaaugguuguuuugaguucuaccauaaaugcgacaacgaguguauggagaguguacgcaaugggacuuaugauuacccucaauauagcgaagaggcuagacuuaagagggaagagauuuccggcguuaagcuggagucuaucggaacauaccagaucuugagcauuuauucaaccguggccaguucccucgcucuggccauaauggucgcaggcuuaagccuguggaugugcucuaacgggucacuacagugccggaucuguauu

SEQ ID NO: 28378 - RNA, 1683 nt, Artificial Sequence; identical to SEQ ID NO: 28376
  derived and/or modified sequence opt3 from anti-influenza_Chain

SEQ ID NO: 28379 - RNA, 1683 nt, Artificial Sequence; identical to SEQ ID NO: 28372
  derived and/or modified sequence opt3 from anti-influenza_Chain

SEQ ID NO: 28380 - RNA, 1683 nt, Artificial Sequence; identical to SEQ ID NO: 28373
  derived and/or modified sequence opt3 from anti-influenza_Chain

SEQ ID NO: 28381 - RNA, 1701 nt, Artificial Sequence; identical to SEQ ID NO: 28377
  derived and/or modified sequence opt3 from anti-influenza_Chain

SEQ ID NO: 28382 - RNA, 1701 nt, Artificial Sequence; identical to SEQ ID NO: 28374
  derived and/or modified sequence opt3 from anti-influenza_Chain

SEQ ID NO: 28383 - RNA, 1701 nt, Artificial Sequence; identical to SEQ ID NO: 28375
  derived and/or modified sequence opt3 from anti-influenza_Chain

SEQ ID NO: 28384 - RNA, 1704 nt, Artificial Sequence
  derived and/or modified sequence opt3 from anti-influenza_Chain
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguuccugaauguuccagaauggaguuauaucguggagaagauaaacccggcgaaugauuugugcuaccccggggacuuuaacgauuaugaggaacucaagcaucugcugagcaggaucaaucacuucgagaaaauucagaucauuccuaaguccucuuggucggacuacgaggcuucaagcggagucaguuccgccuguccauaucagggccggucuagcuuuuuccgcaacgugguauggcucaucaaaaagaauaacgcauaccccacaauaaaacgauccuauaauaacacuaaucaagaagauuuacugguucuuugggguauucaucacccuaacgacgccgcugagcagauccguuuguaccagaacccaaccacauacauuucaaucgggaccaguacucugaaucagaggcuagugcccaagaucgcaacaagaagcaaggucaacggacaaucuggccggauggaauuuuucuggaccauucucaaauccaaugaugccauaaacuuugagucaaauggcaacuucaucgcuccugaauaugccuacaagauugugaaaaagggggacagcacgaucaugaaaagugagcuggaauauggaaauugcaacacuaagugucagaccccaauaggugcgauuaauucuuccaugccguuucacaacauccauccccuuacaaucggcgagugcccuaaauacgugaaaagcaaucgccuggucuuggcaacugggcucagaaacucgccacagggagagaggcggcgccgaaagagaggccuguucggugccauugcuggguuuaucgaaggaggcuggcagggcaugguugacgggugguauggauaccaccauucuaaugagcaagguuccggcuaugccgcagauaaagaaucaacccagaaggcuauugacggggugacaaacaaaguaaauaguauaaucaacaagaugaacacccaguucgaggccgugggaagggaauuuaauaacuuagagcggcguauugagaaucugaacaaaaagauggaagauggcuuccucgacgucuggacguacaaugcggagcuucugguguugauggaaaacgagcgcacucuagauuuccacgacagcaauguuaagaaccuguacgauaaagugagacuccaacugagggacaaugccaaggaacuugguaacggguguuuugaguucuaucaccggugcgauaaugaguguauggaauccguccgaaacggcacauacgacuauccccaguacucugaggaagcacgccugaaaagagaggagaucagcggagugaaguuggaaucaaugggcaucuaucagauucucaguauauacuccaccguagcuagcucucuggccuuagcuaucaugguugccgggcuguuucuauggaugugcucaaauggaagucuccagugcaggauuuguauc

SEQ ID NO: 28385 - RNA, 1704 nt, Artificial Sequence
  derived and/or modified sequence opt3 from anti-influenza_Chain
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucaucaauguuccagaauggaguuauauaguggagaaggcgaacccgacaaaugaucugugcuaccccgggagcuuuaacgacuaugaggaauugaagcaucuccuguccaggaucaaucacuucgagaaaauucagaucauuccuaagucuucguggucagaucaugaagcuagcaguggagucuccucugccuguccauaccugggcagccccuccuuuuuccggaacgugguauggcucaucaaaaagaacucaacuuauccuaccauuaaaaagaguuacaauaauacaaaccaggaggacuuacugguucuuugggguauacaccacccaaaugaugcagccgagcaaacccgcuuguaucagaaccccacuacauacaucagcauugggaccucuacgcugaaccagcggcuagugccuaagaucgcuacucguuccaaagucaauggacagucaggcagaauggaauuuuucuggaccauccucaagccaaacgacgcaauuaauuuugagagcaacggcaauuucauagccccggaauacgcuuauaaaaucgugaagaaaggggauagugccauuaugaagucugagcuggaauacggaaacugcaauacaaaaugucaaacucccaugggugcgaucaacuccagcaugccuuuucauaauauacacccacuuaccauuggcgagugccccaaguaugugaagucgaacaggcuggucuuggcaacagggcuccgaaauucuccucagcgcgaguccagaaggaaaaagcggggacuguucggcgccaucgcugguuuuaucgaagggggauggcagggcaugguugacggcugguacggguaucaucacucaaacgagcagggaagugguuacgccgcagacaaagaaagcacccaaaaggcuauugauggcgugacgaauaaaguaaacuccaucauugacaagaugaauacucaguucgaggccguggggcgcgaauuuaacaacuuagagcgaagaauagagaaucugaacaagaaaauggaagauggauuccucgacgucuggacauauaaugcggagcuucugguguugauggaaaacgagaggacccuagauuuccacgacucuaauguuaagaaccuguacgauaaagugcggcuccagcugcgugacaaugccaaggaacuuggcaacgguuguuuugaguucuaccauaaaugcgauaaugaguguauggaaagcauccgcaacgggacuuauaauuacccacaauauucagaggaagcaagacugaagagggaggagauuaguggcgucaaguuggaauccaucggaacauaccagauccucagcauuuauucuaccguggcuucaagucuggccuuagcuauaaugauggccggccugagccuauggaugugcuccaacgggucucuccagugccggaucuguauu

SEQ ID NO: 28386 - RNA, 1704 nt, Artificial Sequence
  derived and/or modified sequence opt3 from anti-influenza_Chain
auggagaagaucgugcuccuguucgccauugucagccuuguuaaauccgaccagauaugcaucggcuaccacgcuaacaauucuaccgaacaaguggauacaauuauggagaagaacguaacugugacgcaugcacaggacauccuggaaaagacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagcuagccugggagugaguuccgccuguccauaccagggcaaaucuagcuucuuucggaacguaguuuggcugaucaagaaaaauuccacauaucccacuauaaagcgcucauacaacaauaccaaccaagaggaccucuuagugcugugggguauucaccacccuaaugaugcagccgagcagacaaaacuuuaucagaacccaaccacuuacaucagugucgggacaagcaccuugaaccagcgacuggugccccguauugcuacgagaucuaaagugaauggacaauccggcaggauggaguucuuuuggacuauccuaaagccuaacgacgcaaucaauuucgaaucaaacggcaauuuuauugccccagaauacgcuuauaaaauagucaagaaaggggauagcaccaucaugaagagugagcucgaauacggaaacugcaauacaaaaugucagacuccgaugggugccauuaacucuuccaugcccuuccauaauauccacccucugaccauaggcgagugcccaaaguauguuaagagcaaccggcuugugcuggcgacaggguugcgcaauucgccccagagagagaggcggcgcaaaaagcgaggacucuuuggcgcaauugccgguuucaucgaagggggauggcagggcaugguagacggcugguacggguaucaucacucuaacgagcaaggauccgguuacgcugccgacaaagaaucaacccagaaggcaaucgauggcgugacgaauaaagucaacaguauuaucgacaagaugaauacucaguuugaggcuguggggagagaguucaacaaccuggaaaggcggauugagaauuuaaacaagaaaauggaagauggauuccuggacguuuggacauauaaugccgagcuccuugugcugauggaaaacgagcguaccuuggauuuucacgacagcaaugucaagaaccuauacgauaaagugcgccugcaacucagagacaaugcgaaggaacugggcaacgguuguuucgaguuuuaccauaaaugcgauaaugaguguauggaauccguaaggaacgggacuuaugacuacccucaguauucugaggaagcccggcuuaagcgagaggagauaagcggcguuaagcuggaaucaaucggaauuuaccagaucuugaguaucuauuccacaguggcaagcucucucgcucuggccauuauggucgcuggcuuaucacuguggaugugcaguaaugggagccuacagugccgcauauguauc

SEQ ID NO: 28387 - RNA, 1704 nt, Artificial Sequence; identical to SEQ ID NO: 28384
  derived and/or modified sequence opt3 from anti-influenza_Chain

SEQ ID NO: 28388 - RNA, 1704 nt, Artificial Sequence; identical to SEQ ID NO: 28385
  derived and/or modified sequence opt3 from anti-influenza_Chain

SEQ ID NO: 28389 - RNA, 1704 nt, Artificial Sequence; identical to SEQ ID NO: 28386
  derived and/or modified sequence opt3 from anti-influenza_Chain

SEQ ID NO: 28390 - RNA, 1707 nt, Artificial Sequence
  derived and/or modified sequence opt3 from anti-influenza_Chain
agcaaguccagaggcuacaaaaugaacacccagauccugguguucgcccucgucgcuucuauucccacaaaugcagacaagauaugccuugggcaccaugccguuucaaacggaacuaaagugaauacgcugaccgagagggguguagaaguggucaacgcgacagagacuguggaacggaccaauguuccucgcaucuguaguaagggcaaacgaacaguggauuuggggcaaugcggauuacugggcaccauuacugguccaccgcagugugaccaguuucuagaguucagcgcugaucucaucauugaacguagagagggguccgacgucugcuaucccggaaaguuugugaacgaggaagcccugaggcagauccuucgggagucuggcggcauagauaaggaaacaaugggguucaccuacucgggaauccgcacgaaugguacuaccucagcauguagaaggagcggcaguuccuuuuaugccgagaugaaauggcuguugucuaacacagacaaugcugcauucccucaaaugacuaagagcuacaaaaacacccggaaggauccagcccucauuaucugggggauucaccauuccggaucaacaaccgagcagacgaaacuguauggcagugguaauaagcugaucacuguagggagcucuaacuaccagcaguccuuuguucccucaccuggagcucgcccacaagugaauggccagagcggccgaauagacuuccacuggcucauuuuaaaccccaaugauacagucaccuuuaguuucaacggggccuuuaucgcgccugacagagcaucuuuccugaggggaaaguccauggguauucagagcgaaguacagguggaugccaacugcgagggcgacuguuaucauucugggggaacuaucaucucgaaucuuccauuucaaaacauuaauucccgggcugucggcaaaugcccgcguuacguuaagcaggaaucauugcugcuagccacagguaugaaaaacgugcccgagauaccuaagcgcagaaggcggggccucuucggggcaaucgcuggauucauugaaaauggcugggaggggcugaucgauggaugguacgguuuucgacaccagaacgcccaaggcgaggggaccgcggccgacuauaaaaguacgcagagcgcaauagaccagauuaccggaaaacuuaaucgccugaucgaaaagacaaaccagcaauucgaguugaucgauaaugaauuuacugagguagaaagacagauuggcaacgugaucaauuggaccagggacuccaugacagaggucuggucuuacaacgcugagcuccugguggccauggaaaaucagcacacuauugauuuagcugacagcgagaugaacaagcuguaugaacggguuaagcgccagcucagagagaaugccgaagaggaugguaccggguguuucgagauauuucauaaaugcgacgaugacuguauggcaucaaucaggaacaacacauacgaucacaguaaguaucgugaagaggccauucaaaaucggauccagaucgacccagugaaacuuuccagcggcuacaaggaugucauucugugguucucuuuuggagcuucaugcuucauauugcuagcgaucgcaaugggccugguguuuauuugcgugaaaaacgggaauaugcgauguaccaucugcauu

SEQ ID NO: 28391 - RNA, 1707 nt, Artificial Sequence; identical to SEQ ID NO: 28390
  derived and/or modified sequence opt3 from anti-influenza_Chain

SEQ ID NO: 28392 - RNA, 1692 nt, Artificial Sequence
  derived and/or modified sequence opt3 from anti-influenza_Chain
gaccagaucugcauuggcuaccacgccaacaauagcaccgagaagguggauacaaaccuggaaagaaaugucacuguuacgcaugcuaaagacauacucgagaagacccacaacgggaaacuuuguaagcugaauggaaucccucccuuggaauuaggugauugcuccauugcaggcuggcugcuagggaacccagagugugacaggcuccugucugugccggaauggucauauaucauggagaaagagaauccccgggauggacuuugcuacccuggcaguuucaacgacuaugaagaacugaagcauuugcucagcuccguaaagcacuuugaaaaagugaagauucugccaaaagaucgcuggacacaacauacuaccacaggugggucucgagccugugcggucucgggaaaucccucauucuuucguaacaugguguggcugaccaaggagggcagcgacuacccuguugcuaaaggcaguuauaauaacacuuccggggagcagaugcucaucauauggggagugcaccacccaaucgaugaaacagagcagagaaccuuauaccagaaugucgguacguaugugucuguaggcacuagcacccugaacaagagguccacacccgaaauugccacucggccuaagguuaaugggcaaggaggccgcauggaguucucauggacccuuuuggacaugugggauacaaucaacuuugaaaguaccgguaaccugauugcaccagaguacggguucaaaaucagcaagagaggaucuuccggcauaaugaaaacggagggcacucuagaaaauugcgagacaaagugucagaccccgcucggggccauuaacacuacacugcccuuucauaaugugcacccucuuaccaucggagaaugcccaaaauacgucaagucagagaaacugguguuggcuacgggucucaggaacgugccccagauugaaagccggggccuguucggggcaaucgccggauuuaucgagggcgguuggcaggggauggucgacggcugguauggauaccaucacaguaaugaucaaggcucuggguaugcugccgacaaggaguccacccagaaggcguucgacggaauuacaaacaaaguuaauagcgugauagaaaagaugaacacucaguuugaggcaguagguaaagaguucggcaauuuagagcgccgacuggaaaaccucaauaagagaauggaggauggguuucuugacguguggaccuacaacgccgagcuguugguccuaauggaaaaugagaggacacuggauuuccacgacucgaacgugaaaaaucucuaugauaagguucggaugcagcugcgugacaacgugaaggaacuuggaaacggcuguuucgaguuuuaccauaaaugcgaugacgaguguaugaacucugucaagaaugguacuuaugauuacccuaaauacgaagaggaauccaagcugaaucgcaacgagaucaaaggggugaaguugucaaguaugggcguauaucaaagcggaagacucguuccaaggggcucccccgggucuggauacauuccggaagcuccucgggacggucaggccuaugugcgaaaggauggcgaguggguccuguuaagcaccuuccuggggaaacccaucccaaauccucuacucggacuggacucaacaggc

SEQ ID NO: 28393 - RNA, 1692 nt, Artificial Sequence
  derived and/or modified sequence opt3 from anti-influenza_Chain
cagaagcugcccggcaacgacaauagcaccgccacacucugccuugggcaccaugcugugccuaacggaacuaucgucaaaacgauuaccaaugaucaaauagagguuacaaacgcaacugaacuggugcaguccucuucaaccgguggcaucugugacaguccacaccagauuuuggauggggagaauugcacauuaaucgacgcccugcuaggagauccgcagugugacggcuuccaaaacaagaaaugggaucucuuuguagaaagaagcaaggcguacuccaauugcuaucccuacgacgugccugauuaugcuucucugaggucgcuugucgccucaagcgguacccuggaguucaacgacgaaaguuuuaauuggacuggggugacacagaacggaaccuccucuagcuguaaacggcgcuccaauaacucauucuuuagucgauugaauuggcucacgcagcugaaguucaaguacccagcacugaacguuacuaugcccaauaacgagaaauuugauaagcucuauauuuggggcgugcaucacccugucaccgacaacgaucagaucuucuuauacgcccaagcuagcggccguauaacagugucuacuaaaagaucccagcagaccguaaucccaaauauugggucaaggccccggauccgcaacauuccuagcagaaucaguauauauuggacaauuguuaagccaggagacauccugcuuauuaauucuaccgguaacuugaucgcaccgaggggcuacuuuaaaauccgguccggaaagagcucgauuaugcgcucugacgcccccauagggaagugcaauuccgaguguaucacgccuaacggcucaauuccaaaugauaaacccuuccagaacgugaaucgaaucacuuacggugcuugcccuagauaugucaagcaaaacacacugaaacuagccaccgggaugaggaaugugccagaaaagcagacucggggaauauuuggcgcgauugcaggcuucaucgagaacgggugggaaggaaugguggacgguugguacggcuuucgucaucagaauagugaggggaucggacaagccgcugaucucaaaagcacacaggccgcaauuaaccagaucaauggcaagcugaaccgccuuauugguaaaaccaacgagaaguuccaccagauagaaaaggaguucuccgaagucgaggggagaauccaagaccuggaaaaauauguugaggauacgaagauugacuuguggucuuacaaugcugagcuccugguggccuuagaaaaccagcacaccaucgaucugacagacagcgagaugaauaaacucuuugaaaggacuaagaaacagcuucgggagaacgcggaagauaugggcaauggauguuucaagaucuaucauaagugcgacaacgccuguauuggcucaauacgaaaugggaccuacgaucacgacguauaucgcgacgaggcacugaacaauagauuucagaucaaaggaguggaguugaagagugguuccggcaggcuagucccccgggggagcccgggaucuggcuacauuccugaagcuccccgcgauggucaagccuacgugagaaaagacggggaguggguucugcucucaacauuccugggcaagccaaucccuaacccccuucugggauuggauaguacuggc

SEQ ID NO: 28394 - RNA, 1692 nt, Artificial Sequence; identical to SEQ ID NO: 28392
  derived and/or modified sequence opt3 from anti-influenza_Chain

SEQ ID NO: 28395 - RNA, 1692 nt, Artificial Sequence; identical to SEQ ID NO: 28393
  derived and/or modified sequence opt3 from anti-influenza_Chain

SEQ ID NO: 28396 - RNA, 1695 nt, Artificial Sequence
  derived and/or modified sequence opt3 from anti-influenza_Chain
gacaccaucugcauuggcuaccacgccaacaauagcacagauacuguggacacgguccuggagaagaacguuaccgugacacauuccguaaaucuccuugaagauucucacaacgggaaacuguguuuguuaaagggaauagcuccccugcagcuagguaauugcucaguggcaggcuggauccucgggaacccugagugugaacugcuuauuaguagagagagcugguccuauaucgucgaaaaaccaaauccggagaacggaacuugcuaccccggccauuucgccgacuaugaggaacugagggagcaauugucuucggugagcucauuugaacgguucgagauuuuuccuaaggagaguuccuggccaaaucacaccacaaccgguguuucugcgagcuguucccauaacggggaaucaaguuucuacaaaaaucuccuguggcugacuggaaagaacggccucuaucccaauuuaagcaagucuuacgcuaacaauaaagagaaggaagugcugguccuuuggggcgugcaccacccuccaaacaucggggaucagcgcgccuuguaucauaaagagaacgcauacguauccguugugucaagccacuacagucgaaaguuuacacccgaaauagccaaacguccuaaggucagagaccaggagggaaggaucaauuauuacuggacccugcuagagccaggugauacgauuaucuucgaagcuaacggcaaucucauugcaccgcgguaugccuuugcucugucucgcggguucggauccggcaucauaaacagcaaugcccccauggacgagugcgaugcgaagugucagacuccucaaggugcaauuaacucgucucuuccauuucagaaugugcaucccgugaccaucggggaaugcccuaaauacgucagauccgccaagcugaggaugguuacaggauugcggaacauuccaucaauccagagucgcggccucuucggcgcuaucgccggguuuauugagggagguuggacuggcaugguggacgggugguauggauaccaccaccagaaugaacaaggcagcgguuaugcagcugaucagaaauccacccagaacgccauaaaugggaucacaaacaagguaaauucugugauugagaaaaugaacacccaguucacggcggucggcaaggaguuuaauaaacuggaacgaagaauggagaacuuaaacaagaagguggacgauggauucaucgacauauggacuuacaaugccgaacugcucguucuucuggagaacgaaaggacauuggacuuccaugauagcaaugugaaaaaccuauacgagaaggucaaaucacaacugaagaauaacgcaaaagagauuggcaauggguguuuugaguucuaucacaagugcaacgacgaauguauggaaagugugaagaauggaaccuacgauuaucccaaauacuccgaggagagcaagcucaaccgggagaaaaucgacgguguaaagcuggaaucuaugggcguuuaucagucagggcgucuugugccgcgcggaaguccuggcagcgguuacauccccgaagcuccaagagaugggcaggccuaugucaggaaagacggcgagugggugcuguuguccacuuuucucggaaagccuauucccaauccacuguuaggccuggauucuacaggg

SEQ ID NO: 28397 - RNA, 1695 nt, Artificial Sequence
  derived and/or modified sequence opt3 from anti-influenza_Chain
caaaacuacaccggcaaucccgugaucugccuggggcaccaugccgucagcaacggaacaaugguuaagacucucacggacgaucaaauugaggugguaaccgcucaggaacuuguggagucccagcaucugccugaauuguguccaucuccguuaagacuggucgacggucagacaugcgauauagugaauggcgcacuagggucacccggaugugaccaccucaacggcgccgagugggauguuuucaucgaaaggccuacugcgguggauaccugcuauccauuugauguccccgacuaccaaagucugcggagcauucuugcuaauaacgguaaauucgaguuuaucgccgaggaguuccaguggaauacagugaagcagaacgggaaauccggagcauguaagcgcgccaauguaaacgacuuuuucaaucgacugaacugguugaccaaaucugacggcaaugcuuauccucuccagaaccugacuaagguuaauaacggcgauuacgcacgucuguauauuuggggagugcaccauccaucgacagacaccgaacaaacgaaccucuacaagaauaaccccgggagagucacugugucaacccagacaagccagacuagcguggucccuaauaucgguuccaggccauggguucggggcuuaucuagccgcauauccuuuuauuggaccaucguggaaccgggggaucugauuguauucaacacaaucggaaaucuuauugcccccagaggccacuacaaauugaacucacagaagaaaaguaccauccugaauacggcugugccuauagguagcugcgucucuaagugucacacugacaaaggguccauuucaacaaccaagccauuucaaaacaucagcaggauuaguaucggagacugccccaaguacgugaaacagggcucucuaaagcucgccacuggcaugcgguccauccuggagaaagcgacacgcgggcuuuucggagcaauugccgguuuuauagagaauggcuggcaggggcugaucgauggaugguauggcuuccgacaucaaaacgcugaagguaccgggacggccgcagacuugaagaguacccaggcugccauugaucagaucaauggcaaacucaacagacugauaggaaagccuaaugagaaauaccaccagauugaaaaggaguuugaacaaguugagggcaggauccaggacuuagagaaguauguggaagauacaaaaaucgaccuguggucguacaacgcggagcuccuugucgcccuggaaaaucagcauacuauugaugugaccgacucugagaugaacaaguuguucgaacggguacgucaccagcuacgcgagaacgcagaggauaaagggaauggauguuucgaaaucuuucaccaaugcgacaacuccuguauugagucaauaagaaaugguacauaugaucaugacaucuacagggacgaagcuauuaacaaucgguuccagauccagggcguuaagcugauccagggguauaaagauaguggacgacucgugccacgcggcagccccgguuccggguacauuccggaggccccuagagacggccaggcuuacgucaggaaggauggagaaugggugcugcuuucuacuuuucugggcaagcccauaccaaacccuuugcucgggcuggacagcaccgga

SEQ ID NO: 28398 - RNA, 1695 nt, Artificial Sequence
  derived and/or modified sequence opt3 from anti-influenza_Chain
gaccagaucugcauuggcuaccacgccaacaauagcaccgagcaaguggauacaauaauggaaaagaacgucacuguuacgcaugcucaggacauccuggagaaaacccacaaugggaagcucuguaaccuugauggagugaaaccccugauuuugaaggacugcuccguagcagguugguuacugggcaauccuaugugugaugaguuccuaaacgugucugaauggucauauaucgucgaaaaagccaguccagcgaaugggcucugcuacccgggagacuuuaacgauuaugaggagcugaagcaucuucugagcagaauuaaucacuugaagaaaaucaagauaauccccaaauccuacuggucuaaccaugaggcuucgucaggcgugagcgccgcauguaguuaucucggugaaccuuccuucuuuaggaauguuguguggcugauuaagaaaaacaauacauacccacccaucaaggucaacuauacuaauaccaaccaggaagaccugcucguguuaugggggauucaccacccuaacgaugagaaggagcagauccggauauaccaaaauccaaacacaucuauuagcguaggaaccuccacucugaaucagcgccuuguucccaaaaucgccacacgaccuaaggugaacggccagucaggccguauggaguucuuuuggaccauuuugaaaccaaaugacaguaucaacuucgauagcaaugggaacuuuaucgcuccggaauacgcauauaagauugccaaaaagggagacucugucauaaugaaauccgaacuggaguacgguaauugcaacacgaagugucagacucccaugggcgcuaucaauucaagcaugccuuuccauaacauucacccacuaaccaucggggaaugccccaaguaugugaaaaguaauagacucgugcuggccacaggacuuaggaacgcgccucaaacugagacccggggccuguuuggugcaauagccggguucauugagggaggcuggcagggcauggucgaugggugguacggauaucaucacucuaaugaacaggguuccggcuacgcugccgacaaggagagcacacagaaagcaaucgacgggaucaccaacaagguuaacucgauuaucgauaaaaugaauacgcaauuugaaauugugggacgcgaguucaacaauuuggaaagaaggauagagaaccucaauaagaagauggaggacggcuuucuggauguauggacuuauaacgcugaauuacuggugcucauggagaaugaacggacacuugacuuccacgauucuaacgucaaaaaucuguacgagaaggugcgcuugcagcuacgagacaacgccaaagaacuggguaauggguguuucgaguuuuaccauaagugcgauaacgaguguauggaauccguuagaaauggcaccuaugacuacccacaguauucagaggaagcgaggcucagucgggaggagaucagcggagugaaaauggaauccauggucacuuaccaaucuggccgucuggugccccgcgggagcccgggaucagguuauauuccugaggcccccagagauggccaggcauacguaaggaaggacggggaauggguucuucugaguacauucuugggaaagccaaucccuaacccccuccugggcuuagauuccaccggu

SEQ ID NO: 28399 - RNA, 1695 nt, Artificial Sequence; identical to SEQ ID NO: 28396
  derived and/or modified sequence opt3 from anti-influenza_Chain

SEQ ID NO: 28400 - RNA, 1695 nt, Artificial Sequence; identical to SEQ ID NO: 28397
  derived and/or modified sequence opt3 from anti-influenza_Chain

SEQ ID NO: 28401 - RNA, 1695 nt, Artificial Sequence; identical to SEQ ID NO: 28398
  derived and/or modified sequence opt3 from anti-influenza_Chain

SEQ ID NO: 28402 - RNA, 1698 nt, Artificial Sequence
  derived and/or modified sequence opt3 from anti-influenza_Chain
gacacccugugcaucggcuaccacgccaacaauagcacagauacuguggacacgguccucgagaagaacguuaccgugacacauuccguaaaucuucuggaagauaaacacaacgggaaguuguguaaauuaagaggaguggcuccccugcaucuagguaagugcaauauugcaggcuggauacucgggaacccugagugugaaucucugucaacugccaguagcugguccuauaucgucgagaccccaucuucggacaauggaacaugcuacccgggcgauuucauugacuaugaggagcuuagggagcagcugucaagcgugaguuccuuugaacgguucgagaucuuucccaaaaccucuagcuggccuaaccacgauuccaauaaggguguuacugcggcuuguccacaugccggggcaaagucauucuacaaaaacuugauuuggcucgugaagaaaggaaauaguuaucccaagcugagcaaaucuuacaucaacgacaagggcaaggaaguccuggugcucuggggcauacaccacccuuccacaucagccgaucaacagagcuuauaucagaaugcugacaccuacguauuuguugggaguucucgcuacuccaaaaaguucaaaccagagaucgcaauucgacccaaggugcgugaucaggagggaagaaugaacuauuacuggacgcuggucgaaccuggugacaaaaucacuuuugaggccaccggcaaucuuguggugccaagguaugcuuucgccauggaacggaacgcggggagcggaauuaucauaucggauacaccgguccaugacugcaacacuaccugucaaacacccaagggcgcaauuaauaccucuuugccuuuucagaacauccacccaauuacgaucgguaaaugccccaaguacguuaaguccacuaaacugcgccuagccacagggcucagaaauaucccuucaauucagaguaggggacuguucggcgcuauagccggcuuuaucgaagggggauggaccgguaugguggacggcugguauggguaccaucaccagaacgaacaaggaagcggcuaugcagcugaucuuaaguccacucagaaugccauugacgagaucacaaacaaaguaaauucugugauagagaagaugaacacccaguucacggcggucgguaaagaauuuaaucaccuggagaagcggauugaaaacuugaauaagaaaguggaugacggguuccucgauaucuggaccuacaacgccgagcuguuaguucugcucgaaaaugagcgcacacuugacuaccaugauagcaacgugaagaaucuguaugagaaaguccgaucacaguugaagaacaacgcaaaagaaaucggcaauggauguuucgaguuuuaccacaagugcgacaacacuuguauggaaagugugaagaauggcaccuaugauuacccaaaauauuccgaggaagcuaagcuaaacagagaggagauugacgggguaaaacuggaaagcacaaggaucuaccaaucuggacggcucguuccccgugguucaccgggcaguggguauauuccugaggcuccccgcgauggacaggccuacgugagaaaggacggcgaauggguccugcuuagcacuuuccuggguaaaccaauaccuaaucccuugcucgggcuggacuccaccggc

SEQ ID NO: 28403 - RNA, 1698 nt, Artificial Sequence
  derived and/or modified sequence opt3 from anti-influenza_Chain
gacagaaucugcauuggcuaccaaagcaacaauuccaccgauacagugaacacucugauagagcaaaagguccccguuacgcagaccauggaacucguggagacagaaaaacacccugccuauuguaauacugaccuuggggcuccacuggaguugagggauugcaagaucgaagcaguaauuuacggaaacccgaaaugugacauccauuuaaaggaucaggguuggucuuauauuguggagcggcccucagccccugagggcaugugcuacccagggagugucgaaaaucuggaggaacuacgcuucguguuuagcuccgcggcuucuuauaaacgaauccgucucuucgacuacucgagauggaacguuaccucaagcggaacaaguaaggccuguaaugcauccaccggcggucagucuuuuuauaggagcauaaacuggcugacuaagaaaaagcccgauacauacgacuucaaugaggggaccuacgugaacaaugaggauggagacaucauuuuucuuuggggcauccaccauccuccagauacgaaagaacaaacuacccuguauaagaacgccaauacauuguccucagucacuaccaacacaauuaaucggaguuuccagcccaacaucggcccucgcccacucgugagagggcagcagggaaggauggacuacuauugggguauacugaaacggggcgagacccugaagauucgcacgaacgggaaucucaucgcuccggaauuuggauacuuacugaagggcgagagccacggucgaacuauucaaaacgaagauauccccaucgggaauugcuauacaaaaugucagaccuacgcaggagccauuaacucuuccaagccuuuccagaaugcuucaagacauuauaugggcgagugcccaaaauacguaaagaaagccagccuuagguuggcgguuggccugcggaacacucccaguguggagccucgugggcuauuuggagcaauagccgguuucaucgaaggcggguggucuggaaugauugacggcugguacgguuuucaccacuccaauagcgaggggacaggcauggcugccgaccagaagucgacccaagaagcaaucgauaaaauaacgaacaaggucaauaacauuguggacaagaugaaucgcgaguucgaaguggucaaccaugaguuuucugagguugaaaagagaaucaauaugaucaacgauaagauugacgaucagaucgaggaccucugggcuuauaaugccgaacugcuugugcuguuggagaaccagaaaacccucgaugaacacgacuccaacguaaagaaucuguucgaugaggugaaaaggcgguuaucagcgaacgccauugacgcaggaaauggcuguuucgauauacugcauaagugcgacaacgaguguauggaaacaaucaagaaugggacuuacgaccacaaagaguaugaagaggaggcuaagcucgaacgaaguaaaauuaacggagucaaacuugaggaaaauaccacauacaaaagcggucgccuggugccaagaggcucccccgggucuggauauaucccggaggccccuagggauggccaggcuuacguucggaaggacggugaauggguguugcuaagcacuuuucuggggaagcccaucccaaacccucuccugggccuugauucaaccgga

SEQ ID NO: 28404 - RNA, 1698 nt, Artificial Sequence; identical to SEQ ID NO: 28402
  derived and/or modified sequence opt3 from anti-influenza_Chain

SEQ ID NO: 28405 - RNA, 1698 nt, Artificial Sequence; identical to SEQ ID NO: 28403
  derived and/or modified sequence opt3 from anti-influenza_Chain

SEQ ID NO: 28406 - RNA, 1701 nt, Artificial Sequence
  derived and/or modified sequence opt3 from anti-influenza_Chain
gacaagaucugcauuggcuaccacgccaacaauagcaccacacagguggauacuauacuggagaaaaacgucacgguuacccauuccguggaacuccuugagaaucaaaaggaagagagauucuguaaaauccugaacaaggcucccuuggacuuaagggggugcacaauugaaggauggauccuggguaauccucagugugaucuacuccugggcgaccagucuuggucauauauuguagagcggccaacugcacagaacgggaucugcuacccgggagcccuuaaugagguggaggaacugaaagcguugauaggcaguggugaacgcgucgagcgauuugagauguuccccaagagcaccuggacagggguggauaccuccucuggaguuacuaaggcuuguccuuauaacucgggcagcucauuuuaccguaaucuccuguggaucauuaaaacaaagagugccgcauauccagugaucaaaggcaccuacaacaauacggggucccaacccauucuguauuucuggggaguccaccauccuccagacacuaacgaacagaauacccucuacgguucuggcgauagauacgugaggauggggacagagagcaugaacuuugccaagucccccgaaaucgcugcacggccugccguaaauggacagcgcggcagaauagacuauuacuggucaguuuuaaaaccaggugagacucugaacguggaaaguaacgggaaucuuauugcuccgugguaugccuacaaguucgucagcaccaacaauaagggagcgaucuuuaaaucuaacuugcccauugagaauugcgaugcaacaugucagaccaucgccggcgugcugaggacgaacaagacuuuccaaaauguguccccucuauggaucggcgagugcccaaaauaugucaagucagaaagccuccggcuggcuacagggcuucgcaacguuccccagauugagacccgaggacuguuuggugccauagcaggcuucaucgaagggggauggacuggcaugauugacgguugguacggguaucaccaugagaauagucagggcucuggauacgcugccgauaaagaauccacacagaaggcgaucgacggcauaaccaacaaagugaauagcauuaucgauaagaugaacacgcaauuugaggccguagaccacgaguucucgaauuuggaaagaaggaucgacaaccucaauaagcggauggaggauggguuucuggacguguggaccuacaacgcagaauuacugguccuccuugagaacgaacguacacuggauuugcacgacgcuaaugugaaaaaccuauaugagaagguuaaaucucagcugcgcgauaaugccaacgaccucggaaaugguuguuucgaguucuggcauaagugcgauaacgaauguauugaguccgugaaaaauggcacuuacgacuauccuaaguaccaggaugaaucaaagcugaacagacaagagaucgagagugucaaacuugacaaucuggggguguaucagagcggaagguugguaccacggggcucccccgguucuggguacauuccggaagcuccucgagauggccaggccuauguucgcaaggacggagagugggugcuccugagcaccuuuuuaggcaaacccauaccaaacccucugcuagggcucgacucaacagga

SEQ ID NO: 28407 - RNA, 1701 nt, Artificial Sequence; identical to SEQ ID NO: 28406
  derived and/or modified sequence opt3 from anti-influenza_Chain

SEQ ID NO: 28408 - RNA, 1704 nt, Artificial Sequence
  derived and/or modified sequence opt3 from anti-influenza_Chain
gaccacaucugcauuggcuaccaugccaacaauagcaccgaacagguggauacaauaauggaaaagaacgucacuguuacgcacgcucaagacauccuggagaaaacccauaaugggaagcucugugaucuuaacggagugaaaccccugauuuugaaggacugcuccguagcagguugguuacugggcaauccuaugugugaugaguucaucaacgugccagaguggucuuauauugucgaaaaagccaauccggcgaacgaccuaugcuaccccgggaauuuuaacgauuaugaggagcucaagcaucugcuuucaagaaucaaucacuucgaaaagauacagaucauuccuaaagacaguuggagcgaucacgaggcuucccugggagugucuucggccuguccauaccagggcaacagcucauuuuucaggaauguugugugguugaucaagaaagguaacgcauaucccacaauuaagaaaaguuacaauaacacuaaccaggaagaccuccugguccugugggggauccaccauccuaaugaugaggccgagcaaacccggcucuaucagaacccaacaaccuacauauccauuggaacuucuacauuaaaucagcgccuggugcccaagaucgcuacccgaagcaagguaaacggccaguccggccguauugacuuuuucuggacgauccuuaaaccuaaugaugcaaucaacuuugaaucaaaugggaacuucauugccccagaguacgcuuauaagauaguuaaaaagggagacaguacuaucaugaaaagcgaaguggaguacgguaauugcaacaccagaugucaaacaccgaugggcgccauuaauucuuccaugcccuuucacaacauccauccuuugacuauaggggaaugcccaaaguaugucaaaucaaauaagcuggugcuagcgaccggacucaggaacagcccccagcgggagcgcagaaggaagcggggccuguucggugcaauugccggguuuaucgagggaggcuggcagggcaugguggacgggugguacggauaucaccacaguaaugaacaggguucuggcuacgcugccgauaaagaguccacacaaaaggcaaucgacggggucaccaacaaaguuaacagcauuaucgauaagaugaauacgcaguucgaagcugugggacgcgaguuuaacaaucuugaacgaagaauugagaaccugaauaaaaagauggaggacggcuucuuggauguauggacuuauaacgccgaacuccugguguuaauggagaaugaaaggacacuggacuuccaugauucgaacgucaagaaucucuacgacaaagugcggcuucagcugcgugauaacgcgaaggaguuggguaauggguguuuugaguucuaccacaaaugcgacaacgaauguauggagucuguucgcaauggcaccuaugauuacccucaauauuccgaagaggccagacuaaagagggaagagauaucaggagugaaacuggagaguaucggcacuuaccagagcgggcggcucgucccacgaggaucccccgguucuggcuauauuccggaagcaccucgcgacgggcaggcuuacgugagaaaggacggagaguggguacugcuuagcacauuucugggcaagcccaucccaaacccuuugcucggucuggauucaaccggg

SEQ ID NO: 28409 - RNA, 1704 nt, Artificial Sequence
  derived and/or modified sequence opt3 from anti-influenza_Chain
gaccagaucugcauuggcuaccacgccaacaauagcaccgagcaaguggauacaauaauggaaaagaacgucacuguuacgcaugcucaggacauccuggagaaaacccacaaugggaagcucugugaucuugacggagugaaaccccugauuuugagagauugcuccguagcagguugguuacugggcaacccuaugugugacgaguucaucaaugugccagaguggucuuauauugucgaaaaggccaacccggcgaaugaucuaugcuaccccgggaacuuuaaugacuaugaggagcucaaacaucugcuuucaaggaucaaccacuucgaaaagauacagaucauuccuaagaguagcugguccgaucaugaggcuucuucgggagugucaagcgccuguccauaccagggcacacccuccuuuuuccggaauguuguguggcugaucaaaaagaacaauacuuauccuaccauuaaacgcaguuacaacaauacaaaccaagaagacuugcucauccugugggguauacaccacucuaacgaugcagccgagcagaccaagcuguaucagaauccaacuacauacauuagcgucgggaccuccacgcucaaccagcgauuagugcccaaaaucgcuacucguucaaagguaaauggacaaaguggcagaauggacuuuuucuggaccauucugaagccuaacgaugcaaucaauuuugagagcaacggcaauuucaucgccccagaauacgcuuauaaaauuguuaagaaaggggacucugccauagugaaguccgaggucgaauacggaaacugcaauacaaaaugucagacuccgaucggugcgauuaacucaagcaugcccuuucauaauauccacccucuuaccauaggcgagugcccaaaguaugugaaaaguaacaaguuggugcuggcaacagggcuaaggaacucuccccuccgggaacgcagaaggaagcggggacuguucggcgccauugcugguuuuaucgaagggggauggcagggcauggucgacggcugguacggguaucaucacuccaaugagcagggaagcgguuacgccgcagauaaagaaucgacccaaaaggcuaucgacggcguuacgaauaaagugaacucuauuaucgauaagaugaacacucaguucgaggccguagggcgcgaauuuaauaaccuugagcgaagaauugaaaaucugaacaaaaagauggaggacggauucuuggauguguggacauauaaugcggagcuccuggucuuaauggaaaacgagaggacccuggacuuccacgauuccaaugugaagaaccucuacgacaaaguucggcuucagcugcgugauaaugccaaggaauugggcaacgguuguuuugaguucuaccauaaaugcgacaaugaauguauggagucagugcgcaacgggacuuaugauuacccucaauauagugaggaagcaagacuaaagagggaggaaauaagcggcgucaaacuggaguccaucggaacauaccagucuggccggcucgugccacgagggagccccggaucagguuauauuccggaggcuccucgcgacggccaggccuacguaagaaaggacggggaauggguucugcuuaguaccuuucugggaaagcccaucccaaauccuuugcucggccuggauuccacgggu

SEQ ID NO: 28410 - RNA, 1704 nt, Artificial Sequence; identical to SEQ ID NO: 28408
  derived and/or modified sequence opt3 from anti-influenza_Chain

SEQ ID NO: 28411 - RNA, 1704 nt, Artificial Sequence; identical to SEQ ID NO: 28409
  derived and/or modified sequence opt3 from anti-influenza_Chain

SEQ ID NO: 28412 - RNA, 1707 nt, Artificial Sequence
  derived and/or modified sequence opt3 from anti-influenza_Chain
gaccagaucugcauuggcuaccacgccaacaauagcaccgagcaaguggauacaauaauggaaaagaacgucacuguuacgcaugcucaggacauccuggagaaaaagcacaaugggaaacucugugaucuugacggagugaagccccugauuuugagagauugcuccguagcagguugguuacugggcaacccuaugugugacgaauuuaucaaugugccagaguggucuuauauugucgaaaaagccaacccggugaaugaucuaugcuaccccggggacuuuaacgauuaugaggagcucaagcaucugcuuucaaggaucaaucacuucgaaaagauacagaucauuccuaaaaguagcugguccucucaugaggcgucgcugggaguuucaagcgcuuguccauaccagggcaagaguuccuuuuuccggaacguggucugguugaucaaaaagaacucuaccuaucccacaauuaaacgcagcuacaauaauacuaaccaagaagaccuccuggugcugugggguauccaccacccuaaugaugccgcagagcagaccaagcucuaucagaacccaacaaccuacauauccguagggacuucaacauuaaaccagcgacugguuccccguauugccaccagaaguaaggugaauggacaaagcggcaggauggaguuuuucuggacgauccuuaaaccuaacgacgcuauuaauuuugaaucuaacggcaauuucaucgcaccagaguacgccuauaagaucgucaaaaagggggauuccacuauuaugaaaucagaauuggaguacggaaacugcaauaccaagugucagacaccgaugggugcuauaaacagcaguaugcccuuucauaauauccacccucugacuauuggcgaaugcccaaaauaugugaagucuaaccggcuagugcucgccaccgggcugcgcaauagcccccagagagagaggcggcgcaagaaacgaggacuuuucggcgcgaucgcagguuuuauagaagggggauggcagggcauggucgacggcugguacggguaucaucacuccaacgaacaaggaucggguuacgccgcugacaaggagucuacacagaaagccauugauggcguuaccaauaaggugaacuccaucaucgacaaaaugaauacgcaguucgaagcaguagggagagaguuuaacaaccuggaaaggcggauugagaauuugaacaagaagauggaggauggauuccucgacguguggacuuauaaugcugaacuguuaguccugauggagaacgaacguacacucgauuuccacgacucaaaugugaaaaaccuuuacgauaagguucgccugcaauugagagacaaugccaaagagcuaggcaacgguuguuuugaguucuaccauaagugcgauaaugaguguauggagagugugaggaacgggaccuaugacuacccucaguauagcgaagaggcgcggcugaaacgagaagagaucuccggcgucaagcucgagucuauuggaauauaccagagcggccgccuggugccaagagggucacccggaagugguuauaucccggaagccccuagggauggccaggcauacguacggaaggacggggaguggguucuucuguccacuuucuugggaaaacccauuccaaauccucuccugggcuuagacagcacaggu

SEQ ID NO: 28413 - RNA, 1707 nt, Artificial Sequence
  derived and/or modified sequence opt3 from anti-influenza_Chain
gaccagaucugcauuggcuaccacgccaacaauagcaccgagcaaguggauacaauaauggaaaagaacgucacuguuacgcaugcucaggacauccuggagaaaacccacaaugggaagcucugugaucuugacggagugaaaccccugauuuugagagauugcuccguagcagguugguuacugggcaacccuaugugugacgaauuuaucaaugugccagaguggucuuauauugucgaaaaggccaacccgacaaaugaucuaugcuaccccgggucauuuaacgacuaugaggagcucaaacaucugcuuaguaggaucaaucacuucgaaaagauacagaucauuccuaagagcuccuggucugaucaugaggcgucgucaggagugagcagugcuuguccauaccugggcucccccucuuucuuccggaacguugugugguugaucaaaaagaauagcacuuauccuaccauuaaaaaguccuacaacaauacaaaccaggaagaccuccugguccugugggguauccaccacccaaaugaugccgcagagcaaacccgccucuaucagaaccccacuacauacauaucaauugggaccaguacguuaaaccagcgacuggugccuaaaaucgccacucguagcaagguaaauggacagucuggcagaauggaguuuuucuggaccauucuuaagccaaacgacgcuaucaauuuugaauccaacggcaauuucaucgcaccggaguacgccuauaaaauuguuaagaaaggggauucagcuauaaugaaaagcgaauuggaguacggaaacugcaauacaaagugucaaacucccaugggugccaucaacaguucuaugccuuuucauaauauucacccacugaccaucggcgaaugccccaaguaugugaaauccaacaggcuaguccucgcgacagggcugcggaauagcccucagcgcgagucgagaaggaagaagcggggacuuuucggcgcaauagccgguuuuauugaagggggauggcagggcaugguggacggcugguacggguaucaucacucuaacgaacagggauccgguuacgcugccgacaaagagucaacccaaaaggcaaucgauggcgugacgaauaaagucaacaguaucauugacaagaugaauacucaguucgaagcuguugggcgcgaguuuaacaaccuggaacgaagaaucgagaauuugaacaaaaagauggaggauggauuccucgacguguggacauauaaugccgaacuguuaguacugauggagaacgaaaggacccucgauuuccacgacagcaaugugaagaaccuuuacgauaaaguccggcugcaguugcgugacaaugcgaaggagcuaggcaacgguuguuuugaguucuaccauaaaugcgauaaugaguguauggaguccauucgcaacgggacuuauaauuacccacaauauucugaagaggccagacugaagagggaagagauaagcggcgugaaacucgagucaaucggaacauaccagaguggccggcugguuccccgaggguccccgggaagcgguuauauuccugaagcaccccgcgacggccaggcuuacgugagaaaggauggggaguggguccuucugucuaccuuuuugggaaagccaaucccuaacccccuccugggcuuagacucaacgggu

SEQ ID NO: 28414 - RNA, 1707 nt, Artificial Sequence
  derived and/or modified sequence opt3 from anti-influenza_Chain
gaccagaucugcauuggcuaccacgccaacaauagcaccgagcaaguggauacaauaauggaaaagaacgucacuguuacgcaugcucaggacauccuggagaaaacccacaaugggaagcucugugaucuugacggagugaaaccccugauuuugagagauugcuccguagcagguugguuacugggcaacccuaugugugacgaguuccuaaaugugucugaauggucauauaucgucgaaaagauuaacccagccaaugaucucugcuacccggggaacuuuaauaacuaugaggagcugaaacaucuucugaguaggaucaaucgguucgaaaagauacagaucauucccaagagcuccuggccugaccacgaggcgucuuugggagugucgucagcuuguccauaccagggcggucccagcuuuuaucgcaacguuguguggcucaucaaaaagaauaacacauacccuacuauuaaaaagaguuaucauaauaccaaccaagaagaucugcugguccucugggggauccaccacccaaacgacgaggccgagcagacacgaauauacaaaaaucccaccacuuacauuuccgugggaacaucuaccuuaaaccagcgucugguaccuaagaucgcaacgagaagcaagguuaauggccaguccggcaggguggaguucuuuuggacuauucuuaaaucaaacgauaccaucaauuucgaaaguaacgggaauuuuaucgccccagaaaacgcuuauaagauugucaaaaagggagacagcacaauaaugaaaucugaguuggaauacgguaauugcaacacuaagugucaaaccccgaucggcgcaauuaauuccucaaugcccuuccauaacauccacccucugacaauaggggagugcccaaaauaugucaagagcaaucggcuagugcucgccaccggacugcgcaacaguccccagggcgagagaaggcggaagaaacgcggucuuuuuggggcuauugccggauucaucgaaggcggcuggcaggggaugguggauggaugguacgguuaucaucacucuaaugagcagggcuccggguacgcggcagacaaggaaagcacgcaaaaagccaucgacggaguuacuaacaaggugaacucgauuaucgauaaaaugaauacacaguuugaggcuguaggccgagaguucaacaaucuggaaagaaggauugagaacuugaauaagaagauggaagacgguuuucucgauguguggaccuauaacgccgagcuguuaguccugauggaaaaugagcggacucucgacuuccacgauucuaacgugaaaaaucuuuacgacaagguucgucugcaguugcgcgauaacgcaaaagaacuagggaauggcuguuucgaguuuuaccauagaugcgacaacgaguguauggaauccgugaggaauggaacauaugauuacccucaauauucagaggaagcucggcugaagcgagaggagauaaguggcgucaaacucgaaagcaucgggaccuaccaguccggacgccuggugccaagagguucucccggcagcggguauauuccggaggccccuagggacggacaggcguacguacggaaggauggcgaauggguucuucugucaacguucuuggguaagcccaucccaaacccucuccugggguuagacaguaccggc

SEQ ID NO: 28415 - RNA, 1707 nt, Artificial Sequence; identical to SEQ ID NO: 28412
  derived and/or modified sequence opt3 from anti-influenza_Chain

SEQ ID NO: 28416 - RNA, 1707 nt, Artificial Sequence; identical to SEQ ID NO: 28413
  derived and/or modified sequence opt3 from anti-influenza_Chain

SEQ ID NO: 28417 - RNA, 1707 nt, Artificial Sequence; identical to SEQ ID NO: 28414
  derived and/or modified sequence opt3 from anti-influenza_Chain

SEQ ID NO: 28418 - RNA, 1728 nt, Artificial Sequence
  derived and/or modified sequence opt3 from anti-influenza_Chain
aucugcauuggcuaccacgccaacaauagcaccgaacagguggacacaauaauggaaaagaacgucacuguuacgcaugcucaagauauccuggagaaaacccacaaugggaagcucugugaccuugauggagugaaaccccugauuuugagagacugcuccguagcagguugguuacugggcaacccuaugugugaugaauuuaucaaugugccagaguggucuuauauugucgaaaaggccaacccggcgaaugaccuaugcuaccccgggaacuuuaaugauuaugaggagcucaaacaucugcuuucaaggaucaaccacuucgaaaagauacagaucauuccuaagaguagcugguccgaccaugaggcuucuucgggagugucaagcgccuguccauaccagggcacacccagcuuuuuccggaauguuguguggcugaucaaaaagaacaauacuuauccuaccauuaaacgcuccuacaacaauacaaaccaggaagauuugcucauccugugggguauacaccacucuaacgacgcagccgagcaaaccaagcuguaucagaauccaacuacauacauuagcgucgggaccuccacgcucaaccagcgauuagugcccaaaaucgcuacucguucaaagguaaauggacagaacggcagaauggauuucuucuggaccauucugaagccuaaugacgcaaucaacuuugagaguaauggcaacuucaucgccccagaauacgcuuauaaaauuguuaagaaaggggauagcgccauagugaagucugaggucgaauacggaaauugcaacacaaaaugucaaacuccgaucggugcgauuaauuccucaaugcccuuucauaacauccacccucuuaccauaggcgagugcccaaaguaugugaaaagcaauaaguuggugcuggcaacagggcuaaggaacaguccccucggauacauuccugaagccccacgggacggccaggcuuauguccgcaaggacggugaguggguucugcuuucuaccuuccugagauccgauaaaacgcauacuugucccccgugcccugcccccgaguugcucgggggaccaagcguguuucuguucccucccaagccaaaagacacauuaaugaucucgaggacccccgaaguaacuuguguggucguggauguuucucacgaggacccugaagugaaguuuaauugguacgucgauggcguggagguacacaacgcaaaaacaaagccacgggaggagcaguauaacuccaccuaccgcguugugucaguccugacggugcuccaucaggacuggcuuaauggcaaggaguacaaaugcaaggucaguaacaaagcucugccggcccccaucgaaaagaccauuagcaaagcgaaggggcaaccucgagagccacagguguauacauugcccccuuccagagaagagaugacuaagaaucagguuucucuaaccugccuggugaaaggauucuacccaagcgauaucgccguagaaugggagucaaacggucaacccgagaauaacuauaagacaacuccgccuguccucgacagugauggcuccuucuuucuguacagcaaacuuaccguggacaagucuagguggcagcaggggaauguuuucucauguagugugaugcacgaagcacugcauaaccacuauacacagaaaaguuugucccucucuccaggaaag

SEQ ID NO: 28419 - RNA, 1728 nt, Artificial Sequence
  derived and/or modified sequence opt3 from anti-influenza_Chain
augguggucaccagcaacgccgacagaaucugcacaggcauuacuuccucuaauucaccccacguugugaagacggcuacccagggggagguaaacgugacaggagucauaccucugacuaccacaccaaccaaaagucauuucgcaaaucucaaggguacugaaacaaggggcaaacuuuguccgaagugccugaacuguaccgauuuggacguggccuuagggcggcccaaaugcacgggaaauaucccuagcgcgcgcguuuccauucugcacgaggugcgaccagucacuucuggcuguuuucccaucaugcaugaucguaccaagauuagacaacuaccuaaccuccugagggguuacgaacacauccggcuuucgacacauaaugugauaaacgcugagaaugccccagggggacccuauaagaucggcacuucaggcagcugcccuaacguaaccaaugggaacggauucuuugcaacaauggccugggcuguuccaaagaaugacaacaauaagaccgcaacgaacagucugacuauugaagugccguacaucuguacagagggugaggaucagauuaccgucuggggcuuccacuccgacaacgaaacucagauggccaaauuguauggggauucuaagccccagaaauuuacaagcuccgcuaauggagugaccacgcacuacgugucacaaaucggcgguuucccuaaccagaccgaggacgggggacucccacagaguggccgcauagucguugauuauauggugcagaaaagcggcaagacagggacuauuaccuaccaaagaggaauccugcugccccagaaaguauggugcgccucugguaaguccaaagugauuaagggcucacucccuuuaaucggggaagcggacugucugcaugagaaauauggaggccuuaauaagagcaaaccauacuacacaggugagcacgcaaaggccaucgggaacugccccauuugggucaagacuccguugaaacuggcuaauggcaccaaguauaggccucccgccaaacuacucaaggaacggggauuuuucggcgcaauagcuggguuucuggagggagguugggaaggcaugaucgccggguggcauggauacacaagucacggcgcgcacgguguggccguugcagcugaucuuaaaucuacccaggaggccauuaacaagaucacuaagaaucugaacuccuugagcgaacucgaggugaaaaaucugcagcgcuuaucgggggcuauggacgagcugcauaacgaaauacucgagcuugaugaaaaggucgacgaccugcgagccgauacgauuucuucccaaaucgaguuggcagugcuacugucaaaugaaggcaucauuaacagugaggacgagcaccuccuggcccuugaaagaaaacugaagaaaauguugggaccaagcgcuguagagaucggcaauggguguuucgaaacaaagcauaagugcaaccagaccugccucgauaggauugcggcaggaacuuuugacgccggugaguucucccugccuaccuuugauucuuuaaauauaacagcugccagccugaacgacgauggccuagacaaccacaccauccuccuguauuacucaacugcagccaguucccuugcuguuacauugaugauugccaucuucguggucuauauggugagccgggauaaugucucuuguuuccauuca

SEQ ID NO: 28420 - RNA, 1728 nt, Artificial Sequence; identical to SEQ ID NO: 28419
  derived and/or modified sequence opt3 from anti-influenza_Chain

SEQ ID NO: 28421 - RNA, 1728 nt, Artificial Sequence; identical to SEQ ID NO: 28418
  derived and/or modified sequence opt3 from anti-influenza_Chain

SEQ ID NO: 28422 - RNA, 1731 nt, Artificial Sequence
  derived and/or modified sequence opt3 from anti-influenza_Chain
gccaaggcuggcgugcagagcgucaaaauggagaagaucguucuucucuucgcaauugugucccuuguaaaaucugaccaaauaugcaucggguaccacgccaacaauucaaccgaacagguggauacaauuauggagaagaacgucacugugacgcaugcgcaggacauccuggaaaagacccacaauggaaaguugugugauuuagacgguguuaagccccugauucuaagagauugcaguguggcuggcuggcuccuggggaacccuaugugugacgaguuuaucaaugucccagaauggagcuauauaguggagaaagccaacccgguaaaugaucuuugcuaccccggagacuucaacgauuaugaggaacugaagcauuugcucuccaggaucaaucacuuugagaaaauucagaucauuccuaagucuucguggucaagccaugaagcaagucugggcguuuccucugccuguccauaccaagguaaaagcuccuucuuucggaacguggucuggcugaucaagaaaaauucaacauaucccacuauaaaacgcaguuacaacaauaccaaccaggaggaccucuuagugcugugggggauucaccacccuaaugaugcugcagagcagacaaagcuguaucagaacccaaccacuuacaucagcgugggaacaucuaccuugaaccaacgacuggucccccguauugccacgagauccaaaguuaauggccagucaggcaggauggaguucuuuuggacuauccuaaagccuaacgacgcuaucaauuucgaaagcaacgggaauuuuauugccccagaauacgcguauaaaauagugaagaaaggagauaguaccaucaugaagucugagcucgaauacgguaacugcaauacaaagugucagacuccgaugggcgcaauuaacuccagcaugcccuuccauaauauccacccucugaccauaggggagugcccaaaauauguaaagucgaaccggcuugugcuggccacaggauugcgcaauucuccccagagagagaggcggcgcaaaaagcgaggccucuuuggugcuauugccggguucaucgaaggaggcuggcaaggcauggucgacgggugguacggauaucaucacuccaacgagcaggguucaggcuacgcagcugacaaagaaaguacccagaaggccaucgauggggugacgaauaagguuaacagcauuaucgacaaaaugaauacucaauuugaggcggugggaagagaguucaacaaccuggaaaggcggauugagaauuuaaacaagaaaauggaagauggcuuccuggacgucuggacauauaaugccgagcuccuugugcugauggaaaacgagcguaccuuggauuuucacgacuccaauguaaagaaccuauacgauaaaguucgccugcagcucagagacaaugcaaaggaacuggguaacggguguuucgaguuuuaccauaagugcgauaaugaguguauggaaucugugaggaacggcacuuaugacuacccucaguauagcgaggaagcucggcuuaaacgagaggagauaucaggagucaagcuggaaaguaucggcauuuaccagaucuuguccaucuauagcacaguggccucuucacucgcucuggccuuaauggucgcagggcugagucuauggaugugcagcaauggaucccuccaaugccgcauuuguaua

SEQ ID NO: 28423 - RNA, 1731 nt, Artificial Sequence; identical to SEQ ID NO: 28422
  derived and/or modified sequence opt3 from anti-influenza_Chain

SEQ ID NO: 28424 - RNA, 1737 nt, Artificial Sequence
  derived and/or modified sequence opt3 from anti-influenza_Chain
augguggucaccagcaacgccgacagaaucugcacaggcauuacuuccucuaauucaccccacguugugaagacggcuacccagggggagguaaacgugacaggagucauaccucugacuaccacaccaaccaaaagucauuucgcaaaucucaaggguacucaaacaaggggcaaacuuuguccgaacugccugaauuguaccgauuuggacguggccuuagggcggcccaagugcaugggaacgaucccuagcgcgaaggcuuccauucugcacgaaguuaaaccagugacuucuggcuguuuucccaucaugcaugaucgcaccaagauucgacagcuaccuaaccuccugcgugguuacgagaauaucagacuuucggccaggaacgucauaaaugcagaaacagccccagggggacccuauaucgugggcacuucaggcagcugcccuaacguaaccaaugggaaaggauucuuugcuacaauggcaugggccguuccaaagaacaaaaauaagaccgcuacgaacccgcugacuguggagguccccuacauuuguacaaaaggugaagaccagaucaccguguggggcuuccacagugauaaugaggcccagauggugacuuuguauggggacuccaagccucaaaaguuuacaucuagcgcgaacggagucaccacgcauuacguuucccagauuggcgguuucccaaaccagaccgaggaugaagggcuccagcaaucaggacggaucgugguagacuauauggugcagaaacccggcaagacaggcacuauagucuaccagcgcggggugcugcugccucagaaaguuuggugcgcaaguggaagaagcaaggugauuaaagguucucucccauuaaucggcgaggccgauugucugcacgaaaaguaugggggacuuaauaaauccaagcccuacuacaccggcgagcacgcuaaggccauugguaacugcccgaucugggucaaaacaccuuugaagcuggcaaaugggacuaaauauaggcccccagcuaagcuacucaaagagcggggcuuuuucggagccaucgcgggcuuucuggaagggggaugggaggguaugauugccggcuggcauggguacaccucacacggagcacauggcguggcuguagccgcugaccuuaagagcacacaagaagccauaaacaagaucaccaaaaaucugaacaguuugucugagcucgaaguuaagaaucugcagcgcuuauccggugcaauggaugagcugcacaacgagauucucgaacuugacgagaaaguggaugaccugcgagccgacacuaucagcucgcagauagaauuggcuguccuacugucuaaugaggggauuaucaacuccgaagaugagcaccuccuggcgcuugagagaaagcugaaaaagauguugggcccuucagcaguggacaucggaaauggcuguuucgaaacgaagcauaaaugcaaccaaacaugccucgauaggauugccgcugggaccuuuaaugccggagaguucagucugcccacuuuugacagcuuaaacaucaccgcagccucccugaaugaugacggucuagauaaccacacaauucuccuguauuacucuaccgcugccagcucacuugcagucacuuugaugauagcgaucuucauuguguauaugguuagucgggacaacguguuccugcuccaucuguccauccguaag

SEQ ID NO: 28425 - RNA, 1737 nt, Artificial Sequence; identical to SEQ ID NO: 28424
  derived and/or modified sequence opt3 from anti-influenza_Chain

SEQ ID NO: 28426 - RNA, 1731 nt, Artificial Sequence
  derived and/or modified sequence opt3 from anti-influenza_Chain
auggagaccaucagccugauuacaauacuccuuguggucacugccuccaacgcugacaagaucugcauuggccaccagucuaccaauucaaccgaaacaguugauacucugaccgagacaaacgugcccguaacccaugcaaaagaauuguuacacacugagcauaaugggaugcugugugccacaagucuaggacacccucucauccuggacacgugcacgauugaaggucuuguguacggcaacccaagcugugaucuguugcucgggggaagagagugguccuauaucgucgagaggucuucggcggugaauggcacuugcuacccggguaacguugaaaaucuggaggaacugcggacccucuucucaagcgcuaguuccuaucaacgcauacagaucuuucccgacacaacuuggaacgugaccuacacagggaccucucgagccuguagcggauccuucuaucguucaaugagaugguuaacgcagaagaguggcuuuuacccuguccaggaugcacaauauacuaauaacaggggcaaaagcauucuguucgugugggggauccaucacccacccacauacaccgagcagacuaaucuuuacauucggaacgacacaaccacgucuguaaccacagaggauuugaaucgcacuuuuaagccuguuaucggaccaagaccccuggugaacggucuacagggcaggauagacuauuacugguccguccucaaaccugggcagacccugcgggugcgcucaaauggaaaccuuauugccccaugguauggccacgugcugagcggugggagucauggacgaaucuugaagacagaucucaagggcggcaacugcgucguucaaugucagacugaaaaagggggacugaauaguaccuuaccguuccacaacauuuccaaguacgcuuuugguacaugccccaaauaugugagaguaaauagccugaagcucgcagugggccuuaggaacgucccugcccggucgucucgugggcuguucggagcuaucgccggcuuuaucgaggguggguggccaggcuugguggcgggaugguacggcuuccagcauuccaaugaccaggggguuggaauggcagccgaucgcgacucaacccaaaaagcuauugauaagauaacuucuaaggugaacaauaucgucgacaaaaugaacaagcaguaugaaauuaucgaccacgaguuuagcgaaguggagacgagacuaaauaugauaaacaauaaaauugaugaccagauccaagauguaugggccuacaacgcagagcugcucguucugcuugaaaaucagaagacacuggacgagcacgaugcuaacgugaauaacuuguacaacaaagucaagagggcccucgguuccaaugcgauggaagacggcaaaggguguuucgagcuguaucauaagugcgaugaccaguguauggaaaccauccggaacggaacuuacaaucgacgcaaguauagagaggagucuagguuagaacggcagaaaauugagggcgugaagcuggaaagcgaggguaccuacaaaucagggcgccuaguccccagaggcaguccuggauccggcuauaucccagaagcccccagggaugggcaagcauacgugcguaaggacggagaguggguucuccugagcacauuucuugguaaaccgauuccuaaccccuugcugggccucgauucuaccggg

SEQ ID NO: 28427 - RNA, 1731 nt, Artificial Sequence; identical to SEQ ID NO: 28426
  derived and/or modified sequence opt3 from anti-influenza_Chain

SEQ ID NO: 28428 - RNA, 1752 nt, Artificial Sequence
  derived and/or modified sequence opt3 from anti-influenza_Chain
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacucaaacaaggggcaaguuguguccgaacugcuuuaauuguaccgauuuagacguugcgcuggggcggcccaaaugcaugggaaacacgccuagcgcuaagguguccauccuacacgaagucaagccagccacuucuggcuguuuccccauuaugcaugaucgcaccaaaauccgacagcucccuaaucugcuucgugguuacgagaacauaagacugucgacaucaaaugugaucaacacugaaaccgcaccagggggacccuauaagguaggcacaagcggcaguugcccuaauguugccaacgggaauggauuuuucaacaccauggcuugggugauuccaaaagacaauaacaagacggcaaucaacccggucacuguggaggugcccuacauuuguuccgaaggugaggaucagaucacagucuggggcuuucacucugacgauaaaacccagauggagagguuguauggggacagcaauccucaaaaguucacuuccucagccaacggaguuacaacccauuacgugagucagauaggcgguuuuccaaaucagacggaagaugaggggcucaagcagagcggacggauuguaguggacuauaugguccaaaaacccggcaagaccggcacaaucguguaccagcgcgggauucugcugccucagaaaguuuggugcgcuucuggaagauccaaggugaucaaagguucacucccauuaaucggcgaagccgauugucugcacgagaaguaugggggacuuaacaaaagcaagcccuacuacacuggcgagcacgcgaaggcaauugguaauugcccgauaugggucaaaaccccuuugaagcuggccaacgggacaaaauauaggcccccagcuaagcuacucaaagaacggggcuucuuuggagccaucgcaggcuuccuggaagggggaugggaggguaugauugcuggcuggcauggguacacaagucacggagcccauggcguggcgguagccgcagaccuuaagucuacccaggaggcuaucaauaagauaacuaaaaaccugaauuauuuguccgaacucgagguuaagaaccugcaacgcuuaagcggugccaugaaugagcugcacgaugaaauucucgagcuugacgaaaaaguggacgaucugcgagcugacaccaucucgucucagaucgaguuggccguccuacuguccaacgaagggauuaucaauucagaggaugagcaccuccuggcacuugaaagaaagcugaaaaagauguugggcccuagugccguggagauuggaaacggcuguuuugaaacuaagcauaaaugcaaucagacgugccucgacaggauagcugcggggacauucaacgcaggagauuuuagccugcccaccuucgacuccuuaaacaucacugccgcuucucugaaugaugacggucuagauaaccacaccauucuccuguacuauagcacagccgcaucaagucuugccgucaccuugaugaucgcuaucuucauuguguacaugguuucccgggacaaugugagcuguucuauaugccug

SEQ ID NO: 28429 - RNA, 1752 nt, Artificial Sequence
  derived and/or modified sequence opt3 from anti-influenza_Chain
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuuguacagaaggagaggaucagaucaccgugugggguuuccauucugacgauaaaacucagaugaagaaucuguacggcgacagcaacccccaaaaguuuacauccucagcaaauggggugaccacgcacuaugucagucagauuggaggcuucccugaucagaccgaggacggugggcucccacagagcggacgcaucguuguggauuacaugaugcaaaaacccggcaagacaggcacuauaguauaucagagagggguguuacugccucagaaagucuggugcgccucuggaagguccaaggugauuaaagguucacuuccauugaucggcgaagcugacugucugcaugagaaguacgggggacuaaacaaaagcaagcccuacuauaccggcgaacacgccaaggcaauugguaacugcccgaucuggguuaaaacaccucucaagcuggcuaaugggacuaaauaccggcccccagccaaacuucugaaggagcgcggcuuuuucggagcgaucgccggcuuuuuggaagggggaugggaagguaugauugcaggcuggcacggguauaccagucauggagcucacggcguggccgucgcugccgaccucaagucuacacaggaggcaauaaacaagaucaccaaaaaucugaacuccuuaagcgaacuggaggugaagaaucuccaacgacuuucgggugccauggaugaacugcauaacgagauuuuggagcuagacgaaaaaguagaugaccugagagcugauacuaucucuucccagauagagcucgcgguucugcuuucaaaugaagggauuaucaacagugaggacgaacaccuguuggcacucgagaggaagcugaaaaagauguuaggcccuagcgccguggauaucggaaauggcuguuucgagacgaagcacaaaugcaaccagacaugccuggaccggauugcugccgggaccuuuaaugcaggagaguucucccuacccacuuuugauucucucaacaucaccgccgcuagccugaaugacgauggucuugacaaccauacaauuuugcuguacuauucaaccgccgcaaguucccucgcggucacucugaugcuugcuauauucaucguguacauggucagccgugacaaugugucuuguucaauuugccug

SEQ ID NO: 28430 - RNA, 1752 nt, Artificial Sequence
  derived and/or modified sequence opt3 from anti-influenza_Chain
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaagucaagccagugaccucuggcuguuuucccauuaugcacgaccgaacaaagauccgucaacugccuaaucuucugagagguuaugagaacauaagguugucgacucagaauguaaucgaugcagaaaaagccccagggggacccuaccggcucggcaccucaggcagcugcccuaacgcuacaaguaaguccggguucuuugcaaccauggccugggcuguuccaaaagacaauaacaagaaugccacgaacccgcugacuguggagguccccuauauuuguacagaaggagaggaucagaucaccgugugggguuuccauucugacgauaaaacucagaugaagaaucuguacggcgacagcaacccucaaaaguuuacauccucagcgaauggggugaccacgcacuaugucagucagauuggcagcuucccagaucagaccgaggacggaggucucccccagucugggcgcaucguuguggauuacaugaugcaaaaaccuggaaagacaggcacuauaguauaucagagaggcguguuacugccacagaaagucuggugcgcauccgggaggucaaaggugauuaaaggaagccuucccuugaucggugaagccgacugucugcaugagaaguacggcgggcuaaacaaaaguaagccguacuauaccggagaacacgcuaaggccauuggcaacugcccuaucuggguuaaaacaccccucaagcuggcaaaugguacuaaauaccggccuccagcuaaacuucugaaggagcgcggguuuuucggcgccaucgcgggauuuuuggagggcgggugggaaggaaugauugccgguuggcacggcuauaccucucauggggcacacggaguggcugucgccgcugaccucaaguccacacaggaggccauaaacaagaucaccaaaaaucugaacagcuuaucggaacuggaggugaagaaucuccaacgacuuucuggcgcaauggaugaacugcauaacgagauuuuggagcuagacgaaaaaguagaugaccugagagccgauacuaucuccucacagauagagcucgcuguucugcuuaguaaugaagguauuaucaacagcgaggacgaacaccuguuggcgcucgagaggaagcugaaaaagauguuagggcccuccgcaguggagaucggcaauggauguuucgaaacgaagcacaaaugcaaccagacaugccuggaucggauugccgcuggcaccuuuaaugccggggaguucucucuaccaacuuuugacagccucaacaucaccgcagccucacugaaugaugacggacuugauaaccauacaauuuugcuguacuauaguaccgcugccuccagccucgcagucacucugaugcuugcgauauucaucguguacauggucucucgugacaaugugucauguaguauuugccug

SEQ ID NO: 28431 - RNA, 1752 nt, Artificial Sequence; identical to SEQ ID NO: 28428
  derived and/or modified sequence opt3 from anti-influenza_Chain

SEQ ID NO: 28432 - RNA, 1752 nt, Artificial Sequence; identical to SEQ ID NO: 28429
  derived and/or modified sequence opt3 from anti-influenza_Chain

SEQ ID NO: 28433 - RNA, 1752 nt, Artificial Sequence; identical to SEQ ID NO: 28430
  derived and/or modified sequence opt3 from anti-influenza_Chain

SEQ ID NO: 28434 - RNA, 1758 nt, Artificial Sequence
  derived and/or modified sequence opt3 from anti-influenza_Chain
augaaggccaucauugugcugcucauggucguuaccagcaacgcugacagaauaaucugcacaggcauuacuuccucuaauucaccccacgugguaaaaacggcaacccagggggaggugaacgucacaggagugaucccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauauuccuagcgcucgcguguccauccuccacgagguccgaccagugacuucuggcuguuuucccauaaugcaugaucguaccaagaucagacaacugccuaaccuucugagggguuacgaacacauucgguugucgacacauaauguaaucaacgccgagaaugcaccagggggacccuauaaaauuggcacuucaggcagcugcccuaacguuaccaaugggaacggauucuuugccacaauggcuugggcagugccaaagaaugacaacaauaaaaccgccacgaacagucucacuaucgaagucccguacauauguacagagggugaggaucagauuaccguguggggcuuccacuccgacaacgaaacucagauggcuaagcuguauggggauucuaaaccccagaaguuuacaagcuccgccaauggagugaccacgcacuacgucucacaaaucggcgguuucccuaaccagaccgaggacgggggacugccacagaguggccgcauuguuguggauuauaugguacaaaagagcggcaaaacagggacuaucaccuaccagagaggaauccucuuaccccagaagguguggugcgcgucugguagguccaaagucauuaagggcucacugccucuuauaggggaagcagacuguuugcaugagaaauauggaggccugaauaagagcaaaccauacuacacaggugagcacgccaaggcuaucgggaacugccccauuugggugaagacuccgcuaaaacucgccaauggcaccaaguaucggccucccgcaaaacugcuuaaggaacgcggauuuuucggcgcuaucgccggguuucuggagggagguugggaaggcaugauagcgggguggcauggauacacaagucacggcgcccacgguguugcaguggcugccgauuugaaaucuacccaggaggcuauuaacaagaucacuaagaaucucaacucccugagcgaauuagaggucaaaaaucugcagcgacucucgggggccauggacgagcuucauaacgaaauccuggaguuggaugaaaagguggacgaccuaagagcagauacgauuucuucccaaaucgagcuggccguacuccugucaaaugaaggcauuauaaacagugaggacgagcaccuucuggcuuuggaaaggaaacucaagaaaaugcugggaccaagcgcgguugagaucggcaauggguguuucgaaacaaagcauaagugcaaccagaccugcuuagaucggauugcagccggaacuuuugacgcuggugaguucucccugccuaccuuugauucucuaaauaucacagccgcaagccucaacgacgauggccuggacaaccacaccauccuuuuguauuacucaacugccgcuaguucccuggccgugacacucaugauugcaauauucgucguguauauggucagccgugauaaugugucuuguucaaucugccug

SEQ ID NO: 28435 - RNA, 1758 nt, Artificial Sequence; identical to SEQ ID NO: 28434
  derived and/or modified sequence opt3 from anti-influenza_Chain

SEQ ID NO: 28436 - RNA, 1749 nt, Artificial Sequence
  derived and/or modified sequence opt3 from anti-influenza_Chain
auggaggccagacugcucgugcuucugugcgcuuucgcagccaccaacgcggacacaaucuguauuggcuaccacgcuaauaacagcacugauacggucgacaccguuuuggaaaagaaugugacaguaacucauuccgugaacuuacuggaggauucucacaaugggaaacuaugcaagcucaaaggaauagcuccccugcagcuugguaaguguaacaucgcaggcuggcuguuggggaauccugaaugcgaccuccugcugaccgccucaaguuggagcuauauugucgagacauccaacucugaaaauggaaccuguuacccaggcgauuuuaucgacuaugaggagcucagggaacaauuaucgucagugagcaguuucgagaaauuugaaauuuucccgaagacuuccucuuggcccaaccaugagacaaccaaggguguuacggcugcaugcagcuacgccggggcuuccucauuuuaucggaaucugcuuugguugacuaaaaagggaaguagcuacccuaaacugucuaaguccuaugugaacaauaaaggcaaggagguccuagugcucuggggcguacaccauccacccaccgggacagaucagcagucacuguaccagaacgccgacgcguacguuagcgugggaaguucuaaguauaaucgccgauucacuccugaaaucgcagcccguccaaaagucagagaucaagcugguaggaugaacuacuauuggacccuucuggagcccggcgacacaauaaccuuugaagccacggggaacuugaucgcaccuugguacgcuuucgcccucaaucggggauccggcagcgguauuaucacuucggaugcgccagugcacgacuguaacacaaagugccagaccccgcacggggccauuaauucuucccugcccuuucagaacauccauccugugacuauaggagaguguccaaaauauguccgcucaacaaaguuaagaauggcaaccggccugaggaauauucccaguauccagagccggggccucuucggggcuauugccggauuuaucgaagguggcuggacggggaugaucgauggaugguacggcuaucaccaucaaaacgagcaggguuccggguacgcugccgaccagaaaucuacccagaaugcaauugacggcauaacaaacaagguuaauagcgugaucgagaaaaugaacacucaauucaccgccguaggaaaggaauuuaauaaccuugagcgccgaauugaaaaucugaacaagaaaguggaugacggcuucuuggauaucuggacauacaaugcugagcuacugguccuccuggaaaacgagagaacucuugacuuccacgauucaaacgugaggaaucuguaugagaagguuaaaagucaguugaagaacaaugcgaaagaaauagggaacggaugcuuugaguucuaccacaagugugacgaugcaugcauggaauccgugcggaaugguaccuaugacuacccuaaguauagcgaggaaucuaaacucaaccgugaggagauugauggcgucaagcuggaaucaauggggguguaccagaguggacgcuuaguaccaagaggcagccccgguuccggguauaucccggaggccccuagggacggccaagccuacguucggaaagauggagaaugggugcugcuaucuacauuucucggcaagcccaucccaaauccucugcuuggguuggacucgaccgga

SEQ ID NO: 28437 - RNA, 1749 nt, Artificial Sequence; identical to SEQ ID NO: 28436
  derived and/or modified sequence opt3 from anti-influenza_Chain

SEQ ID NO: 28438 - RNA, 1755 nt, Artificial Sequence
  derived and/or modified sequence opt3 from anti-influenza_Chain
auggagagaaccgugcugcuccuugccacagucagccugguuaaguccgaccagaucugcauuggcuaccacgcuaacaauucuacugaacaaguggauacgauaauggagaaaaacguaaccgugacacaugcacaggacaucuuggaaaggacucacaaugggaaguuaugugaucugaacggagucaaaccccuaauucuccgggacugcucaguggccgguuggcugcuuggcaauccuaugugugaugaguucaucaacguuccagaauggaguuauauuguggagaaggcgagcccggcuaaugaccugugcuaccccgggaacuuuaaugauuaugaggaauugaaacaucuccugucccgcaucaaccacuucgagaagauacagaucauuccuaagucuucguggucaaaucaugacgccagcaguggagucuccucugcauguccauaccugggccgaagcuccuuuuuccguaacgugguauggcucaucaaaaagaacucagccuaucccaccauuaaaagaaguuacaauaauacaaaccaggaagauuuacugguucuuuggggugugcaccacccuaacgacgcugcagagcaaaccaaguuguaucagaauccaacuacauacaucagcgucgggaccucuacgcugaaccagaggcuagugcccgagauagccacucggccuaaagugaauggacaguccggccgcauggaauuuuucuggaccauucucaagccaaacgaugcuaucaauuuugagucaaacggcaauuucauugccccggaauacgcguauaagaucgucaaaaagggggacagcacaaucaugaaaagugagcuggaauacggaaacugcaauacuaagugucaaacccccaugggugcaauuaacucuuccaugccuuuucauaauauacacccacuuacaaucggcgagugccccaaauauguuaagagcaacagacugguguuggccaccgggcucaggaauacgccucagcgggagcgccgaaggaaaaagagaggacuguucggcgcuauugccgguuuuaucgaagggggauggcagggcaugguagauggcugguacggguaucaucacucgaacgagcagggaucuuguuacuccgcagacaaggaaucaacucaaaaagcuauagacggugugacaaauaaggucaacaguauuaucaacaaaaugaauacccaguucgaggccgugggccgggaauuuaacaauuuagagcgucgcaucgagaaccugaauaagaaaauggaagauggguuccucgacguuuggacuuauaacgcggagcuucugguguugauggaaaaugagagaacacuagauuuccacgacagcaacgucaagaaucuguacgauaaggugaggcuccagcugcgggacaacgccaaagaacuuggaaauggcugcuuugaguucuaccauaagugugauaacgagugcauggaauccguuaaaaaugguaccuaugacuacccacaauauucugaggaagcacgacugaaccgcgaggagauuagcgggguaaaguuggaaucaaugggcacguaccagaguggaagacucgugcccaggggcuccccggggagcggauauaucccugaggcuccccgggauggucaggccuacguccgcaaagacggcgaaugggugcuguuaucuaccuuucuggggaagccaauuccuaauccccuacucggacuggauucaacaggc

SEQ ID NO: 28439 - RNA, 1755 nt, Artificial Sequence; identical to SEQ ID NO: 28438
  derived and/or modified sequence opt3 from anti-influenza_Chain

SEQ ID NO: 28440 - RNA, 1947 nt, Artificial Sequence
  derived and/or modified sequence opt3 from anti-influenza_Chain
augggcgacaagaucaacuucauuuuugggauacacaaucaucagccccugggaaacuucgguuggguguuugaggaagccuacgagaaaugcuauuggccuuuccucgaaacccuugaggaauacccaaauaugaaggucgcuauccacacaagcggcccgcugauugagugguugcaagauaacagacccgaguauaucgacuuacugaggucccuaguuaaacggggacagguggaaauuguaguggcaggguuuuacgagccuguccucgccucuaucccaaaggaagaucgcauagagcagauccgacugaugaaagagugggcgaagucaauuggcuucgacgcucgugguguguggcuuacugaaagaguuuggcagcccgagcuggugaagacguugaaagaaagugggaucgauuaugucauuguggacgauuaccauuuuaugagcgccggacucuccaaggaggaacuguauuggccuuacuacaccgaggacggcggcgagguaaucgcaguuuucccaauagaugaaaaacugagguaucucauucccuuucggccuguggacaaggucuuagaguaccugcacucucuuaucgauggggacgaaucgaaaguggccguguuccaugaugacggagagaaguuugguauuuggccaggcacauaugaaugggucuacgagaaggggugguugcgcgaguucuuugacagaaucucaagcgaugaaaagaucaaucugaugcuauauacugaguaccucgaaaaguauaaaccgaggggacugguuuaccuucccauugcuaguuacuucgagauguccgaauggucucugccugcaaagcaagcccgguuguucguggaguuuguaaacgagcucaaagugaagggcauauucgaaaaauaucgcgucuuugugcgaggugggaucuggaagaauuucuuuuacaaguauccagagagcaacuacaugcacaaaagaaugcugaugguuuccaaguuagugaggaauaaccccgaagcucggaaauaucugcuccgugcccaguguaaugacgcguacuggcacggacuuuucggcggcgucuaucugccucauuugcgcagagcaauuuggaacaaucuaaucaaggccaacucauacgugagucuggggaaaguaauaagggauauugacuacgauggauuugaggagguucucaucgaaaaugacaacuucuaugcuguguuuaagccaagcuacgguggcucucuggucgaguucuccucaaagaaccggcuugugaauuaugucgaugugcuggcccgacgcugggaacacuaccauggguauguugagagccaguuugacggaguggcaaguauccacgaauuggagaaaaagauucccgaugagaucagaaaagaaguagcuuacgacaaguauaggcgguucaugcuccaggaucacgucgugccgcugggcaccacauuagaggacuuuauguucucucgccaacaggaaauuggugaguucccuagaguucccuacuccuacgaacugcuagacgggggcauaaggcucaaacgugagcaucugggaaucgagguggaaaagaccgucaaacuugugaacgauggcuuugagguagaauauauugugaauaacaaaacugggaauccaguuuuguucgccgucgagcugaacguggcggugcagagcaucauggaaucgccuggaguccuccgggguaaggagaucguuguggacgauaaauacgccgugggcaaguuugcacugaaauucgaggacgaaauggagguauggaaguaucccgucaagacacuuucucaguccgaaucagggugggaucugauucaacagggagugaguuacauaguuccaauccgauuggaggacaaaauuagauuuaagcucaaauucgaggaagcuagcggc

SEQ ID NO: 28441 - RNA, 1947 nt, Artificial Sequence
  derived and/or modified sequence opt3 from anti-influenza_Chain
augagcagaaugacccugaaguccucuaugaaaaagagggugcucucacuucugaucgccgucguuuucuugaguuuaacaggcguguuucccagcgggcugauugagacuaaaguauccgcugcaaagauaacggaaaacuaccaguucgacucucggauccgccuaaauucgauuggauuuaucccuaaccacagcaaaaaggccaccauugcggcuaauugcucaacauucuauguggucaaggaggaugguacuaucguguacaccggcacagccaccaguauguuugacaacgauacuaaagaaacaguuuauauagcagacuucuccucugugaaugaggaagggaccuacuaucucgccgucccaggagugggcaagagcguaaacuuuaaaaucgcuaugaauguuuacgaggaugcauucaagacggccaugcuggguauguaucuucugcgaugugggacuuccgugucagcuaccuacaacgggauucauuacagucacggcccgugccauacaaaugacgccuauuuggauuacaucaacggccaacacacuaaaaaggacagcaccaagggguggcaugaugcgggagacuauaauaaauacgucgugaacgcagguauuacagugggcucuauguuucucgccugggagcacuucaaggaucagcuggaacccgucgcucuggagaucccugagaaaaauaacuccauaccagacuuucucgaugaauuaaaguaugagauugacuggauccugaccaugcaguaccccgacgggucaggacguguugcccacaaagugagcacgagaaauuucggcgguuuuauuaugccugaaaacgagcaugaugaaagguucuucguaccauggaguucugcagcuacugccgacuuuguggcgaugacagccauggcagcucggaucuuccgccccuaugauccucaguacgccgagaaguguaucaacgcugccaaagucuccuacgaauuucuuaagaauaacccagcaaauguguucgccaaccaaagcggguuuucgaccggagaguaugcuacuguuucugacgcggaugacagauugugggcagccgcugagaugugggaaacacugggcgaugaggaauaccuaagggacuucgagaaucgggccgcacaguuuuccaagaaaauugaagccgauuucgacugggauaacguggcuaaucucggcauguuuaccuaucugcuuucagagcgcccggggaagaaccccgcccugguccagaguauaaaagacagcuugcucuccacggcagacucuaucgugcgaaccagccagaaucacggauacgguagaacacugggcacuaccuauuacugggggugcaacggaacaguaguuaggcaaacuaugauuuuacagguggcgaauaagaucucaccuaacaaugauuaugucaacgcugcccuggacgcaauaagucauguguucggccggaauuacuacaaccguuccuaugucaccggucucgggauuaacccacccaugaauccucacgaucgcagaagcggcgccgacggaaucugggagccauggcccggcuaccuugugggaggagguuggccgggcccuaaagauuggguugacauccaggauucuuaucagacaaacgaaauugcuaucaauuggaacgccgcacugauuuacgcuuuggccggguuugugaauuauaacucaccccaaaaugagguacuauacggagacgucaacgaugacggcaaggugaauaguaccgaucugacucuccugaagagguauguucuuaaagcggugagcacgcugccauccucuaaggccgagaaaaacgcugacgucaaucgggauggucgagugaacucgagcgacguaacaauauugucccgcuaccucaucagagugauugaaaagcugccuauc

SEQ ID NO: 28442 - RNA, 1947 nt, Artificial Sequence; identical to SEQ ID NO: 28440
  derived and/or modified sequence opt3 from anti-influenza_Chain

SEQ ID NO: 28443 - RNA, 1947 nt, Artificial Sequence; identical to SEQ ID NO: 28441
  derived and/or modified sequence opt3 from anti-influenza_Chain

SEQ ID NO: 28444 - RNA, 2046 nt, Artificial Sequence
  derived and/or modified sequence opt3 from anti-influenza_Chain
augaagcccagccacuucaccgagaaaagauuuaugaagaaagugcugggccucuuccuugucguugugaugcuggccuccguagggguguugccuacaucuaagguccaggcugcaggaacuacggugaccucaauggaauacuuuaguccagccgacgguccgguuaucagcaaauccggcguggggaaggcgucuuauggauucgucaugcccaaguuuaacggcgguucggcuacauggaaugauguguacucagacguagggguuaacgugaaagucggaaauaacuggguggauauugaccaggccggcggcuauauauacaaucagaacugggggcauuggagcgauggagguuucaauggcuauugguuuacuuuaagugcaaccacagagauccagcuguacuccaaggccaacggggugaaacuagaauaucagcucgucuuccaaaauauuaacaagaccacuaucacagcuaugaauccuacccagggaccacagauuacggcaucuuuuacuggcggugccggguucaccuaccccacauuuaacaaugacagcgcuguuacuuacgaggccguggcggaugaccugaaaguauaugugaagccugucaacuccucaaguuggaucgauauagacaauaacgcagccagcggauggaucuacgaucacaacuucggccaguuuaccgacggcgggggagguuauugguucaaugugacagaaucuauuaacguuaaacuugaguccaagaccucaagcgcuaaucugguguacacgaucacuuucaacgagccaacaaggaauaguuaugucauuacccccuacgaaggcacuacauuuaccgccgaugcaaacgggucuaucggaauaccuuugccaaagauugacggcggugcuccgaucgccaaagagcucgggaauuucguguaucaaauuaacaucaauggccaguggguagaccuguccaacagcucgcagucuaaguuugcguacuccgccaauggauacaacaauaugucagaugcaaaccaguggggcuauugggcugacuacaucuaugggcugugguuccaacccauucaggaaaauaugcagauacggaucggauacccucucaacggucaagccggcgggaacauuggaaauaacuuuguuaauuauacguucaucggcaacccaaaugcuccccgcccugaugugagugaccaggaggauauaagcauugguaccccaacagaccccgccaucgcagggaugaacuuaaucuggcaggaugaguuuaauggcacuacccuggacacauccaaauggaacuacgaaacuggauauuaccuuaauaacgauccggccaccuggggcugggggaaugcugaguugcagcauuacacaaacucuacccaaaaugucuaugugcaggacggaaagcugaacauuaaagcgaugaaugauagcaagucauucccucaggaccccaaccgauacgcacaguauaguuccgguaagaucaacacuaaagacaagcuaagccucaaauacggccgugucgauuuuagagccaagcugccaacgggggacggaguguggccugcucuuuggaugcugcccaaagauucuguuuauggcacaugggccgcaucaggugaaauugacgugauggaggccagggggcgguugccaggcaguguaagcggaaccauacacuucggcgggcaauggcccgucaaucaguccucuggaggcgauuaccauuuuccugaaggucagacuuucgcuaacgacuaucacguguacucgguugugugggaggaggauaauaucaagugguacgucgacgggaaguuuuucuauaaagugaccaaccagcaaugguacagcacagccgcaccaaauaacccgaaugcgcccuucgaugaaccuuuuuaucucauuaugaaccuggcuguaggaggcaauuucgacgguggccgcaccccaaacgccuccgauauccccgcaacuaugcaaguggacuacguuagagucuauaaggagcag

SEQ ID NO: 28445 - RNA, 2046 nt, Artificial Sequence; identical to SEQ ID NO: 28444
  derived and/or modified sequence opt3 from anti-influenza_Chain

SEQ ID NO: 28446 - RNA, 2058 nt, Artificial Sequence
  derived and/or modified sequence opt3 from anti-influenza_Chain
augaccaagagcaucuacuucucccugggcauucacaaccaucagcccguggggaauuuugacuucgucauagagagagccuaugaaaugucuuacaaaccucucaucaacuuuuucuuuaagcacccagauuucccgauuaauguucauuuuucaggauuccuucuguugugguuagagaaaaaccaccccgaauauuuugagaagcugaaaaucauggcugaaaggggucaaauugaguucgugaguggcggguuuuacgagccuauccuaccaauaauccccgacaaggauaagguacagcagauuaaaaagcucaauaaauauaucuacgacaaguucggacagacaccuaaaggcauguggcuggcagaacgggugugggagccacaucuugucaaguauauugccgaagcggguaucgaguacgugguuguggaugacgcucacuuuuucagcgucgggcugaaggaggaagauuuguucggauacuaucucauggaggaacaaggcuacaaacuggccguguuucccauauccaugaagcugcgcuaucucauuccuuucgcagacccagaggaaacuaucacguacuuagauaaauuugccucugaggacaagucgaaaauugcucugcuuuucgaugacggcgagaaguuuggguuguggccggauaccuaucgaacaguauacgaagagggauggcuggaaacuuucguuucaaaaaucaaggagaacuuucuacucgugacccccgucaaucuguauacauacaugcagcgugugaagccuaaagguagaaucuaccuuccaaccgcaagcuauagggaaaugauggagugggugcuguuccccgaggcccagaaggaauuggaggaacucgucgagaaacugaagacugaaaacuuaugggacaaauuuaguccuuacguuaagggcggguucuggcggaauuuucuggcuaaguaugacgaguccaaccacaugcagaaaaagaugcucuacguguggaaaaagguacaagauucuccaaaugaggaagugaaagagaaggccauggaagaggucuuccagggacaggcgaacgacgcauauuggcauggcauuuuuggugggcuuuaccugccccacuugcgcacagccauauaugagcaucuaaucaaggcugaaaauuaccuggagaacagcgaaauuagauucaauaucuucgauuuugacugcgauggaaacgacgagauaauuguggaauccccguucuuuaaccucuaccugucaccuaaucacggcggcaguguucuugagugggauuucaaaaccaaggccuuuaaccugacgaauguguugacuaggcggaaagaggcauaucacagcaagcucucuuacgucaccuccgaagcucaggggaaaucaauccaugagcgcuggacagccaaggaagagggacuggaaaacaucuuauucuaugacaaucaccgaagagugagcuuuacugagaagauuuucgagagugaacccguacuggaggaucuauggaaagacucuuccaggcucgaaguugauagcuuuuacgagaacuaugacuacgaaaucaauaaggacgagaacaaaauucgggugcuguucucgggugucuuucguggcuucgagcuuuguaagucuuauauauuguacaaagauaaguccuuuguggacgucguguacgaaaucaaaaauguuucagagaccccaauuagucugaacuucgggugggaaaucaaucucaacuuccuggcgccuaaucaucccgauuauuacuuucuuaucggagaccaaaaguauccacugagcuccuucggcauugagaaggugaacaauuggaaaauauuuucugguaucgggauugaguuggaaugcguacucgaugucgaggccagccuguaccgcuaucccaucgaaacagugucauuaagugaggaaggcuucgagagaguuuaccagggauccgcacugauucacuuuuauaagguggaccuaccugucggcagcaccuggaggacgacuauccgguucugggugaaa

SEQ ID NO: 28447 - RNA, 2058 nt, Artificial Sequence; identical to SEQ ID NO: 28446
  derived and/or modified sequence opt3 from anti-influenza_Chain

SEQ ID NO: 28448 - RNA, 2115 nt, Artificial Sequence
  derived and/or modified sequence opt3 from anti-influenza_Chain
augcccaccaaccuguucuuuaaugcccaccauagcccugugggcgcuuucgcauccuuuacacucggguucccaggaaagucugguggccuugaccuggaguuggccagaccgcccaggcagaacgucuuaaucgggguugaaucacugcacgagaguggacuauaccaugugcucccuuuucuggaaacugcggaggaagaugagagcaaacgguaugacauugagaauccagaucccaacccucaaaagccaaauauacuuauccccuucgcuaaagaagagauucagcgcgaauuucacguagccacggacaccuggaaggcaggcgaucugacauucacuaucuacuccccugugaaagccgucccaaacccggagaccgcugacgaggaagaguugaagcucgcacuggugcccgccguuauuguggaaaugacaaucgauaauaccaacgguacucgagcucguagagccuuuuucggguuugagggaacagacccuuauaccucuaugaggcggauagaugacacgugcccacagcugcgcggcgucggccaggggagaauccucucgauugugucaaaggaugaaggaguaaggagcgcguuacauuucaguauggaggacauccugacugcacaacuugaggaaaauuggaccuuugguuugggcaaaguuggggcccugauuguggauguccccgcuggagagaagaaaacauaccaguucgccguguguuucuaucggggcgguuacgugacugcagggauggacgcuuccuauuuuuacacccgcuucuuucagaacaucgaagaggucggacuauacgcccucgaacaggcggagguucugaaggagcaaucuuuccgaagcaauaaacuuauagaaaaggaguggcuguccgacgaucagacauuuaugauggcccacgcaauuagaucauauuacggcaacacccaguugcucgaacacgagggcaagccuaucugggugguaaaugaaggggaguauaggaugaugaacacguucgaccugacuguggaucaguuauuuuucgagcugaaacucaauccauggacagucaagaacgugcuugaccuguacguugaacgguauaguuacgaggaucgugugcgcuuucccggagaagagaccgaguauccgagcgguauuucuuucacucaugacaugggcgucgcuaacacauuuuccagaccucacuacucaagcuacgaauuguaugggaucaguggaugcuucucucauaugacccacgagcagcuagugaauuggguacugugugccgcuguuuacaucgaacaaacgaaagauugggccuggagggacaagcggcucgcaauucuggagcagugccuugaauccauggugcgacgcgaucaccccgacccagagcaaagaaacggcgucaugggucuggauagcaccaggacaaugggcggggccgagauaacuaccuaugacucguuggacgugucucucggacaggcucggaauaaccuguacuuagcgggcaaauguugggcagccuaugucgcucuggaaaagcuauuucgcgauguggggaaagaggaacucgccgcacuggccggagagcaggcugaaaagugcgccgcaacaaucguuucccaugugacugacgaugguuacauuccugcgaucaugggcgaggggaaugacucaaagauaauucccgcuaucgagggacuuguauucccauauuucaccaacugucacgaagccuuggaugagaauggcagauuuggugcauacauccaggcccugaggaaccaucuccaauacguccugcgugaagggauuugccuuuuccccgacggcggauggaaaaucaguagcacauccaauaacucuuggcugagcaagauuuauuugugucaguuuauagcucggcacauccucggcugggagugggaugaacaggggaaacgagccgacgcagcucauguggccuggcugacccacccuacuuuaucaauuuggaguugguccgaucagaucaucgcgggagagauuacggguagcaaguacuauccaagaggcguuacaucuauacuguggcuagaggaaggggag

SEQ ID NO: 28449 - RNA, 2115 nt, Artificial Sequence; identical to SEQ ID NO: 28448
  derived and/or modified sequence opt3 from anti-influenza_Chain

SEQ ID NO: 28450 - RNA, 2148 nt, Artificial Sequence
  derived and/or modified sequence opt3 from anti-influenza_Chain
auggaggacuucgugagacagugcuuuaaccccaugaucgucgaacuggccgagaaggcuaugaaagaauacggcgaggaucucaagauugaaaccaauaaauucgcagccauauguacacaccuugagguuugcuuuauguauagcgacuuccauuuuaucaacgagcaaggggaauccauuaucguggagccugaagauccaaaugcgcuguugaagcacagguucgagauuaucgagggacgggaccgcacuauggcuuggacgguagugaacucuauauguaauaccacaggugccgaaaaaccgaaguuuuuacccgaucuguacgacuauaaggagaaccgauucaucgaaauuggcgucacucguagagaggugcauaucuacuaucuagaaaaagcaaauaagauuaaaucagagaagacccacauccauauauuuaguuucacaggggaggaaauggccaccaaagcugauuacacucucgacgaggaaagcagggcacggauuaagacacgccuguuuaccaucagacaggagauggccuccaggggacuuugggauucuuuccggcagucggaacgcggcgaggagacgauugaagaacgauuugaaaucacugguaccaugagaaggcuggcugaccagucauugccuccaaacuucagcugccucgagaauuuccgggccuauguugauggguuugaacccaacggauacaucgagggcaagcugagucaaauguccaaagaggugaaugcgcguauugaaccuuuccugcgcacaacuccaagacccauaaggcucccugacggcccaccguguuuucagcggucuaaguucuuacugauggauagccuuaaauuguccaucgaggaccccucacacgaaggggaggguauuccucuguacgacgcaaucaagugcaugcgaaccuuuuucggauggaaagagccaagugucgugaagccccacggcaaagggauaaacccuaauuaucuacucagcuggaagcagguacuggccgaacuucaggauauugagucugaagagaagaucccacgcaccaaaaacaugaagaaaacaucccaacugaagugggcuuugggagaaaauauggcccccgagaaaguugacuuugaugacuguaaggauaucucagaccucaagcaguacgauagcgacgagccggaacugagaaguuuaucuuccuggauucagaacgaguucaacaaagcaugcgaacugacggauagcaucuggauugagcucgacgaaauaggcgaggauguggcuccuaucgagcauauugccucgaugaggcggaauuauuuuacugcggaagucucucacugucgcgccacagaguacaucaugaaggguguguauaucaacaccgcacuucugaaugcuuccugcgccgcuauggacgacuuccaguugauucccaugauaucaaaauguagaacuaaggaagggaggcguaaaacaaaccuauacggauuuaucauuaagggccggagucaucugcgaaaugauaccgacguggucaacuucguuagcauggaguuuucccucacggauccaagacuggaaccucacaagugggagaaauauugcgugcuugagaucggcgacaugcuguugaggucugccauugggcaaguaagccgccccauguuccucuacgugcggaccaauggaacaucaaagaucaaaaugaagugggguauggaaaugagaaggugccuguuacagagucugcagcaaauagaguccaugaucgaagcagagagcucugucaaagagaaggauaugacuaaggaguucuuugagaaccgcucagaaaccuggccaauuggcgagagucccaaagggguggaagagggaagcaucggcaagguuugucgaacacuacucgccaaauccguguucaauucucuguacgcuucgccucagcuugaggguuuuagcgcggaaucccggaaguugcugcucauuguccaggcacugcgugacaaccuugagccagggacuuucgaucugggcggauuguaugaagccaucgaggaaugccucauaaaugacccgugggugcuguuaaacgcuucaugguuuaauaguuuccugacccacgcccuaaga

SEQ ID NO: 28451 - RNA, 2148 nt, Artificial Sequence; identical to SEQ ID NO: 28450
  derived and/or modified sequence opt3 from anti-influenza_Chain

SEQ ID NO: 28452 - RNA, 2256 nt, Artificial Sequence
  derived and/or modified sequence opt3 from anti-influenza_Chain
augaacaucaaucccuacuuccuguuuauugacgugccuauacaggccgcuaucagcaccacauucccauauacuggcgucccgcccuacucccacgggacgggaaccgguuauacaauugauacuguuaucagaacccaugaguacucuaacaagggcaaacaauauauuucagacgugacagggugcguaaugguggauccuaccaauggaccacuccccgaagacaacgagccuagugcauacgcccagcuugauuguguccuggaagcguuggacaggauggaugaggaacacccaggcuuauuucaggcugguagccagaaugccauggaggcacugauggugacuacaguugacaagcuaacccaagggcggcagacguucgauuggacugugugccgcaaccagcccgccgcuaccgcacucaauacaacuaucaccuccuuucgacugaacgaccuuaauggagccgauaaaggcggccuggucccuuucugucaggacauaaucgauucuuuggacaagccagagaugauuuucuucacagugaaaaacaucaagaagaaacucccggcuaagaaucguaaaggguuucugauuaagagaauccccaugaaaguaaaggacaggauaacccggguugaauauauuaagcgcgcccugucgcucaacacgaugacuaaagaugcggagagaggaaaguuaaaaaggcgggcaaucgccacagcugguauucaaauccgcggcuucgugcuggucguggaaaaucuugccaagaacaucugcgagaauuuggagcagucagggcugccugugggaggcaacgaaaagaaggcaaaacuaagcaacgcugucgccaagaugcucaguaauuguccacccggugggauuuccaugaccguuacuggagacaacacaaaguggaaugagugccugaacccucgaauauuucuugcgaugaccgaaagaaucacgagggauucuccaauuugguuccgggacuuuuguagcaucgcccccgugcuguucuccaauaaaauagcacguuugggcaagggcuucaugauuaccucaaaaacaaagcgccucaaagcucagaucccgugcccugaucuguuuaacauccccuuagagagauacaaugaagagacuagggccaagcugaagaaacucaagccauucuuuaacgaggaagggaccgcuagucuuagcccuggaaugaugauggguauguucaauaugcugucuacaguauugggcguggccgcacuagggauuaaaaacaucggaaauaaggaguaccugugggacggccuccaguccucagaugacuuugcccuguucgucaacgcuaaagaugaagagacuuguauggaagguauuaaugacuuuuaucggaccugcaaacuucuggggauaaacaugagcaagaaaaagaguuacuguaaugagacaggcauguucgaguuuaccucuauguucuaucgagauggauuuguguccaacuucgcgauggaauugcccagcuuuggcguugcaggggugaacgagucggccgacauggcuaucggaaugacuauuaucaaaaauaacaugaucaauaacgguaugggcccagccacggcacaaacagccauucagcucuuuauagcugacuaccgcuauaccuacaagugccauagaggggauucuaaagucgaaggaaagaggaugaagaucauuaaagagcugugggaaaauacuaagggccgggacgguuuacugguggccgaugggggccccaaccuauauaaucuccgcaaccugcacaucccugagauuauccuuaaauacaauauaauggacccagaguacaagggaagauugcugcauccgcagaaccccuucguaggccaccucuccaucgaagggauuaaagaggcagauaucaccccugcgcacggaccaauuaagaaaauggacuaugaugcuguuucagguacacauaguuggaggaccaagcguaaucggagcauccugaacacugaccaacgaaauaugauacuugaggaacagugcuacgccaaguguugcaaccuguuugaggcauguuucaauuccgccucuuauagaaaacccgugggccagcacagcauguuggaagcuauggcccauaggcuccgcauggaugcacggcuggacuacgagucagggagaaugaguaaggaagauuuugagaaagcuauggcccacuuaggagaaauuggcuauaug

SEQ ID NO: 28453 - RNA, 2256 nt, Artificial Sequence; identical to SEQ ID NO: 28452
  derived and/or modified sequence opt3 from anti-influenza_Chain

SEQ ID NO: 28454 - RNA, 2265 nt, Artificial Sequence
  derived and/or modified sequence opt3 from anti-influenza_Chain
auggccguggacaucaagaaaauuauaaagcagaugacccuggaggaaaaagcuggccucugcagcgggcuugauuucuggcacacaaagcccgucgagagacugggaaucccuuccauuaugaugacugacgguccacauggcuugaggaaacaacgggaagaugcagagaucgccgacauuaacaauucuguuccggcgacguguuuucccucagcugccggguuagcaugcaguugggaucgcgaacugguggagcgaguaggagccgcucuaggcgaggaaugucaggcagagaacgugagcauccuccuggguccuggggccaauauaaagcguuccccacuuugcggaagaaacuucgaauacuuuucugaggaccccuaucugucgucagaguuggcugccagccacaucaagggcguccagagucagggcgugggggcgugucucaaacauuucgcagccaauaaccaagaacacaggcggaugaccguugauacaauuguggacgagcgcacucugagagaaaucuacuuugcuuccuucgagaaugccgucaagaaagcaaggccuugggugguaaugugcgcuuauaacaagcugaauggagaauacuguucugagaaccgguaucucuuaaccgagguucugaaaaaugaauggaugcaugaugguuuuguggucagcgacuggggcgccgugaacgaucgcguguccgggcuugacgcgggauuggaucuggagaugccaacaucacacggcauuaccgacaagaagaucgucgaagccguuaaaagugguaagcuaagcgagaauauacucaaccgagcaguggaacgcauucugaaaguaaucuucauggcucuugagaauaagaaagagaacgcccaguacgacaaggaugcucaccauaggcuggcccggcaggcagccgcugaaucuaugguguugcucaaaaacgaggacgauguccugcccuuaaagaaguccgggacuauugcgcugaucggagcauuugugaaaaagccucguuaucagggcucaggcagcagucacaucacaccaacccgccucgacgauauuuacgaagagaucaaaaaggccgggggagacaaaguuaaucuuguguacucugaagguuauagacuggagaacgauggcauagacgaggaauugauuaaugaggcuaagaaggccgcauccagcucggaugucgccgugguauucgcugggcuaccggacgaauacgagucugagggauuugauaggacgcauauguccauccccgaaaaccaaaaucggcugauagaggccguugcagaagugcagucaaacauugucgugguccuccugaauggcaguccuguggagaugccauggaucgacaaaguuaagagcgugcuugaagcguaucugggugggcaggcuuugggcggagcccucgcagacguacuguucggcgaggucaaccccuccgggaaauuagccgagacuuuuccugugaagcugucucacaauccaagcuaccuaaacuuccccggagaagaugaccgaguugaguauaaagaaggucucuucgugggcuaccgcuauuacgauaccaaggggaucgagccgcuguuuccuuucggacacggccuuucauacacaaaguuugaauauagugacauuuccgucgauaaaaaggacgugagcgauaauucuaucauuaacguaucagugaaaguuaagaaugucgguaaaauggcugggaaggagauagugcaguuguacgugaaggacgucaaaaguagcguuagaaggcccgagaaggaacugaaaggcuucgagaagguguuucucaacccaggagaagagaaaacugugaccuucacacuggauaagcgggccuuugcauauuacaauacccaaaucaaagacuggcauguagaauccggcgaguuccuuauucugaucgggagaucuucgagagauaucgucuugaaggagagcgugaggguuaacuccacggugaagauucguaaacgguuuacugucaacucagcuguggaagacguuaugagugauucuagcgccgcggccgugcucggaccuguacugaaggagauaacagacgcuuuacagaucgacauggauaaugcacacgacaugauggccgcuaacauuaaaaauaugccccugcgaucccuagucgguuauucacagggcagacucagcgaagagaugcuggaggaacuuguggauaagaucaacaauguggag

SEQ ID NO: 28455 - RNA, 2265 nt, Artificial Sequence; identical to SEQ ID NO: 28454
  derived and/or modified sequence opt3 from anti-influenza_Chain

SEQ ID NO: 28456 - RNA, 2277 nt, Artificial Sequence
  derived and/or modified sequence opt3 from anti-influenza_Chain
auggagagaaucaaggaacugaggaaccucaugagccagucccggacccgcgagauucuuacaaaaacuacgguggaccacauggccauaaucaagaaauacaccucuggccgacaagaaaagaaucccgcucugcguaugaaauggaugauggcaaugaaguauccuauuacagccgauaagagaaucacugagaugauuccagaaaggaacgagcaggggcagaccuuguggucaaaaaugaaugacgcgggaagugaucgggucaugguuagcccguuagcugugacaugguggaaccgcaauggucccaugaccaacacuguacauuacccuaagaucuauaaaacauacuucgagagaguggaaaggcugaagcacggcaccuuugggccaguccauuuccggaaucaggugaaaauacgccgaagaguugacaucaaccccggacacgccgaucuauccgcaaaggaggcccaagacgugauuauggaagucguguuuccuaaugagguaggcgcuaggauccucacgucugagucgcagcugacuauuaccaaggagaaaaaggaggaacuucaggauugcaaaaucucaccacugaugguugcauauauguuggagcgggaacucgugcguaagacacgcuuccugcccgucgccggugggacuagcaguguguacauagaggugcugcaucucacccagggaacauguugggagcaaauguauaccccuggcggcgaagucaaaaacgacgauguugaccaguccuuaauuaucgcugccagaaauauugugaggcgggcggcaguaucugccgauccacuggcuagccuuuuggagaugugccacuccacgcagaucgggggaauccgaaugguggacauucugaagcagaacccgacugaagaacaagccgucgguauauguaaagcagcuaugggccuacgcaucucaaguagcuuuucuuucgggggauuuacauucaagagaaccuccggcucaagcgugaagagggaagaggagguucucacugguaaucugcagacacuuaaaauucgggugcacgaaggguacgaggaauuuaccauggucggacgcagagccacggcgauccugaggaaggccacccgucgguugauacagcucauugugaguggccgagaugagcaaucuaucgcagaagcuaucauuguagccaugguuuucucccaggaggacugcaugaucaaagcugugagaggcgaccugaacuuugucaauagggccaaccagcgcuuaaaccccaugcaucagcugcuccggcacuuccaaaaggaugcaaaagugcuuuuucagaauuggggagucgagccuauugacaacgugauggggaugauagguauccugccagauaugacacccagcauugaaaugucgaugagaggcguuaggaucucuaagauggggguggacgaguacuccucaacugaacgcguagucgugaguaucgaucgauucuugcggguucgugaccagagaggaaaugugcuacugagcccugaggaggucuccgaaacccagggcacagagaagcucacuauuaccuauucuagcucaaugaugugggaaauaaacgguccagagagugugcugguaaauacauaccaauggaucauuaggaacugggaaaccgugaaaauccaguggucccagaaucccacuaugcuuuauaacaagauggaguucgagccguuucagagccugguuccuaaagccauucgcgggcaauacucuggcuucguccggacguuguuucagcagaugagagaugugcucggaacauucgacaccgcucagaucauaaagcuguuacccuuugcggcagccccaccuaaacaaucaaggaugcaguucaguagcuuuacugugaauguccgaggcuccgggaugcgcauccugguucggggaaacucucccguguucaauuauaacaaggcuaccaagagacuaacagugcucgguaaagaugccggcacccugacugaagacccagaugaggggacagcaggaguagaaucggccguccuuaggggcuuuuugauucuggguaaggaggaccgucgcuacgggcccgcucucagcaucaaugaacuguccaaccuugccaaaggcgagaaggcaaaugugcugauuggacagggcgacguuguguuggucaugaaacggaagagagauucaaguauccucacggacucucaaaccgcgacuaagaggauacgaauggcuauuaac

SEQ ID NO: 28457 - RNA, 2277 nt, Artificial Sequence; identical to SEQ ID NO: 28456
  derived and/or modified sequence opt3 from anti-influenza_Chain

SEQ ID NO: 28458 - RNA, 2472 nt, Artificial Sequence
  derived and/or modified sequence opt3 from anti-influenza_Chain
augaugcugagaaagaaaaccaagcagcucaucagcuccauucuuauacugguguuguuacugucucuauuccccgccgcucucgcagccgagggcaacacaagggaagacaauuuuaaacaucugcuugggaacgauaaugucaagcggccuucagaggcgggagcucugcaauugcaggaaguugacggucagaugacucucguggaucagcacggcgagaaaauccaacugcgcgggaugaguacgcacggacugcagugguucccagaaauucucaacgacaaugccuacaaggcauuaagcaacgauugggacuccaauaugauccgacuggccauguauguaggcgagaacgguuacgcuaccaauccggagcuuauuaagcagcgugugaucgaugggauagaauuggcaaucgagaacgacauguaugucauuguggauuggcauguucacgcccccggagacccuagagauccaguguacgcuggcgccaaagacuuuuucagggaaaucgcggcacuguaucccaauaacccucauauuaucuacgagcuagccaaugagccaucuucgaacaauaacggcggggcuggaauacccaacaaugaagaggguuggaaggccgucaaagaauaugcagauccuauuguggagaugcuccggaagucaggcaacgcugacgacaauaucauuaucguagggagcccaaacuggagucagcgcccggaucuggccgcggacaaucccaucgaugaccaccacacaauguacacuguucauuuuuacaccggaucccacgccgcaucuacagaaagcuauccuuccgagaccccaaacucagagagaggcaaugugaugaguaacacuagguacgcucuugaaaauggugucgccguguucgcuacagagugggggaccagccaagccucuggagauggcggccccuauuuugacgaagcagauguguggauugaguuccugaacgaaaauaacauauccugggccaauuggucauugacgaacaaaaaugaggucagcggggcuuuuacuccuuucgagcucggaaagaguaacgcgaccaaccuggacccaggucccgaucauguuugggcaccggaagaguuaucucuguccggcgaauacgugcgggcccgcaucaaggggguaaauuaugagccuauugaccgaacaaaauacacuaaggugcucugggauuuuaacgacggaaccaaacagggcuucggugucaauagcgacucgcccaacaaggaacuuaucgcuguggauaaugagaacaauacacugaaaguuucuggguuggacguguccaacgaugucucagacggcaauuuuugggccaacgcaagacuaagugccaauggauggggcaagagcguggauauacugggggcugagaaacucaccauggacguaauuguugaugaaccaacgacuguggccaucgcagcgaucccucaguccucuaagagcggaugggcuaaccccgagagggccguccgggugaaugcagaagacuucguccagcaaacagaugguaaguauaaagccggccugaccauuacuggggaggacgcuccaaaccuuaagaauaucgccuuccacgaggaagauaacaacaugaauaacauuauacuguuugugggaacagacgcagcugauguuaucuacuuggacaauauuaaagugaucggcaccgagguagaaauccccgucgugcacgacccuaagggugaggccguucucccaucaguguucgaagaugggacgcgucagggcugggacugggcgggagagaguggcgucaaaaccgcccugacaauugaggaagcuaacggguccaaugcauuaagcugggaguuuggauacccggaagugaagcccucugauaacugggccacugcuccucgccuggacuucuggaagucagaucuaguaagaggugagaaugacuauguggccuuugauuucuaccucgacccaguuagggcaaccgaaggcgcgaugaacauaaaucuggucuuucagcccccuacaaacggguauugggugcaagccccaaaaacuuacaccaucaauuucgaugagcuugaggaagcuaaccaggugaauggauuguaucauuacgaggucaagauuaacguucgggacaucacaaauauucaggaugacacccugcuccgaaacaugaugaucauauuugccgauguggaaagugacuucgcaggccgcguguuuguagacaacgucagauucgagggugcugccacuacggaacccguggagccggagccuguugauccaggggaagagacacccccuguggacgaaaaagaggcaaagaaagagcagaaggaagccgagaaggaagagaaagaagcugucaaggaggagaaaaaggaagcgaaagaggaaaagaaggccgugaaaaaugaggcaaagaaaaag

SEQ ID NO: 28459 - RNA, 2472 nt, Artificial Sequence; identical to SEQ ID NO: 28458
  derived and/or modified sequence opt3 from anti-influenza_Chain

SEQ ID NO: 28460 - RNA, 3063 nt, Artificial Sequence
  derived and/or modified sequence opt3 from anti-influenza_Chain
auggccggcccccacagaagcagggcugcagggccuccaccguucgccguggacgagcaugucgcgcuggaaaugguugcuuuucggggagagguguucgccggucacggccuccuugcagaucagcgccugaucgcccauaccgggcgacccgcuuugaacgcacaacguauuacacagcagaagcagagagaccaaugcaggggacagcggcaccgccaucaccagggcgguagaaauuuaaggaaagcccaccggacuuuucaugaacaccaguccacgcaagaucaggcucaugacgccccucacgggcagcaggcgaagaccggacacgagggccugggccaugaacacgcacaagcccagcaucagcaagggcagucuaacguaguggaucgccaggacggagagccagucgaggcucagcaccaaaaagauggugcccagcgagcaggcaaugcucccgccgggagaguggaacuagagcagcagccuguugaagcgcaacaucagcagcaggagggagacgugaggauaggcaagcggcgucaaaacgccuucgcaccacccgcucucgaucacguccacggugggccuggacgccugcagagacauggccuugccguggagaggcacguaccagcuguucagcagcaucaacagcgggugcagcgaggccgccaacagaucgaccacguccuggggcacggauugccggguagacagaggcucgccuuucgggauggcccccgcagaccuguggggguggcaucaccaguccugggacagaggcccuguccuggccaucguauuguucaaaaucuguuccggcacgguaucgacccaugccgaguggggagauguaggcgcagucccagcgaacuccauggcaugggaugcgccgauguacgggcuagaggccacgggaggcauaugcgcggacagcgagacgagcacccgggucggggccguccuugugcgagaaggcgccacguggacgaugaccgggauagaacaccccaggaaaaauuauacgacgucgcaagggggcuggaugagccagcccgacgcgugcauuuugacgaugaagcugaccgguccguuuucagaggacuugcccagccugcacccgaugagccagagggcaggcgucgcgaccgguuggugcugcaaagacagucugucaaccacaggcgaggucggcuaucgcgccauagacagcagcaccaaccccagcagcaaaggccucaugggaaucaggccuuucucggcaaguaugaaaagcggcgaagaaaaccaacugcuugccugaagucacuucgcagguucccggauaaagacgcccccgugcuguacuuuguaaaccaguuggagaagaccaaacgucggaugacacuccuguuaguuuggcugauuuucaccggaguggcaggcgaaaucagacucgaggcggaagacggggagcuucugggagucgcuguggauagcacuuugacagguuauaguggcaggggguacgucaccggauuugacgccccugaggauuccgugcgcuucucuuucgaagcaccacgaggcguuuauagagugguauuuggugucagcuucuccucacgguuugccaguuacgcucuaaggguggacgauuggcaccagacggggagccugauaaagcgcggcggaggcuucuuugaggccucuaucggggaaauuuggcucgacgagggagcacacacuauggcuuuccaacugaugaauggcgcccuugauuauguucgucuggaacccguguccuacgguccuccagcgagacccccggcccaguugucagacagccaggcuaccgcaagugcccaggcucucuuugccuuccuguuaucugaguacgggcggcauauccuggcaggacaacagcagaacccuuauaggcgcgauuuugacgcgauuaauuacguccgaaacgugacaggcaaggagccagcccuaguauccuucgaucucaucgacuauagccccacuagagaagcucacggugugguucauuaccagaccccugaggauuggauagccugggcaggccgggacgggauugucucgcugauguggcacuggaaugcucccacagaccuuaucgaagauccaucucaagacuguuauuggugguacggauuuuauaccaggugcacgacuuucgauguggccgcagccuuggcugacacauccucagagcgcuacagacugcuccugagggauauugacgugaucgcggcccagcuucagaaauuucagcaagcagauaucccuguccuguggcggcccuugcacgaggcugccggcgggugguucugguggggagccaagggcccagaaccguucaaacagcucuggcgucuguuauacgagcgccugguucaucaccauggucuacacaaccucauuuggguguauacccaugaaccuggggcugcagagugguaccccggagacgccuauguggauauaguaggccgagacgucuacgcggaugacccagaugcucugaugagaagugacuggaaugaacuucagacuuuguuugguggcaggaagcugguggcccucacagagaccgggacgcugcccgacguugaggugaucaccgauuauggaauuugguggagcugguucuccaucuggacagacccauuuuuacgggaugucgacccugaucgccugacuagaguguaccacucugaaaggguucuuacccgggacgaguugcccgauuggcgaagcuaugugcuccacgcaacaacuguacaaccugccggcgaccuggcucuagcagucuacccgaacccaggggccggaagacugcauguggaagugggccuccccgucgcggcuccuguugugguagagguguucaaccugcuuggucagcgcgucuuucaguaccaggccgggaugcaaccagcaggauuguggaggcgggccuucgaacuggcuuuagcccccggcguguaucucguucaggugcgugcagguaaucuggucgcuagaaggcgcugggugucaguucgg

SEQ ID NO: 28461 - RNA, 3063 nt, Artificial Sequence; identical to SEQ ID NO: 28460
  derived and/or modified sequence opt3 from anti-influenza_Chain

SEQ ID NO: 28462 - RNA, 3165 nt, Artificial Sequence
  derived and/or modified sequence opt3 from anti-influenza_Chain
augagaaagaaaaggcggggcuuccugaacgccagcaccgcugugcucgucgggauccuugcaggauuucuggguguuguguuggccgcgacaggcgcuuuaggguucgccguacgcgagucccugcuacucaagcaguuucuguuccuuucuuuugaaggaaauacugacggcgcaucacccuucgguaaagauguggucgugacggccagucaagacguugcugcagauggggaguacagccugaagguggaaaaccgaaccuccgucugggacggaguggagauugauuugacaggcaaaguaaauacuggcaccgacuaucuccugucuuuucacguuuaccagacaucggauucaccucagcuguucagcgugcucgcccguaccgaagacgagaagggggagagauauaagauauuagcugauaaagucguggugccaaacuacuggaaggaaauccuggucccguuuagucccacuuucgagggaaccccugccaaauuuucccuuauuaucacaucuccaaagaaaacggacuucguuuucuauguggauaauguacagguguugacucccaaggaagcggguccuaaggucguguacgagaccagcuucgagaaaggcauuggggacuggcaaccaaggggauccgauguuaagaucucaauaagucccaaaguggcacauagcggcaagaaaucucuguucgucuccaaccggcagaaggguuggcacggggcccagaucucacuaaaaggaauacucaagacaggcaagacuuaugcuuuugaagccuggguguaccaggagagcggccaagaccagaccaucauuaugacaaugcagcgcaaauacaguucugacuccagcaccaaguaugaauggaucaaagcagcuacgguaccuucggggcaguggguucaacugucuggaacuuacacaauaccagccggugugaccgucgaggaucuuacucuguauuucgaaucccagaauccgacauuggaguuuuacguggacgaugucaaggugguugacaccacgucagcggagauuaaacucgaaaugaaccccgaggaagagaucccugcccugaaggauguguuaaaggacuauuucagaguaggcgucgcacugccaaguaaaguguuuauuaaucagaaggauaucgcucucaucagcaaacauuccaacucuagcaccgccgaaaaugagaugaagcccgacucacuucuggcugggauugagaacggaaaauugaaguucagguuugaaacagccgauaaguacauagaguucgcacaacagaauggcaugguugugcggggucacacucuagucuggcauaaccagaccccugaaugguuuuucaaagacgagaaugggaaccugcucaguaaggaagagaugacagagcgccugcgagaauauauccacacugugguaggccacuuuaaaggaaagguguacgccugggauguugucaacgaggcuguggacccaaaucagcccgacggccuuagaagguccaccugguaccaaauuauggggccggauuauaucgaacuggcguucaaauuugcacgggaggccgacccuaacgcuaaguuguucuacaaugauuauaacacauucgagcccaagaaacgugacauaauuuacaaucucgugaaaagccugaaagaaaagggauuaaucgaugguaucggcaugcagugccauauuucucuggccaccgacauccgccagauugaggaagcaauuaaaaaguuuucaacuaucccagggauugagauccacaucacggaacuagauauuagugucuauagagacagcacauccaacuacucugaggccccuaggaccgcucucauagagcaggcccauaaaauggcacaacuguucaagaucuuuaagaaauauucgaauguuauuacuaacgugaccuucuggggacuuaaggaugacuacagcuggcgggcgacacgacgcaaugauuggcccuugaucuuugacaaagauuaccaggcuaagcuggccuauugggcaauuguggccccagaaguacugcccccucucccaaaagaguccaagaucucagaaggcgaggcugucgugguugguaugauggacgacaguuacaugaugucuaagccgauagaaaucuaugaugaggaggggaacgugaaagccaccauuagagcaaucuggaaggacagcacuauuuacgucuauggcgaagugcaggaugcuacaaagaagcccgccgaggacggaguugcgaucuucauaaauccuaacaaugaaaggacgccauaccuucagcccgaugacaccuaugugguacuguggacuaacuggaaauccgaggucaaucgggaagauguggaggugaagaaguuugucggcccuggguuccgcagauacucauuugagaugagcauuacaaucccaggaguugaauuuaaaaaggacucuuacauugguuuugauguggccguaaucgacgauggcaaaugguauuccuggagugacaccacaaacagccaaaagacuaacaccaugaauuacgggacguugaaacucgagggagugauggucgcuaccgcaaaguauggcacacccgugauagauggugaaaucgacgacauuuggaacacuaccgaggagaucgaaacaaagucuguugccauggggucccuggagaaaaaugcuacugccaaggugagggucuuaugggaugaagagaaccuguacgugcuagcaauuguuaaagacccggugcucaauaaggauaacucaaauccuugggaacaggacagugucgagaucuucauagaugagaacaaucacaaaaccggcuauuacgaagacgaugacgcgcaguuucguguaaacuauaugaaugagcagagcuucggaacgggcgccucggcugcccgguucaagacagcagugaaacugauugaagggggauacaucguugaggcugccaucaaguggaagaccauuaaaccaucccccaacacugugaucggcuuuaauguccaagugaacgaugcaaaugaaaagggucagcgaguagggauuauaucuuggagcgacccuacaaacaacucauggagagaucccaguaaauucggaaaucuuagguugaucaag

SEQ ID NO: 28463 - RNA, 3165 nt, Artificial Sequence; identical to SEQ ID NO: 28462
  derived and/or modified sequence opt3 from anti-influenza_Chain

SEQ ID NO: 28464 - RNA, 3177 nt, Artificial Sequence
  derived and/or modified sequence opt3 from anti-influenza_Chain
augcaagugagaaagaggcggggccugcucgacgucagcaccgccguucuuguggggauccuggcuggauucuuggguguaguguuagcagccuccggcguccugucuuuugggaaagaggcgucaaguaagggagauagcucccuagaaacagugcucgcucugucuuucgagggcacuacggaagguguugugcccuuugggaaagacgucgugcuuaccgccucgcaggauguagcagccgacggagaguacucacugaagguugaaaaccgcacaagcccuugggauggcguggagauugacuugacuggcaaagucaagaguggggcugauuaucuccuguccuuccagguguaccagucuagcgacgcaccacagcuguuuaauguggucgcccgaaccgaggaugaaaagggagagcguuaugacguuauacucgauaaagugguaguguccgaccacuggaaggaaaucuuagucccguucucacccacauuugaggguaccccugcuaaauacagucugauuaucguggccagcaagaacacuaauuucaacuuuuaucuugauaaaguucaaguguuggcgccaaaggagucuggccccaaggucauuuacgaaacauccuucgagaauggggugggagacuggcagccuagaggcgacguaaacaucgaagcaucaagcgagguugcccauagugguaaaucuucccuguuuauaagcaauaggcagaagggguggcagggagcucaaaucaaccuaaaaggcauucucaagaccggcaaaacguaugccuucgaagcauggguguaccaaaauucggggcaggaucagacuaucauuaugaccaugcagcggaaguacucuuccgacgcuucaacacaguaugaguggaucaaaagugccacugucccaagcggacagugggugcaacuguccgguaccuacacaauacccgcgggcgucaccguggaggaucuuacgcuguauuuugaaucucagaacccuacuuuggaguucuacguugacgaugugaagauuguagacacaaccagcgccgaaaucaagauugagauggaaccagagaaagagaucccggcacucaaggaaguccugaaagauuauuucaagguggggguugcuuuacccucaaaaguguuucugaauccuaaggacaucgagcucauuacuaagcacuucaacaguauaacagccgaaaaugagaugaaaccagaaucccuucuggcuggaaucgagaacggcaaguugaaauuucgcuucgagaccgccgauaaguacauucaguuugucgaagagaaugguauggugaucagagggcauacgcuaguauggcacaaccagacccccgacugguucuuuaaagaugaaaacggcaaucugcucagcaaggaggcaaugacagagaggcugaaggaauauauacauacugugguuggacacuucaaaggcaaggucuacgccugggacguggugaacgaggcugucgacccuaaucaaccagaugggcuucggcgcucuaccugguaccagauuaugggacccgacuauaucgaacuggcguuuaaauucgcacgagaggccgauccggacgcuaaguuguuuuacaacgauuauaauacauucgaaccuagaaaaagggacaucauuuacaaccucguuaaggaucugaaggagaaagguuuaaucgacggcauugggaugcagugccacauaucacuggccacugauaucaagcagauugaggaagcaaucaaaaaguuuaguaccauccccggaauugagauacauaucacagaacuagacaugagcguguaucgggauuccucuucgaauuacccagaggccccucguaccgcucucauugaacaagcccacaaaaugaugcagcuguucgagaucuucaagaaauauagcaacgugauuacuaauguaacguuuuggggccuuaaggacgauuacuccuggcgcgcaacaagaaggaacgacuggcccuugaucuucgacaaggaucaucaggcgaaacuggcuuacugggccauagucgcaccagaggugcugcccccucucccaaaggaaucacggaucagugagggugaagccguuguggucgggaugauggacgauucuuaucuuaugagcaaaccgauugagauccuggacgaagagggcaaugugaaggcuaccauucgagccguuuggaaagauuccacuaucuacauauauggagaggugcaggacaagaccaagaaacccgcagaagauggcguagcuauuuuuaucaacccuaauaacgagcgcacaccauacuugcaacccgacgauaccuaugccguccucuggacuaauuggaagacagaagugaacagagaggacgugcaggucaaaaaguucguugggccuggauuuaggcgguacucauucgagaugagcauuacgaucccagguguggaauuuaaaaaggauucuuauauaggcuucgacgcggccguaaucgaugacgggaagugguacuccuggagugacaccacuaacagccagaaaacaaauaccaugaacuacggaacacugaaguuagagggcauuaugguggcuacugcaaaauaugguacccccgucaucgauggggaaauugacgagaucuggaauacgaccgaagagauagagacaaaggccguggcuaugggcucucuggauaaaaacgccacugcaaagguucgcgugcuaugggacgaaaauuaccucuauguccuggcgauugugaaggauccgguucuuaacaaagacaauuccaacccuugggagcaggauucaguggaaaucuuuaucgacgagaauaaccacaagaccggauacuaugaagaugacgaugcccaauucagagucaauuacaugaacgagcagacauuuggcacugggggaaguccagcuagguucaaaaccgccguaaaguugauugagggcgguuauaucguggaagcagcuauuaaauggaagacgauaaaacccacaccuaauaccguuaucggguuuaacauucaggugaaugacgccaacgagaagggacaacgugucggcaucauuagcuggucggaccccacuaacaauuccuggcgggauccaucuaaguucgguaaccugcgacucaucaaa

SEQ ID NO: 28465 - RNA, 3177 nt, Artificial Sequence; identical to SEQ ID NO: 28464
  derived and/or modified sequence opt3 from anti-influenza_Chain

SEQ ID NO: 28466 - RNA, 318 nt, Artificial Sequence
  derived and/or modified sequence opt3 from anti-OX40_LightChain
gagaucguggucacccagagccccgccacacugucccucucuccuggcgaaagagcuacucuuucaugcagggcaagucaaagcguuuccucuuaccuggccugguaucagcagaagccagggcaggcgccgcgguuguuaauuuacgacgcuucgaaccgcgccacgggaauacccgcacgauucucagguagcggcagugggaccgauuuuacacugacuaucuccucucuagagccugaagacuucgccguguauuacugucaacagcguagcaauuggccaaccuuuggacagggcacaaaaguagagauuaag

SEQ ID NO: 28467 - RNA, 321 nt, Artificial Sequence
  derived and/or modified sequence opt3 from anti-OX40_LightChain
gacauccagaugacccaaagccccuccucucugucagccagugugggcgauagagucacaauuacuugcagggcuagccaggggauauccucuuggcucgcaugguaccagcagaagccugagaaagccccaaagucgcuuaucuaugcggcuucaagccugcaaaguggaguuccgucccgguucucugguagcggcuccgggacggacuuuaccuugacaauuucaaguuuacagcccgaagauuucgccacuuacuauugucagcaguacaacagcuauccuccaaccuuuggaggcgguacaaaaguggagaucaag

SEQ ID NO: 28468 - RNA, 321 nt, Artificial Sequence
  derived and/or modified sequence opt3 from anti-OX40_LightChain
gacauccagaugacccaaagccccuccucucugucagccagugugggcgauagagucacaauuacuugcagggcuagccaggacauauccaacuaccucaauugguaucagcagaagccugggaaagcaccaaaacuucugaucuacuauacgucucgguugcgcucgggaguuccgucacgauucagcgguaguggcuccgggaccgauuuuacauuaacuauuucuagccugcaacccgaggacuucgccaccuacuauugucagcagggacacacacuaccuccaaccuuuggccaggguacuaagguggaaaucaag

SEQ ID NO: 28469 - RNA, 321 nt, Artificial Sequence
  derived and/or modified sequence opt3 from anti-OX40_LightChain
gacauccagaugacccaaagccccuccucucugucagccagugugggcgauagagucacaauuacuugcagggcuagccaggacauauccaacuaccucaauugguaucagcagaagccugggaaaacgguuaaacuucugaucuacuauaccucucgguugcgcucgggagugccaucacgauucagcgguaguggcuccgggacagauuuuacuuuaaccauuucuagccugcaaccggaggacuucgcaacauacuauugucagcagggacacacccuacccccuacuuuuggccaggguacaaagguagaaaucaag

SEQ ID NO: 28470 - RNA, 321 nt, Artificial Sequence
  derived and/or modified sequence opt3 from anti-OX40_LightChain
gacauccagaugacccaaagccccuccucucugucagccagugugggcgauagagucacaauuacuugcagggcuagccaggacauauccaacuaccucaauugguaucagcagaagccugggaaaacgguuaaacuucugaucuacuauaccucucgguugcgcucgggagugccaucacgauucagcgguaguggcuccgggaaggauuacacauuaacuauuucuagccugcaaccggaggacuuugcaaccuauuucugucagcagggacacacacuacccccuaccuuuggccaggguacuaagguagaaaucaaa

SEQ ID NO: 28471 - RNA, 321 nt, Artificial Sequence
  derived and/or modified sequence opt3 from anti-OX40_LightChain
gacauccagaugacccaaagccccuccucucugucagccagugugggcgauagagucacaauuacuugcagggcuagccaggacauauccaacuaccucaauugguaucagcagaagccugggaaagcaccaaaacuucugaucuacuauacgucucgguugcgcucgggaguuccgucacgauucagcgguaguggcuccgggaccgauuuuacauuaacuauuucuagccugcaacccgaggacuucgccaccuacuauugucagcagggacacacacuaccugcgaccuuuggccaggguacuaagguggaaaucaag

SEQ ID NO: 28472 - RNA, 321 nt, Artificial Sequence
  derived and/or modified sequence opt3 from anti-OX40_LightChain
gacauccagaugacccaaagccccuccucucugucagccagugugggcgauagagucacaauuacuugcagggcuagccaggacauauccaacuaccucaauugguaucagcagaagccugggaaagcaccaaaacuucugaucuacuauacgucucgguugcgcucgggaguuccgucacgauucagcgguaguggcuccgggaccgauuuuacauuaacuauuucuagccugcaacccgaggacuucgccaccuacuauugucagcagggacacacagcgccuccaaccuuuggccaggguacuaagguggaaaucaag

SEQ ID NO: 28473 - RNA, 321 nt, Artificial Sequence
  derived and/or modified sequence opt3 from anti-OX40_LightChain
gacauccagaugacccaaagccccuccucucugucagccagugugggcgauagagucacaauuacuugcagggcuagccaggacauauccaacuaccucaauugguaucagcagaagccugggaaagcaccaaaacuucugaucuacuauacgucucgguugcgcucgggaguuccgucacgauucagcgguaguggcuccgggaccgauuuuacauuaacuauuucuagccugcaacccgaggacuucgccaccuacuauugucagcagggagcgacacuaccuccaaccuuuggccaggguacuaagguggaaaucaag

SEQ ID NO: 28474 - RNA, 321 nt, Artificial Sequence
  derived and/or modified sequence opt3 from anti-OX40_LightChain
gacauccagaugacccaaagccccuccucucugucagccagugugggcgauagagucacaauuacuugcagggcuagccaggacauauccaacuaccucaauugguaucagcagaagccugggaaagcaccaaaacuucugaucuacuauacgucucgguugcgcucgggaguuccgucacgauucagcgguaguggcuccgggaccgauuuuacauuaacuauuucuagccugcaacccgaggacuucgccaccuacuauugucagcagggacacgcgcuaccuccaacauuuggccaggguaccaagguggaaaucaag

SEQ ID NO: 28475 - RNA, 321 nt, Artificial Sequence
  derived and/or modified sequence opt3 from anti-OX40_LightChain
gacauccagaugacccaaagccccuccucucugucagccagugugggcgauagagucacaauuacuugcagggcuagccaggacauauccaacuaccucaauugguaucagcagaagccugggaaagcaccaaaacuucugaucuacuauacgucucgguugcgcucgggaguuccgucacgauucagcgguaguggcuccgggaccgauuuuacauuaacuauuucuagccugcaacccgaggacuucgccaccuacuauugucagcaggcgcacacacuaccuccaaccuuuggacagggcacuaagguggaaaucaag

SEQ ID NO: 28476 - RNA, 321 nt, Artificial Sequence
  derived and/or modified sequence opt3 from anti-OX40_LightChain
gacauccagaugacccaaagccccuccucucugucagccagugugggcgauagagucacaauuacuugcagggcuagccaggacauauccaacuaccucaauugguaucagcagaagccugggaaagcaccaaaacuucugaucuacuauacgucucgguugcgcucgggaguuccgucacgauucagcgguaguggcuccgggaccgauuuuacauuaacuauuucuagccugcaacccgaggacuucgccaccuacuauugucagcagggacacacacuagcgccuaccuuuggccaggguacuaagguggaaaucaag

SEQ ID NO: 28477 - RNA, 321 nt, Artificial Sequence
  derived and/or modified sequence opt3 from anti-OX40_LightChain
gacauccagaugacccaaagccccuccucucugucagccagugugggcgauagagucacaauuacuugcagggcuagccaggacauauccaacuaccucaauugguaucagcagaagccugggaaagcaccaaaacuucugaucuacuauacgucucgguugcgcucgggaguuccgucacgauucagcgguaguggcuccgggaccgauuuuacauuaacuauuucuagccugcaacccgaggacuucgccaccuacuauugucaggcgggacacacacuaccuccaaccuuuggccaggguacuaagguggaaaucaag

SEQ ID NO: 28478 - RNA, 321 nt, Artificial Sequence
  derived and/or modified sequence opt3 from anti-OX40_LightChain
gacauccagaugacccaaagccccuccucucugucagccagugugggcgauagagucacaauuacuugcagggcuagccaggacauauccaacuaccucaauugguaucagcagaagccugggaaagcaccaaaacuucugaucuacuauacgucuaaguugcacucgggaguuccgucacgguucagcgguaguggcuccgggaccgauuacacauuaacuauuucuagccugcaacccgaggacuuugccaccuauuacugucagcagggauccgcgcuaccuuggacauucggccaggguaccaagguggaaaucaaa

SEQ ID NO: 28479 - RNA, 321 nt, Artificial Sequence
  derived and/or modified sequence opt3 from anti-OX40_LightChain
gacauccagaugacccaaagccccuccucucugucagccagugugggcgauagagucacaauuacuugcagggcuagccaggacauauccaacuaccucaauugguaucagcagaagccugggaaagcaguuaaacuucugaucuacuauacgucuaaguugcacucgggagugccaucacgguucagcgguaguggcucccgcaccgauuacacauuaacuauuucuagccugcaaccggaggacuuugccaccuauuacugucagcagggguccgcgcuacccuggacauucggacagggcaccaagguagaaaucaaa

SEQ ID NO: 28480 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagacaguuauaugagcugggugagacaggccccuggucagggccucgaguggaucggggauauguacccagacaacggagauuccucuuauaaucagaaguuuagggaacgggucacuauuacgcgcgacaccucgacaucaacugcguaccuugagcugagcaguuugcgauccgaagauaccgcuguguauuacuguguuuuagccccgcguugguauuucucuguguggggccaagguacacuggucaccgugagcucc

SEQ ID NO: 28481 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagacaguuauaugagcugggugagacaggccccuggucagggccucgaguggaucggggauauguacccagacaacggagauuccucuuauaaucagaaguuuagggaacgggucacuauuacgguggacaccucgacaucaacugcguaccuugagcugagcaguuugcgcuccgaagauaccgcuguuuauuacuguguguuagccccgcgaugguauuucucugucuggggccaagguacacuggugaccguaagcucc

SEQ ID NO: 28482 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagacaguuauaugagcugggugagacaggccccuggucagggccucgaguggaucggggauauguacccagacaacggagauuccucuuauaaucagaaguuuagggaacgggucacucuuacgguggacaccucgacaucaacugcguaccuggaguugagcaguuuacgcuccgaagauaccgcuguuuauuacugugugcuggccccgcgaugguauuucucugucuggggccaagguacccuagugacaguaagcucc

SEQ ID NO: 28483 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagacgccuauaugaguugggugagacaggcgccuggucagggccucgaguggaucggggauauguacccagacaacggagauagcuccuauaaucagaaguuuagggaacgggucacuauuacgcgcgacaccucuacaucgacugcuuaccuugagcugagcucauugcgaagugaagauaccgccguguauuacuguguuuuagcaccgcguugguauuucuccguguggggccaagguacacuggucaccgugucuagc

SEQ ID NO: 28484 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagagaguuauaugagcugggugagacaggccccuggucagggccucgaauggaucggggacauguacccagauaacggagacuccucuuauaaucagaaguuuagggagcgggucacuauuacgcgcgauaccucgacaucaacugcguaccuugaacugagcaguuugcgauccgaggacaccgcuguguauuacuguguuuuagccccgcguugguauuucucuguguggggccaagguacacuggucaccgugagcucc

SEQ ID NO: 28485 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagacaguuauaugagcugggugagacaggccccuggucagggccucgaguggaucggggauauguacccagacaacgcggauuccucuuauaaucagaaguuuagggaacgggucacuauuacgcgcgacaccucgacaucaacugcuuaccuugagcugagcaguuugcgauccgaagauaccgccguguauuacuguguuuuagcaccgcguugguauuucucuguguggggacaaggcacacuggucaccgugagcucc

SEQ ID NO: 28486 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagacaguuauaugagcugggugagacaggccccuggucagggccucgaguggaucggggauauguacccagacaacgcggaugcuuccuauaaucagaaguuuagggaacgggucacuauuacgcgcgacaccucuacaucgacugccuaccuugagcugagcucauugcgaagugaagauaccgcaguguauuacuguguuuuagccccgcguugguauuucuccguguggggacaaggcacacuggucaccgugucuagc

SEQ ID NO: 28487 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagacaguuauaugagcugggugagacaggccccuggucagggccucgaguggaucggggauauguacccagacaacggagaugcguccuauaaucagaaguuuagggaacgggucacuauuacgcgcgacaccucuacaucgacugcuuaccuugagcugagcucauugcgaagugaagauaccgccguguauuacuguguuuuagcaccgcguugguauuucuccguguggggccaagguacacuggucaccgugucuagc

SEQ ID NO: 28488 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagacaguuauaugagcugggugagacaggccccuggucagggccucgaguggaucggggauauguacccagacuccggagauucuucguauaaccagaaguuuagggaacgggucacuauuacgcgcgacaccucaacaagcacugcguaccuugagcugaguuccuugcgaucugaagauaccgcuguguauuacuguguuuuagccccgcguugguauuucagcguguggggccaagguacacuggucaccguguccuca

SEQ ID NO: 28489 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagacaguuauaugagcugggugagacaggccccuggucagggccucgaguggaucggggauauguacccagacaacggauccucuucguauaaucagaaguuuagggaacgggucacuauuacgcgcgauaccucaacaagcacugcguaccuugagcugaguuccuugcgaucugaagacaccgcuguguauuacuguguuuuagccccgcguugguauuucagcguguggggccaagguacacuggucaccguguccuca

SEQ ID NO: 28490 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagacgccuauaugaguugggugagacaggcgccuggucagggccucgaguggaucggggauauguacccagacaacgcugaugccagcuauaaucagaaguuuagggaacgggucacuauuacgcgcgacaccuccacaucuacugcauaccuugagcugucgucauugcgaagcgaagauaccgccguguauuacuguguuuuagcuccgcguugguauuucaguguguggggacaaggcacacuggucaccguguccucu

SEQ ID NO: 28491 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagacaguuauaugagcugggugagacaggccccuggucagggccucgaguggaucggggauauguacccagacaacggagauuccucuuauaaucagaaguuuagggaacgggucacuauuacgcgcgacaccucgacaucaacugcguaccuugagcugagcaguuugcgauccgaagauaccgcuguguauuacuguguuuuagccccgcguugguauuucucugcauggggccaagguacacuggugaccgucagcucc

SEQ ID NO: 28492 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagacaguuauaugagcugggugagacaggccccuggucagggccucgaguggaucggggauauguacccagacaacggagauuccucuuauaaucagaaguuuagggaacgggucacuauuacgcgcgacaccucgacaucaacugcguaccuugagcugagcaguuugcgauccgaagauaccgcuguguauuacuguguuuuagccccgcguugguauuucgcaguguggggccaagguacacuggucaccgugucuagc

SEQ ID NO: 28493 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagacaguuauaugagcugggugagacaggccccuggucagggccucgaguggaucggggauauguacccagacaacggagauuccucuuauaaucagaaguuuagggaacgggucacuauuacgcgcgacaccucgacaucaacugcguaccuugagcugagcaguuugcgauccgaagauaccgcuguguauuacugugccuuagcaccgcguugguauuucucuguuuggggccaagguacacuggugaccgucagcucc

SEQ ID NO: 28494 - RNA, 351 nt, Artificial Sequence
  derived and/or modified sequence opt3 from anti-OX40_HeavyChain
gaggugcagcugguccaaagcggcgccgaaguuaagaaacccggggcuuccgugaagguaucuugcaaagcaucaggauacaccuucacagacaguuauaugagcugggugagacaggccccuggucagggccucgaguggaucggggauauguacccagacaacggagauuccucuuauaaucagaaguuuagggaacgggucacuauuacgcgcgacaccucgacaucaacugcguaccuugagcugagcaguuugcgauccgaagauaccgcuguguauuacuguguugccgcaccgcguugguauuucucuguguggggccaagguacauuagucaccgugagcucc

SEQ ID NO: 28495 - RNA, 354 nt, Artificial Sequence
  derived and/or modified sequence opt3 from anti-OX40_HeavyChain
gaggugcagcuggucgaaagcggcgggggacucguucaacccgguggcucccuuagacugucuugcgccgcuucaggguucaccuuuaguagcuacuccaugaauugggugaggcaggcaccuggaaagggcuuggaguggguaucuuauaucucgucaagcaguuccacaauugacuacgccgauucugugaaaggucgguucacuauaagccgcgacaaugcgaagaacuccuuauaucugcagaugaacucacuacgagaugaagacacggcugucuacuauugugcccgugagagugggugguaccucuuugauuauuggggacagggcacccuggugacaguuagcucu

SEQ ID NO: 28496 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagguucauucaguagcggcuauuggaacuggaucagacagcacccagggaaaggauuggaauggauuggcuacauauccuauaaugguaucacuuaccauaacccgucuuuaaagucgaggauuacgaucaaucccgacaccagcaaaaaccaauuuucacugcagcuaaauagugugacaccugaggauacugcuguauauuacugugcacgguaucgcuacgacuacgaugggggacacgccauggacuauuggggccagggcacccucgugacagucuccucu

SEQ ID NO: 28497 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagguucauucaguagcggcuauuggaacuggaucagaaaacacccagggaagggauuggaauggauuggcuacauauccuauaaugguaucacuuaccauaacccgucuuuaaaaucgaggauuacgaucaaucgggacaccucaaagaaccaguuuagccugcaacuaaauagugugacacccgaggauacugcuguauauuacugugcacgcuaucgauacgacuacgaugggggacacgccauggacuauuggggccagggcacccucgugacagucuccucu

SEQ ID NO: 28498 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagacucauucaguagcgguuauuggaacuggaucagaaaacacccaggcaagggguuggaauacaugggauauauuuccuacaauggcauaacuuaucauaacccgucuuuaaaaucgaggaucacgauuaaucgggauaccucaaagaaccaguacagccugcaacuaaauagugugacacccgaggacacugcuguauauuuuugugcacgcuaccgauacgauuaugacggugggcacgccauggauuacuggggacagggcacccucgugacagucuccucu

SEQ ID NO: 28499 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagacucauucaguagcgguuauuggaacuggaucagaaaacacccaggcaagggguuggaauacauuggauauauauccuacaauggcaucacuuaucauaacccgucuuuaaaaucgaggauuacgaucaaucgggauaccucaaagaaccaguacagccugcaacuaaauagugugacacccgaggacacugcuguauauuuuugugcacgcuaccgauacgauuaugacggugggcacgccauggauuacuggggacagggcacccucgugacagucuccucu

SEQ ID NO: 28500 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagacucauucaguagcgguuauuggaacuggaucagaaaacacccaggcaagggguuggaauacauuggauauauauccuacaauggcaucacuuaucauaacccgucuuuaaaaucgaggauuacgaucaaucgggauaccucaaagaaccaguuuagccugcaacuaaauagugugacacccgaggacacugcuguauacuucugugcacgcuaucgauacgauuacgacggugggcacgccauggauuauuggggacagggcacccucgugacagucuccucu

SEQ ID NO: 28501 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagacucauucaguagcgguuauuggaacuggaucagaaaacacccaggcaagggguuggaauacauuggauauauauccuacaauggcaucacuuaucauaacccgucuuuaaaaucgaggauuacgaucaaucgggauaccucaaagaaccaguacagccugcaacuaaauagugugacacccgaggacacugcuguauauuacugugcacgcuaccgauaugauuacgacggugggcacgccauggauuauuggggacagggcacccucgugacagucuccucu

SEQ ID NO: 28502 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagacucauucaguagcgguuauuggaacuggaucagaaaacacccaggcaagggguuggaauacauuggauauauauccuacaauggcaucacuuaucauaacccgucuuuaaaaucgaggauuacgaucaaucgggauaccucaaagaaccaguuuagccugcaacuaaauagugugacacccgaggacacugcuguauacuauugugcacgcuaccgauacgauuaugacggugggcacgccauggauuacuggggacagggcacccucgugacagucuccucu

SEQ ID NO: 28503 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagguucauucaguagcggcuauuggaacuggaucagaaaacacccagggaagggauuggaauacauuggcuauauauccuacaaugguaucacuuaucauaacccgucuuuaaaaucgaggauuacgaucaaucccgacaccucaaagaaccaguacagccugcaacuaaauagugugacaccugaggauacugcuguauauuuuugugcacgguaccgcuacgacuaugaugggggacacgccauggacuacuggggccagggcacccucgugacagucuccucu

SEQ ID NO: 28504 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagguucauucaguagcggcuauuggaacuggaucagaaaacacccagggaagggauuggaauacauuggcuauauauccuacaaugguaucacuuaucauaacccgucuuuaaaaucgaggauuacgaucaaucgggacaccucaaagaaccaguacagccugcaacuaaauagugugacacccgaggauacugcuguauauuuuugugcacgcuaccgauacgacuaugaugggggacacgccauggacuacuggggccagggcacccucgugacagucuccucu

SEQ ID NO: 28505 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagguucauucaguagcggcuauuggaacuggaucagaaaacacccagggaagggauuggaauacauuggcuauauauccuacaaugguaucacuuaucauaacccgucuuuaaaaucgaggauuacgaucaaucgggacaccucaaagaaccaguacagccugcaacuaaauagugugacacccgaggauacugcuguauauuacugugcacgcuaccgauaugacuacgaugggggacacgccauggacuauuggggccagggcacccucgugacagucuccucu

SEQ ID NO: 28506 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagguucauucaguagcggcuauuggaacuggaucagaaaacacccagggaagggauuggaauacauuggcuauauauccuacaaugguaucacuuaucauaacccgucuuuaaaaucgaggauuacgaucaaucccgacaccucaaagaaccaguacagccugcaacuaaauagugugacaccugaggauacugcuguauauuacugugcacgguaccgcuaugacuacgaugggggacacgccauggacuauuggggccagggcacccucgugacagucuccucu

SEQ ID NO: 28507 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagguucauucaguagcggcuauuggaacuggaucagaaaacacccagggaagggauuggaauacauuggcuauauauccuacaaugcuaucacuuaucauaacccgucuuuaaaaucgaggauuacgaucaaucgggacaccucaaagaaccaguacagccugcaacuaaauagugugacacccgaggauacugcaguauauuacugugcccgcuacaaauaugacuacgaugcgggucacgcuauggacuauugggggcagggaacccucgugacagucuccucu

SEQ ID NO: 28508 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagguucauucaguagcggcuauuggaacuggaucagaaaacacccagggaagggauuggaauacauuggcuauauauccuacaaugcuaucacuuaucauaacccgucuuuaaaaucgaggauuacgaucaaucgggacaccucaaagaaccaguacagccugcaacuaaauagugugacacccgaggauacugcaguauauuacugugcccgcuaccgauaugacuacgauggugggcacgcgauggacuauuggggacagggcacccucgugacagucuccucu

SEQ ID NO: 28509 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagguucauucaguagcggcuauuggaacuggaucagaaaacacccagggaagggauuggaauacauuggcuauauauccuacaaugguaucacuuaucauaacccgucuuuaaaaucgaggauuacgaucaaucgggacaccucaaagaaccaguacagccugcaacuaaauagugugacacccgaggauacugcuguauauuacugugcacgcuacaaauaugacuacgaugggggacacgccauggacuauuggggccagggcacccucgugacagucuccucu

SEQ ID NO: 28510 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagguucauucaguagcggcuauuggaacuggaucagaaaacacccagggaagggauuggaauacauuggcuauauauccuacucugguaucacuuaucauaauccgucguuaaaaucaaggauuacgaucaaccgggacaccagcaagaaucaguacagucugcaacuaaacuccgugacacccgaggauacugcuguauauuacugugcacgcuaccgauaugacuacgaugggggacacgccauggacuauuggggccagggcacccucgugacagucucuagc

SEQ ID NO: 28511 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagguucauucaguagcggcuauuggaacuggaucagaaaacacccagggaagggauuggaauacauuggcuauauauccuacucugguaucacuuaucauaauccgucguuaaaaucaaggauuacgaucaaccgggacaccagcaagaaucaguacagucugcaacuaaacuccgugacacccgaggauacugcuguauauuacugugcacgcuacaaauaugacuacgaugggggacacgccauggacuauuggggccagggcacccucgugacagucucuagc

SEQ ID NO: 28512 - RNA, 363 nt, Artificial Sequence
  derived and/or modified sequence opt3 from anti-OX40_HeavyChain
gaggugcagcugcaagaaagcggccccucccucgucaagccuucucagacccuuucacugacaugcaguguuacuggggacagcuucacguccggauacuggaacuggaucagaaaauuuccagguaauagguuggaguauaugggcuacauuucuuauaacgccauaaccuaccacaauccgucguuaaagucacggaucagcauuacacgcgauaccaguaaaaaccauuauuaccugcagcuaaauuccgugacuacagaagacaccgcuacuuauuucugugcacgauaccguuacgauuaugacgggggacacgccauggauuacuggggccaggguacacucguaaccgugucuagc

SEQ ID NO: 28513 - RNA, 363 nt, Artificial Sequence
  derived and/or modified sequence opt3 from anti-OX40_HeavyChain
caggugcaacugcaggagagcggccccgggcucgucaagccuucccagacccuuucucugacaugcgccguuuacggagguucauucaguagcggcuauuggaacuggaucagaaaacacccagggaagggauuggaauacauuggcuauauauccuacaaugcuaucacuuaucauaacccgucuuuaaaaucgaggauuacgaucaaucgggacaccucaaagaaccaguacagccugcaacuaaauagugugacacccgaggauacugcaguauauuacugugcccgcuacaaauaugacuacgauggugggcacgcgauggacuauuggggacagggcacccucgugacagucuccucu

SEQ ID NO: 28514 - RNA, 372 nt, Artificial Sequence
  derived and/or modified sequence opt3 from anti-OX40_HeavyChain
gaggugcagcuggucgaaagcggcgggggacucguucaacccgguagaucccuuaggcugucuugcgccgcuucaggcuucaccuuugacgauuacgcaaugcacugggugcggcaggccccugggaagggauuggaguggguaaguggcaucagcuggaacuccgguucuauuggguaugcggacucggugaaaggacgcuucacaauaucacgagauaaugcuaagaacagcuuauaccugcagaugaauagucuacgugccgaagacacugcacucuauuacugugccaaagaucaguccacggcugacuauuacuuuuauuacggcauggaugucuggggccaagggaccacagugacuguuucuagc

SEQ ID NO: 28515 - RNA, 381 nt, Artificial Sequence
  derived and/or modified sequence opt3 from anti-OX40_LightChain
auggagacccccgcccagcuccuguuccuucuguuguuauggcugccugacacaacuggcgaaaucgugcuaacgcaaagcccagggacccucucccugucuccgggagagagagcuauucuuucaugcagggcaagucagagcgucuccucuucguuucuggccugguaccagcagaagcccggucaagcgccucgguugcucauauauggcgcuuucucacgcgccacagggaucccagaucgauuuagcggaaguggcuccgguacugacuucacccugacaauuucucgucuggaacccgaggauuuugcaguuuacuauugucagcaguacgacagcuccagaaccuucgggcagggaacuaaaguggaaaucaag

SEQ ID NO: 28516 - RNA, 381 nt, Artificial Sequence
  derived and/or modified sequence opt3 from anti-OX40_LightChain
auggaggcccccgcucagcuccuguuccuucuguuguuauggcugccugacaccacaggcgaaaucgugcuaacucaaagcccagcaacgcucucccugucuccgggggagagagccacccuuucaugcagggcgagucagggagucagcuccuaccuggcuugguaucagcagaagcccggucaagccccucgguugcucauuuacgaugcaucuaaccgcgccacaggcauaccagcucgauuuucggggucaggacccggcacugacuucacccugacaaucagcagucuggaaccugaggauuuugcaguuuauuacugucagcagcguuccaauuggcacccaaccuucggucaggggacuaaaguggaaauuaag

SEQ ID NO: 28517 - RNA, 381 nt, Artificial Sequence
  derived and/or modified sequence opt3 from anti-OX40_LightChain
auggaggcccccgcucagcuccuguuccuucuguuguuauggcugccugacaccacaggcgaaaucgugcuaacucaaagcccagcaacgcucucccugucuccgggggagagagccacccuuucaugcagggcgagucagagcgucuccucuuaccuggcuugguaucagcagaagcccggacaagccccucgguugcucauuuacgaugcaucgaaccgcgccacagguauaccagcucgauuuucaggcagcgggaguggaacugacuucacccugacaaucuccucucuggaacccgaggauuuugcaguuuauuacugucagcagcguagcaauuggccuauuaccuucggccaggguacuagacucgaaaucaaa

SEQ ID NO: 28518 - RNA, 387 nt, Artificial Sequence
  derived and/or modified sequence opt3 from anti-OX40_LightChain
auggagacccccgcccagcuccuguuccuucuguuguuauggcugccugacacaacuggcgaaaucgugcuaacgcaaagcccagggacccucucccugucuccgggagagagagcuacacuuucaugcagggcaagucagagcgucuccucuucguaccuggccugguaucagcagaagcccggucaagcgccucgguugcucauuuacggcgcuucaagccgcgccacugggauaccagaucgauuuaguggauccggcucugguaccgacuucacacugaccaucagccgucuggaacccgaggauuuugcaguuuauuacugucagcaguaugacuccucacucacuuucgggggaggcacaaaaguggaaauuaagagaacc

SEQ ID NO: 28519 - RNA, 390 nt, Artificial Sequence
  derived and/or modified sequence opt3 from anti-OX40_LightChain
auggacaugagagugcuggcccagcuccuuggccuguuguuacugugcuuccccggggcuaggugugauauccaaaugacccagagcccuuccucucuaucagcaagugucggaaaccggguuacaauuacuugccgcgccagccaggacauauccucuuggcucgcgugguaccagcaaaagccagagaaagcuccgaagucgcugaucuaugccgcaucaagccuucagaguggugugcccucccgauuuucuggcagcggguccggaacggauuucacccugacaauuucaaguuugcagccugaagacuuugccacuuacuauugucagcaauacaauagcuauccacucaccuucggccaggguacacgucuggagaucaaaaga

SEQ ID NO: 28520 - RNA, 408 nt, Artificial Sequence
  derived and/or modified sequence opt3 from anti-OX40_HeavyChain
auggacacccugugcagcacacuccuucuguugacuauccccuccuggguguuaucucagauuacgcugaaggagucaggcccuacccuagucaaaccaacacaaacucucacccugaguuguacauucagcggguuuucccuuucuaccucgggaguuggugugggcuggauaagacagccgcccgggaaggcccuggaaugguuggcucucauccacugggaugacgcagagagguacucaccuagccugaaaagucggcugacuauuacaaaggauaccuccaaaaaccagguagugcucacgaugacuaauauggacuuagucgauaccgccacauauuacugcgcgcauacucgcggagcuuucgacaucuggggccaggguaccauggugacaguuucuagc

SEQ ID NO: 28521 - RNA, 408 nt, Artificial Sequence
  derived and/or modified sequence opt3 from anti-OX40_HeavyChain
auggacacccugugcagcacacuccuucuguugacuauccccuccuggguguuaucucagauuacgcugaaggagucaggcccuacccuagucaaaccaacacaaacucucacccugacauguaccuucaguggguuuagccuuuccacuucuggaguuggugugggcuggauaagacagccgcccgggaaggcccuggaaugguuggcucucaucuacugggaugaccacucgccuuauucaccaagccugaaaaguaggcugacaauuaccaaggauacguccaaaaaccagguagugcucacuaugaccaauauggaccccgucgauacagcaacuuacuauugcgcccggacccgcggagcguucgacaucuggggccaggguacaauggugaccguuucuagc

SEQ ID NO: 28522 - RNA, 420 nt, Artificial Sequence
  derived and/or modified sequence opt3 from anti-OX40_HeavyChain
auggaguggggccccugcuggguguuccuggucguuauccucgaaggggugcaguguggaguacaacuuguggagagcgguggcgggcugguccagccuggaggcuccuugagauuaucuugcgccgcuucagguuuuaccuucaguagcuacuccaugaacugggugaggcaggcaccagggaagggacuggaauggguuucuuauauuucgucaagcaguuccacaauauacuaugccgacucugugaaaggccgguuuacuaucagccgcgauaaugcgaagaacucccuauaccuccagaugaacucacugcgagacgaggauacggcugucuauuacugugcccguggcguguaucacaauggguggaguuucuuugacuacuggggacaagguacccuucugacaguaagcucu

SEQ ID NO: 28523 - RNA, 423 nt, Artificial Sequence
  derived and/or modified sequence opt3 from anti-OX40_HeavyChain
auggacacccugugcagcacacuccuucuguugacuauccccuccuggguguuaucucagauuacgcugaaggagucaggcccuacccuagucaaaccaaagcaaacacucacucugaccuguacauucaguggguuuagccuuuccaccucuggaauggguguuggcuggauaagacagccgcccgggaaagcccuggaaugguuggcugugaucuacugggaugaccaccagcucuauucgccuucacucaagagcaggcugacuauuacaaaagauaccaguaagaaccagguagugcugacgaugacuaauauggacccagucgauaccgcaacauacuauugcgcccaucggcgcggagcguuccaacacuggggccaggguacuuuagugaccguuuccucugcuagcacaaagggg

SEQ ID NO: 28524 - RNA, 462 nt, Artificial Sequence
  derived and/or modified sequence opt3 from anti-OX40_HeavyChain
augaccaugaucacacccagccuggugccuuccucugacccacucgucacugccgcuucaguucuugaguucgcacuguugauuagauuaacgauaggccaggccgugguaaguacccaaagcacagggggaggucuggugcagccgggcaggucccuacggcucucuugcgcggcuucgggguuuacucuggaugacuacggaaugcacuggguccgccaggcccccggcaagggucuugaaugggugucagggaucagcuggaauagugauuccauuggauauguugacucugugaaaggccgauucaccaucagccgugauaaugcaaagaacucccuguacuugcagaugaacucacucagagucgaggacacagcccuguauuacugugugaaagauauuaguggcugguauagcuuugacuacugggggcaaggaacccugguaacuguuucuucc

SEQ ID NO: 28525 - RNA, 639 nt, Artificial Sequence
  derived and/or modified sequence opt3 from anti-OX40_LightChain
gagaucguggucacccagagccccgccacacugucccucucuccuggcgaaagagcuacucuuucaugcagggcaagucaaagcguuuccucuuaccuggccugguaucagcagaagccagggcaggcgccgcgguuguuaauuuacgacgcuucgaaccgcgccacgggaauacccgcacgauucucagguagcggcagugggaccgauuuuacacugacuaucuccucucuagagccugaagacuucgccguguauuacugucaacagcguagcaauuggccaaccuuuggacagggcacaaaaguagagauuaagagaaccguggcugcacccuccgucuucaucuuuccuccaucagaugaacagcucaaaagugguacugccagcgugguuugccugcuuaacaauuucuaucccagggaggcuaaggugcaauggaaagucgacaacgcccugcagucuggaaauucccaggagucagugacagaacaggauagcaaggacaguaccuacucuuuguccagcacgcucacucugucgaaggcggauuaugagaaacacaagguauacgcaugugaaguuacccaucaagggcugucuuccccugugacaaaaucauuuaaccggggcgagugc

SEQ ID NO: 28526 - RNA, 1350 nt, Artificial Sequence
  derived and/or modified sequence opt3 from anti-OX40_HeavyChain
gaggugcagcuggucgaaagcggcgggggacucguucaacccgguagaucccuuaggcugucuugcgccgcuucaggcuucaccuuugacgauuacgcaaugcacugggugcggcaggccccugggaagggauuggaguggguaaguggcaucagcuggaacuccgguucuauuggguaugcggacucggugaaaggacgcuucacaauaucacgagauaaugcuaagaacagcuuauaccugcagaugaauagucuacgugccgaagacacugcacucuauuacugugccaaagaucaguccacggcugacuauuacuuuuauuacggcauggaugucuggggccaagggaccacagugacuguuucuagcgcauccaccaagggaccaucaguguucccgcuggcccccugcaguagaagcacaucugaguccaccgcugcccuugguugucuggucaaagacuacuuuccugaaccagugacuguaucauggaacagcggcgcguugacaagugggguucauaccuuccccgcagugcuccagucuuccggacuguauagccugucgucugucgugacggugccuuccucaaauuuuggcacucagaccuacacaugcaacgucgaucacaagccaaguaauacuaagguugacaaaaccguggagaggaaguguugcguagagugucccccuugcccagccccgcccguggcugguccuagcgucuuccucuuuccacccaaaccuaaggauacauuaaugaucucccggaccccagaagugacguguguuguggucgacgugucucaugaggaucccgaaguacaguucaacugguauguugacgggguggagguccacaaugccaaaacuaagccgcgcgaggaacaauuuaacagcacauucagaguggucucagugcugaccguugugcaucaggacuggcuuaauggaaaggaguacaaaugcaagguaaguaacaaaggcuugccugcacccauugaaaagacuaucuccaaaacaaagggccagccaagggagccucaggucuauacccugcccccaagccgggaagagaugacgaaaaaucaagugucucuaaccugucucguuaagggguuuuaccccucagauauugcuguggagugggaaaguaacggacagccugagaauaacuauaagacaacuccaccgaugcuggacagcgaugguuccuucuuccuuuacucuaaacugaccgucgacaagucgcgcuggcagcaaggcaacguguuuagcugcuccguaaugcacgaagccuugcacaaucauuacacacagaaaucacucagucugucucccgggaag

SEQ ID NO: 28527 - RNA, 21 nt, Artificial Sequence
  derived and/or modified sequence opt3 from anti-HIV_VRC01_VRC02_NIH45-46_LightChain_CDR
ugccagcaauacgaguucuuu

SEQ ID NO: 28528 - RNA, 42 nt, Artificial Sequence
  derived and/or modified sequence opt3 from anti-HIV_VRC01_HeavyChain_CDR
accagaggcaagaacugcgacuacaauugggauuucgagcac

SEQ ID NO: 28529 - RNA, 21 nt, Artificial Sequence
  derived and/or modified sequence opt3 from anti-HIV_3BNC60_LightChain_CDR
ugccagguguacgaguucauc

SEQ ID NO: 28530 - RNA, 36 nt, Artificial Sequence
  derived and/or modified sequence opt3 from anti-HIV_3BNC60_HeavyChain_CDR
gccagacagaggagcgacuucugggauuuugacgug

SEQ ID NO: 28531 - RNA, 36 nt, Artificial Sequence
  derived and/or modified sequence opt3 from anti-HIV_5H/I1-BMV-D5_HeavyChain_CDR
gccagagacaaccccacccugcucggcagcgauuac

SEQ ID NO: 28532 - RNA, 33 nt, Artificial Sequence
  derived and/or modified sequence opt3 from anti-HIV_8ANC195_LightChain_CDR
ugccagcaauacgacaccuaucccggcacauuc

SEQ ID NO: 28533 - RNA, 33 nt, Artificial Sequence
  derived and/or modified sequence opt3 from anti-HIV_CH01_CH02_CH03_LightChain_CDR
ugccagcaauacggcgggagccccuauaccuuc

SEQ ID NO: 28534 - RNA, 78 nt, Artificial Sequence
  derived and/or modified sequence opt3 from anti-HIV_CH01_HeavyChain_CDR
gccagaggcaccgacuacacaaucgaugacgcugggauucacuaucagggaagcgguacuuucugguacuuugaucug

SEQ ID NO: 28535 - RNA, 78 nt, Artificial Sequence
  derived and/or modified sequence opt3 from anti-HIV_CH02_HeavyChain_CDR
gccagaggcaccgacuacacaaucgaugaccaggggagguucuaucaaggaagcgguacuuuuugguacuucgauuuu

SEQ ID NO: 28536 - RNA, 78 nt, Artificial Sequence
  derived and/or modified sequence opt3 from anti-HIV_CH03_HeavyChain_CDR
gccagaggcaccgacuacacaaucgaugaccaggggauuuucuauaagggaagcgguacuuuuugguacuucgaucug

SEQ ID NO: 28537 - RNA, 33 nt, Artificial Sequence
  derived and/or modified sequence opt3 from anti-HIV_CH04_LightChain_CDR
ugccagcaauacggcagaagccccuauaccuuc

SEQ ID NO: 28538 - RNA, 78 nt, Artificial Sequence
  derived and/or modified sequence opt3 from anti-HIV_CH04_HeavyChain_CDR
gccagaggcaccgacuacacaaucgaugaccaggggauuagguaucaaggaagcgguacuuucugguacuuugaugug

SEQ ID NO: 28539 - RNA, 54 nt, Artificial Sequence
  derived and/or modified sequence opt3 from anti-HIV_NIH45-46_HeavyChain_CDR
accagaggcaaguacugcacagccagggacuauuacaacugggauuucgagcac

SEQ ID NO: 28540 - RNA, 90 nt, Artificial Sequence
  derived and/or modified sequence opt3 from anti-HIV_PG16_HeavyChain_CDR
gccagagaggcuggcgggcccaucuggcacgacgaugugaaguacuaugacuucaacgauggauacuauaauuaccauuauauggacguc

SEQ ID NO: 28541 - RNA, 36 nt, Artificial Sequence
  derived and/or modified sequence opt3 from anti-HIV_PGT122_LightChain_CDR
cacaucugggacagcagaaggcccaccaacugggug

SEQ ID NO: 28542 - RNA, 72 nt, Artificial Sequence
  derived and/or modified sequence opt3 from anti-HIV_PGT122_HeavyChain_CDR
accaagcacggcagaaggaucuacgggguggucgccuucaaagagugguuuacauauuucuacauggacguu

SEQ ID NO: 28543 - RNA, 36 nt, Artificial Sequence
  derived and/or modified sequence opt3 from anti-HIV_PGT123_LightChain_CDR
cacaucuacgacgccagaggcgggaccaacugggug

SEQ ID NO: 28544 - RNA, 72 nt, Artificial Sequence
  derived and/or modified sequence opt3 from anti-HIV_PGT123_HeavyChain_CDR
gcccugcacggcaagagaaucuacgggauuguggcucucggagagcuuuucaccuauuuuuacauggacguc

SEQ ID NO: 28545 - RNA, 30 nt, Artificial Sequence; identical to SEQ ID NO: 13261
  derived and/or modified sequence opt3 from anti-HIV_PGT125_PGT128_LightChain_CDR

SEQ ID NO: 28546 - RNA, 57 nt, Artificial Sequence
  derived and/or modified sequence opt3 from anti-HIV_PGT125_HeavyChain_CDR
uucgacggcgaggugcuggucuacaaccacuggcccaagccugccuggguugaucuc

SEQ ID NO: 28547 - RNA, 30 nt, Artificial Sequence; identical to SEQ ID NO: 13263
  derived and/or modified sequence opt3 from anti-HIV_PGT126_PGT127_LightChain_CDR

SEQ ID NO: 28548 - RNA, 57 nt, Artificial Sequence
  derived and/or modified sequence opt3 from anti-HIV_PGT126_HeavyChain_CDR
uucgacggcgaggugcuggucuaccacgauuggcccaagccugccuggguugaccuc

SEQ ID NO: 28549 - RNA, 57 nt, Artificial Sequence
  derived and/or modified sequence opt3 from anti-HIV_PGT127_HeavyChain_CDR
uucggcggggaggugcuggucuacagagacuggcccaagccugccuggguugaucuc

SEQ ID NO: 28550 - RNA, 57 nt, Artificial Sequence
  derived and/or modified sequence opt3 from anti-HIV_PGT128_HeavyChain_CDR
uucggcggggaggugcugagauacaccgacuggcccaagccugccugggucgaucuc

SEQ ID NO: 28551 - RNA, 30 nt, Artificial Sequence
  derived and/or modified sequence opt3 from anti-HIV_PGT130_LightChain_CDR
agcucccuguucggcagaugggacgugguc

SEQ ID NO: 28552 - RNA, 57 nt, Artificial Sequence
  derived and/or modified sequence opt3 from anti-HIV_PGT130_HeavyChain_CDR
agcggcggggacauccuguacuauuacgaguggcagaagccccacugguucuccccu

SEQ ID NO: 28553 - RNA, 30 nt, Artificial Sequence
  derived and/or modified sequence opt3 from anti-HIV_PGT131_LightChain_CDR
agcucccugucuggcagaugggacaucgug

SEQ ID NO: 28554 - RNA, 57 nt, Artificial Sequence
  derived and/or modified sequence opt3 from anti-HIV_PGT131_HeavyChain_CDR
agcggcggggacauccuguacuauauugaguggcagaagccccacugguucuacccu

SEQ ID NO: 28555 - RNA, 27 nt, Artificial Sequence
  derived and/or modified sequence opt3 from anti-HIV_PGT135_PGT136_PGT137_LightChain_CDR
cagcaauacgaggaauggcccagaacc

SEQ ID NO: 28556 - RNA, 54 nt, Artificial Sequence
  derived and/or modified sequence opt3 from anti-HIV_PGT135_HeavyChain_CDR
cacagacaucacgacguguucaugcugguccccaucgccggcugguuugauguu

SEQ ID NO: 28557 - RNA, 54 nt, Artificial Sequence
  derived and/or modified sequence opt3 from anti-HIV_PGT136_HeavyChain_CDR
cacaaguaccaugacaucuucagagugguccccguugccggcugguuugauccu

SEQ ID NO: 28558 - RNA, 54 nt, Artificial Sequence
  derived and/or modified sequence opt3 from anti-HIV_PGT137_HeavyChain_CDR
cacaaguaccaugacaucgugauggucguucccauugccggcugguucgauccu

SEQ ID NO: 28559 - RNA, 27 nt, Artificial Sequence
  derived and/or modified sequence opt3 from anti-HIV_PGT141_PGT142_PGT143_PGT144_LightChain_CDR
augcagggccugaacagacccuggacc

SEQ ID NO: 28560 - RNA, 96 nt, Artificial Sequence
  derived and/or modified sequence opt3 from anti-HIV_PGT141_HeavyChain_CDR
ggcagcaagcacagacugagggacuacgugcucuaugaugacuacgggcuuaucaacuaucaggaauggaaugauuaccuggaguucuuggacguc

SEQ ID NO: 28561 - RNA, 96 nt, Artificial Sequence
  derived and/or modified sequence opt3 from anti-HIV_PGT144_HeavyChain_CDR
ggcagcaagcacagacugagggacuacgugcucuaugaugacuacgggcuuaucaaccagcaagaauggaaugauuaucuggaguucuuggacguc

SEQ ID NO: 28562 - RNA, 27 nt, Artificial Sequence
  derived and/or modified sequence opt3 from anti-HIV_PGT145_LightChain_CDR
augcagggccugcacagccccuggacc

SEQ ID NO: 28563 - RNA, 93 nt, Artificial Sequence
  derived and/or modified sequence opt3 from anti-HIV_PGT145_HeavyChain_CDR
ggcagcaagcacagacugagggacuacuuccucuauaacgaguacgggcccaauuaugaagaguggggagauuaccuugccacccuggacgug

SEQ ID NO: 28564 - RNA, 21 nt, Artificial Sequence
  derived and/or modified sequence opt3 from anti-HIV_VRC-CH30_VRC-CH31_VRC-CH32_VRC-CH33_VRC-CH34_LightChain _CDR
ugccagcaauacgagaccuuc

SEQ ID NO: 28565 - RNA, 45 nt, Artificial Sequence
  derived and/or modified sequence opt3 from anti-HIV_VRC-CH30_VRC-CH31_VRC-CH32_VRC-CH34_HeavyChain_CDR
gccagagcucagaagaggggccggagcgagugggcauacgcccac

SEQ ID NO: 28566 - RNA, 45 nt, Artificial Sequence
  derived and/or modified sequence opt3 from anti-HIV_VRC-CH33_HeavyChain_CDR
gccagagcucagaagagggcacggagcgagugggccuacgcgcac

SEQ ID NO: 28567 - RNA, 21 nt, Artificial Sequence
  derived and/or modified sequence opt3 from anti-HIV_VRC-PG04_LightChain_CDR
ugccagcaacuggaguucuuu

SEQ ID NO: 28568 - RNA, 48 nt, Artificial Sequence
  derived and/or modified sequence opt3 from anti-HIV_VRC-PG04_HeavyChain_CDR
gccagacagaaguucuacaccggcgggcaaggaugguauuuugaccug

SEQ ID NO: 28569 - RNA, 21 nt, Artificial Sequence
  derived and/or modified sequence opt3 from anti-HIV_VRC-PG04b_LightChain_CDR
ugccagcaaguggaguucuuu

SEQ ID NO: 28570 - RNA, 48 nt, Artificial Sequence
  derived and/or modified sequence opt3 from anti-HIV_VRC-PG04b_HeavyChain_CDR
gccagacagaaguucgagaggggcgggcaaggaugguacuuugaccug

SEQ ID NO: 28571 - RNA, 21 nt, Artificial Sequence
  derived and/or modified sequence opt3 from anti-HIV_VRC03_LightChain_CDR
ugccagcaauucgaguuuuuc

SEQ ID NO: 28572 - RNA, 48 nt, Artificial Sequence
  derived and/or modified sequence opt3 from anti-HIV_VRC03_HeavyChain_CDR
gugagaaggggcagcugcgacuacuguggggauuuccccuggcaguau

SEQ ID NO: 28573 - RNA, 21 nt, Artificial Sequence
  derived and/or modified sequence opt3 from anti-HIV_1TJG_P-Chain
gagcuggacaagugggccagc

SEQ ID NO: 28574 - RNA, 69 nt, Artificial Sequence
  derived and/or modified sequence opt3 from anti-HIV_2B1H_P-Chain
aacaauaccaagaaaagcaucaagauuagacccaggcaggccuucuacgcuacaaacggcauaaucggg

SEQ ID NO: 28575 - RNA, 69 nt, Artificial Sequence
  derived and/or modified sequence opt3 from anti-HIV_2B1A_P-Chain
aacaauaccagaaagagcauccaccugggccccgggagggccuucuacgcuacaggagacauuauaggu

SEQ ID NO: 28576 - RNA, 57 nt, Artificial Sequence
  derived and/or modified sequence opt3 from anti-HIV_2B0S_P-Chain
aagagaaaaaggauccacauuggccccgggcgggccuucuacaccacaaagaacgcu

SEQ ID NO: 28577 - RNA, 69 nt, Artificial Sequence
  derived and/or modified sequence opt3 from anti-HIV_3UJJ_P-Chain
aacaauaccagaaagagcaucaggauuggccccgggcaggccuucuacgcuacaggagacauaaucggu

SEQ ID NO: 28578 - RNA, 69 nt, Artificial Sequence
  derived and/or modified sequence opt3 from anti-HIV_3UJI_P-Chain
uacaacaagagaaaaaggauccacauuggccccgggcgggccuucuauaccacaaagaauauaaucgga

SEQ ID NO: 28579 - RNA, 75 nt, Artificial Sequence
  derived and/or modified sequence opt3 from anti-HIV_3MLZ_P-Chain
agcaacaauaccagaaagggcauccacauugggcccggaagggccuucuacgcuacaggucagauaacuggcgac

SEQ ID NO: 28580 - RNA, 60 nt, Artificial Sequence
  derived and/or modified sequence opt3 from anti-HIV_3MLV_Q-Chain
aacaauaccagaaagaggauccgggugggccccgggcagacagucuacgccacuaacgcu

SEQ ID NO: 28581 - RNA, 69 nt, Artificial Sequence
  derived and/or modified sequence opt3 from anti-HIV_3MLU_P-Chain
aacaauaccagaaagagcaucaggauuggccccgggcaggccuucuacgcuacaggagguauaaucggc

SEQ ID NO: 28582 - RNA, 60 nt, Artificial Sequence
  derived and/or modified sequence opt3 from anti-HIV_3MLR_P-Chain
aacaauaccaagaaaggcaucgccauugggcccggaagaacacuguacgcuagggagaag

SEQ ID NO: 28583 - RNA, 48 nt, Artificial Sequence
  derived and/or modified sequence opt3 from anti-HIV_4XCF_P-Chain
aacuggugggacaucaccaauuggcugugguacauuaagaaaaagaaa

SEQ ID NO: 28584 - RNA, 45 nt, Artificial Sequence
  derived and/or modified sequence opt3 from anti-HIV_4XBE_P-Chain
aacugguucgacaucaccaauuggcugugguacauuaagaaaaag

SEQ ID NO: 28585 - RNA, 48 nt, Artificial Sequence
  derived and/or modified sequence opt3 from anti-HIV_4XAW_P-Chain
aacugguucgacaucaccaauuggcugugguacauuaagaaaaagaaa

SEQ ID NO: 28586 - RNA, 45 nt, Artificial Sequence
  derived and/or modified sequence opt3 from anti-HIV_2QSC_P-Chain
agaaagaggauccacauuggccccgggcgggccuucuacaccaca

SEQ ID NO: 28587 - RNA, 60 nt, Artificial Sequence
  derived and/or modified sequence opt3 from anti-HIV_3MLS_S-Chain
gccugccaggcuuucuacgcaagcucccccagaaagucuauccacauuggcgccugugcg

SEQ ID NO: 28588 - RNA, 42 nt, Artificial Sequence
  derived and/or modified sequence opt3 from anti-HIV_3GO1_P-Chain
agaaagaggauccacauuggccccgggcgggccuucuacacc

SEQ ID NO: 28589 - RNA, 42 nt, Artificial Sequence
  derived and/or modified sequence opt3 from anti-HIV_4M1D_Q-Chain
ugcagaauccacauuggccccgggagggccuucuacaccugu

SEQ ID NO: 28590 - RNA, 39 nt, Artificial Sequence
  derived and/or modified sequence opt3 from anti-HIV_3C2A_Q-Chain
aagagcauccaccugggccccgggagagccuucuacgcu

SEQ ID NO: 28591 - RNA, 12 nt, Artificial Sequence
  derived and/or modified sequence opt3 from anti-HIV_CDR
cagagcaagacc

SEQ ID NO: 28592 - RNA, 12 nt, Artificial Sequence
  derived and/or modified sequence opt3 from anti-HIV_CDR
gaccugaucgau

SEQ ID NO: 28593 - RNA, 15 nt, Artificial Sequence
  derived and/or modified sequence opt3 from anti-HIV_CDR
gaccacuacuggagc

SEQ ID NO: 28594 - RNA, 15 nt, Artificial Sequence
  derived and/or modified sequence opt3 from anti-HIV_CDR
ggcagauucuggagc

SEQ ID NO: 28595 - RNA, 15 nt, Artificial Sequence
  derived and/or modified sequence opt3 from anti-HIV_CDR
aacuacuauuggacc

SEQ ID NO: 28596 - RNA, 15 nt, Artificial Sequence
  derived and/or modified sequence opt3 from anti-HIV_CDR
gacgccuacuggagc

SEQ ID NO: 28597 - RNA, 15 nt, Artificial Sequence
  derived and/or modified sequence opt3 from anti-HIV_CDR
gacagcuacuggucc

SEQ ID NO: 28598 - RNA, 15 nt, Artificial Sequence
  derived and/or modified sequence opt3 from anti-HIV_CDR
gacaacuacuggagc

SEQ ID NO: 28599 - RNA, 15 nt, Artificial Sequence
  derived and/or modified sequence opt3 from anti-HIV_CDR
aacagcuacuggacc

SEQ ID NO: 28600 - RNA, 15 nt, Artificial Sequence
  derived and/or modified sequence opt3 from anti-HIV_CDR
agcuacuauuggucc

SEQ ID NO: 28601 - RNA, 15 nt, Artificial Sequence
  derived and/or modified sequence opt3 from anti-HIV_CDR
agcuucggcaugcac

SEQ ID NO: 28602 - RNA, 15 nt, Artificial Sequence
  derived and/or modified sequence opt3 from anti-HIV_CDR
gccgcuuuccagugg

SEQ ID NO: 28603 - RNA, 15 nt, Artificial Sequence
  derived and/or modified sequence opt3 from anti-HIV_CDR
cagcaacugagaacc

SEQ ID NO: 28604 - RNA, 15 nt, Artificial Sequence
  derived and/or modified sequence opt3 from anti-HIV_CDR
cagcaauacgacagc

SEQ ID NO: 28605 - RNA, 15 nt, Artificial Sequence
  derived and/or modified sequence opt3 from anti-HIV_CDR
cagcaacuggccacc

SEQ ID NO: 28606 - RNA, 15 nt, Artificial Sequence
  derived and/or modified sequence opt3 from anti-HIV_CDR
gagagcuuccagugg

SEQ ID NO: 28607 - RNA, 15 nt, Artificial Sequence
  derived and/or modified sequence opt3 from anti-HIV_CDR
gaaguguacgaguuc

SEQ ID NO: 28608 - RNA, 15 nt, Artificial Sequence
  derived and/or modified sequence opt3 from anti-HIV_CDR
gccagccuggaguuc

SEQ ID NO: 28609 - RNA, 15 nt, Artificial Sequence
  derived and/or modified sequence opt3 from anti-HIV_CDR
agcguguacgaguuc

SEQ ID NO: 28610 - RNA, 15 nt, Artificial Sequence
  derived and/or modified sequence opt3 from anti-HIV_CDR
gccgcucuggaguuc

SEQ ID NO: 28611 - RNA, 15 nt, Artificial Sequence
  derived and/or modified sequence opt3 from anti-HIV_CDR
gccguggucgaguuc

SEQ ID NO: 28612 - RNA, 15 nt, Artificial Sequence
  derived and/or modified sequence opt3 from anti-HIV_CDR
cagcuguucgaguuu

SEQ ID NO: 28613 - RNA, 15 nt, Artificial Sequence
  derived and/or modified sequence opt3 from anti-HIV_CDR
gccguguuccagugg

SEQ ID NO: 28614 - RNA, 15 nt, Artificial Sequence
  derived and/or modified sequence opt3 from anti-HIV_CDR
gccgugcuggaguuc

SEQ ID NO: 28615 - RNA, 15 nt, Artificial Sequence
  derived and/or modified sequence opt3 from anti-HIV_CDR
aacggcuucgacgug

SEQ ID NO: 28616 - RNA, 15 nt, Artificial Sequence
  derived and/or modified sequence opt3 from anti-HIV_CDR
cagcaauacgaguuc

SEQ ID NO: 28617 - RNA, 15 nt, Artificial Sequence
  derived and/or modified sequence opt3 from anti-HIV_CDR
cagcacuacgaguuc

SEQ ID NO: 28618 - RNA, 15 nt, Artificial Sequence
  derived and/or modified sequence opt3 from anti-HIV_CDR
cagguguacgagguc

SEQ ID NO: 28619 - RNA, 15 nt, Artificial Sequence
  derived and/or modified sequence opt3 from anti-HIV_CDR
cagguguacgaguuc

SEQ ID NO: 28620 - RNA, 15 nt, Artificial Sequence
  derived and/or modified sequence opt3 from anti-HIV_CDR
uucagcaaggagucc

SEQ ID NO: 28621 - RNA, 15 nt, Artificial Sequence
  derived and/or modified sequence opt3 from anti-HIV_CDR
cugaagcucagcucc

SEQ ID NO: 28622 - RNA, 15 nt, Artificial Sequence
  derived and/or modified sequence opt3 from anti-HIV_CDR
uacaaggugagcucc

SEQ ID NO: 28623 - RNA, 15 nt, Artificial Sequence
  derived and/or modified sequence opt3 from anti-HIV_CDR
cccccucaggagagc

SEQ ID NO: 28624 - RNA, 15 nt, Artificial Sequence
  derived and/or modified sequence opt3 from anti-HIV_CDR
accgccagagacuac

SEQ ID NO: 28625 - RNA, 15 nt, Artificial Sequence
  derived and/or modified sequence opt3 from anti-HIV_CDR
augcagagcauccaa

SEQ ID NO: 28626 - RNA, 15 nt, Artificial Sequence
  derived and/or modified sequence opt3 from anti-HIV_CDR
caccagcuggacacc

SEQ ID NO: 28627 - RNA, 15 nt, Artificial Sequence
  derived and/or modified sequence opt3 from anti-HIV_CDR
caccagcuggacagc

SEQ ID NO: 28628 - RNA, 15 nt, Artificial Sequence
  derived and/or modified sequence opt3 from anti-HIV_CDR
cagcaacugggcacc

SEQ ID NO: 28629 - RNA, 15 nt, Artificial Sequence
  derived and/or modified sequence opt3 from anti-HIV_CDR
cagaaggccaccaca

SEQ ID NO: 28630 - RNA, 15 nt, Artificial Sequence
  derived and/or modified sequence opt3 from anti-HIV_CDR
cuguucgccggcacc

SEQ ID NO: 28631 - RNA, 18 nt, Artificial Sequence
  derived and/or modified sequence opt3 from anti-HIV_CDR
gugagaggcagcuccccc

SEQ ID NO: 28632 - RNA, 18 nt, Artificial Sequence
  derived and/or modified sequence opt3 from anti-HIV_CDR
ggccuccuguucgugguc

SEQ ID NO: 28633 - RNA, 18 nt, Artificial Sequence
  derived and/or modified sequence opt3 from anti-HIV_CDR
auggacuggaccuggagc

SEQ ID NO: 28634 - RNA, 18 nt, Artificial Sequence
  derived and/or modified sequence opt3 from anti-HIV_CDR
auggacuggaccuggaga

SEQ ID NO: 28635 - RNA, 18 nt, Artificial Sequence
  derived and/or modified sequence opt3 from anti-HIV_CDR
augaagcaccugugguuc

SEQ ID NO: 28636 - RNA, 18 nt, Artificial Sequence
  derived and/or modified sequence opt3 from anti-HIV_CDR
auggacuggaucuggaga

SEQ ID NO: 28637 - RNA, 18 nt, Artificial Sequence
  derived and/or modified sequence opt3 from anti-HIV_CDR
auggacuggaccuggaca

SEQ ID NO: 28638 - RNA, 18 nt, Artificial Sequence
  derived and/or modified sequence opt3 from anti-HIV_CDR
augaagcaccuguuccuc

SEQ ID NO: 28639 - RNA, 18 nt, Artificial Sequence
  derived and/or modified sequence opt3 from anti-HIV_CDR
cagcugcuccaaagcaac

SEQ ID NO: 28640 - RNA, 18 nt, Artificial Sequence
  derived and/or modified sequence opt3 from anti-HIV_CDR
ggcgggagccccgagcac

SEQ ID NO: 28641 - RNA, 18 nt, Artificial Sequence
  derived and/or modified sequence opt3 from anti-HIV_CDR
cuggagggcaccgacuac

SEQ ID NO: 28642 - RNA, 18 nt, Artificial Sequence
  derived and/or modified sequence opt3 from anti-HIV_CDR
cagcaauaccccagcacc

SEQ ID NO: 28643 - RNA, 21 nt, Artificial Sequence
  derived and/or modified sequence opt3 from anti-HIV_CDR
aacaaucacgacagacccagc

SEQ ID NO: 28644 - RNA, 21 nt, Artificial Sequence
  derived and/or modified sequence opt3 from anti-HIV_CDR
aacaaucaggacagacccgcc

SEQ ID NO: 28645 - RNA, 21 nt, Artificial Sequence
  derived and/or modified sequence opt3 from anti-HIV_CDR
aacaauaacgacagacccagc

SEQ ID NO: 28646 - RNA, 21 nt, Artificial Sequence
  derived and/or modified sequence opt3 from anti-HIV_CDR
aacaaucaggacagacccagc

SEQ ID NO: 28647 - RNA, 21 nt, Artificial Sequence
  derived and/or modified sequence opt3 from anti-HIV_CDR
gacgauagcgacagacccucc

SEQ ID NO: 28648 - RNA, 21 nt, Artificial Sequence
  derived and/or modified sequence opt3 from anti-HIV_CDR
ugggccagcaccagacacaca

SEQ ID NO: 28649 - RNA, 21 nt, Artificial Sequence
  derived and/or modified sequence opt3 from anti-HIV_CDR
ggcgccaccgcuagagacuuc

SEQ ID NO: 28650 - RNA, 21 nt, Artificial Sequence
  derived and/or modified sequence opt3 from anti-HIV_CDR
gccagcaucaagcuggcucuc

SEQ ID NO: 28651 - RNA, 21 nt, Artificial Sequence
  derived and/or modified sequence opt3 from anti-HIV_CDR
cagcaauacggcagaagcccc

SEQ ID NO: 28652 - RNA, 21 nt, Artificial Sequence
  derived and/or modified sequence opt3 from anti-HIV_CDR
cagcaauacuauaucagcccc

SEQ ID NO: 28653 - RNA, 21 nt, Artificial Sequence
  derived and/or modified sequence opt3 from anti-HIV_CDR
cagcaaagccacucccccucu

SEQ ID NO: 28654 - RNA, 21 nt, Artificial Sequence
  derived and/or modified sequence opt3 from anti-HIV_CDR
ggcagaugcgccaggcggugg

SEQ ID NO: 28655 - RNA, 21 nt, Artificial Sequence
  derived and/or modified sequence opt3 from anti-HIV_CDR
agauuccuguuuguggucgcc

SEQ ID NO: 28656 - RNA, 21 nt, Artificial Sequence
  derived and/or modified sequence opt3 from anti-HIV_CDR
augagcguguccuuccugauc

SEQ ID NO: 28657 - RNA, 21 nt, Artificial Sequence
  derived and/or modified sequence opt3 from anti-HIV_CDR
ggcagcuccaacagaugcccc

SEQ ID NO: 28658 - RNA, 21 nt, Artificial Sequence
  derived and/or modified sequence opt3 from anti-HIV_CDR
augaagcaccugugguucuuu

SEQ ID NO: 28659 - RNA, 21 nt, Artificial Sequence
  derived and/or modified sequence opt3 from anti-HIV_CDR
gccagcugggacuucgauuuu

SEQ ID NO: 28660 - RNA, 21 nt, Artificial Sequence
  derived and/or modified sequence opt3 from anti-HIV_CDR
gagaucggcguggccgaacac

SEQ ID NO: 28661 - RNA, 21 nt, Artificial Sequence
  derived and/or modified sequence opt3 from anti-HIV_CDR
cagaaguacgacaccgccccc

SEQ ID NO: 28662 - RNA, 21 nt, Artificial Sequence
  derived and/or modified sequence opt3 from anti-HIV_CDR
cagcaaagcuccucuaccccc

SEQ ID NO: 28663 - RNA, 21 nt, Artificial Sequence
  derived and/or modified sequence opt3 from anti-HIV_CDR
cagcaaagcgccggcaccccc

SEQ ID NO: 28664 - RNA, 21 nt, Artificial Sequence
  derived and/or modified sequence opt3 from anti-HIV_CDR
cagcaaagcuccucuaagccc

SEQ ID NO: 28665 - RNA, 21 nt, Artificial Sequence
  derived and/or modified sequence opt3 from anti-HIV_CDR
caggaguacaacaccuauaca

SEQ ID NO: 28666 - RNA, 21 nt, Artificial Sequence
  derived and/or modified sequence opt3 from anti-HIV_CDR
caggaguacaacaauuauaac

SEQ ID NO: 28667 - RNA, 21 nt, Artificial Sequence
  derived and/or modified sequence opt3 from anti-HIV_CDR
cacuacgacgcccuggauuau

SEQ ID NO: 28668 - RNA, 24 nt, Artificial Sequence
  derived and/or modified sequence opt3 from anti-HIV_CDR
gccaucuucaagggcgugcagugc

SEQ ID NO: 28669 - RNA, 24 nt, Artificial Sequence
  derived and/or modified sequence opt3 from anti-HIV_CDR
ggcccccugggggacuacgauuuc

SEQ ID NO: 28670 - RNA, 24 nt, Artificial Sequence
  derived and/or modified sequence opt3 from anti-HIV_CDR
cagcaauacggcagcucccugaga

SEQ ID NO: 28671 - RNA, 24 nt, Artificial Sequence
  derived and/or modified sequence opt3 from anti-HIV_CDR
cagcaauacagccacuauagaacc

SEQ ID NO: 28672 - RNA, 24 nt, Artificial Sequence
  derived and/or modified sequence opt3 from anti-HIV_CDR
caguacuauggcaugagcgugacc

SEQ ID NO: 28673 - RNA, 24 nt, Artificial Sequence
  derived and/or modified sequence opt3 from anti-HIV_CDR
cagcaauacgagaacuggcugacc

SEQ ID NO: 28674 - RNA, 24 nt, Artificial Sequence
  derived and/or modified sequence opt3 from anti-HIV_CDR
agcggcgugcacuacauggacguc

SEQ ID NO: 28675 - RNA, 24 nt, Artificial Sequence
  derived and/or modified sequence opt3 from anti-HIV_CDR
cagcaauacagcggcccccugacc

SEQ ID NO: 28676 - RNA, 24 nt, Artificial Sequence
  derived and/or modified sequence opt3 from anti-HIV_CDR
cagcaauacuauaccgugcccagc

SEQ ID NO: 28677 - RNA, 24 nt, Artificial Sequence
  derived and/or modified sequence opt3 from anti-HIV_CDR
cagcaauacggcagcuccaucacc

SEQ ID NO: 28678 - RNA, 24 nt, Artificial Sequence
  derived and/or modified sequence opt3 from anti-HIV_CDR
caccaguacaacaagugggacacc

SEQ ID NO: 28679 - RNA, 24 nt, Artificial Sequence
  derived and/or modified sequence opt3 from anti-HIV_CDR
cagcaaagcuacaccacaccccug

SEQ ID NO: 28680 - RNA, 24 nt, Artificial Sequence
  derived and/or modified sequence opt3 from anti-HIV_CDR
cagagaugggagaccaucgacuac

SEQ ID NO: 28681 - RNA, 24 nt, Artificial Sequence
  derived and/or modified sequence opt3 from anti-HIV_CDR
ugcagcuacgccggcuccuauacc

SEQ ID NO: 28682 - RNA, 24 nt, Artificial Sequence
  derived and/or modified sequence opt3 from anti-HIV_CDR
cagcaauacgacaaccugcccacc

SEQ ID NO: 28683 - RNA, 24 nt, Artificial Sequence
  derived and/or modified sequence opt3 from anti-HIV_CDR
cagcaaugcacccugccccucaca

SEQ ID NO: 28684 - RNA, 24 nt, Artificial Sequence
  derived and/or modified sequence opt3 from anti-HIV_CDR
cagcaaagcuacuccucugugacc

SEQ ID NO: 28685 - RNA, 24 nt, Artificial Sequence
  derived and/or modified sequence opt3 from anti-HIV_CDR
cagcaaagccacaccuccgugaca

SEQ ID NO: 28686 - RNA, 24 nt, Artificial Sequence
  derived and/or modified sequence opt3 from anti-HIV_CDR
cagcaaaccuacgccagcgugaca

SEQ ID NO: 28687 - RNA, 24 nt, Artificial Sequence
  derived and/or modified sequence opt3 from anti-HIV_CDR
cagcaauacaacagcgacuauacc

SEQ ID NO: 28688 - RNA, 24 nt, Artificial Sequence
  derived and/or modified sequence opt3 from anti-HIV_CDR
caccuguacgugagcagacccguc

SEQ ID NO: 28689 - RNA, 24 nt, Artificial Sequence
  derived and/or modified sequence opt3 from anti-HIV_CDR
cagcaauacggcagaagcccccug

SEQ ID NO: 28690 - RNA, 24 nt, Artificial Sequence
  derived and/or modified sequence opt3 from anti-HIV_CDR
cagcaauacggcuccagcccccug

SEQ ID NO: 28691 - RNA, 24 nt, Artificial Sequence
  derived and/or modified sequence opt3 from anti-HIV_CDR
cagcaauacaacgacuggcccgcc

SEQ ID NO: 28692 - RNA, 24 nt, Artificial Sequence
  derived and/or modified sequence opt3 from anti-HIV_CDR
caccaguacggcagcucccaaaga

SEQ ID NO: 28693 - RNA, 24 nt, Artificial Sequence
  derived and/or modified sequence opt3 from anti-HIV_CDR
cagcaaaccuacagcuccgugaca

SEQ ID NO: 28694 - RNA, 24 nt, Artificial Sequence
  derived and/or modified sequence opt3 from anti-HIV_CDR
cagcaaaccuacagaagcgugaca

SEQ ID NO: 28695 - RNA, 24 nt, Artificial Sequence
  derived and/or modified sequence opt3 from anti-HIV_CDR
cagcaauacggcagcuccuggacc

SEQ ID NO: 28696 - RNA, 24 nt, Artificial Sequence
  derived and/or modified sequence opt3 from anti-HIV_CDR
agcuccuacgccggcaucaacaau

SEQ ID NO: 28697 - RNA, 24 nt, Artificial Sequence
  derived and/or modified sequence opt3 from anti-HIV_CDR
cagaaguacggcagcucccugacc

SEQ ID NO: 28698 - RNA, 24 nt, Artificial Sequence
  derived and/or modified sequence opt3 from anti-HIV_CDR
augcaggcccuggagacccucggc

SEQ ID NO: 28699 - RNA, 24 nt, Artificial Sequence
  derived and/or modified sequence opt3 from anti-HIV_CDR
cagcaauacgccggcagccugacc

SEQ ID NO: 28700 - RNA, 24 nt, Artificial Sequence
  derived and/or modified sequence opt3 from anti-HIV_CDR
agaaacuggggcaauuucgaccac

SEQ ID NO: 28701 - RNA, 27 nt, Artificial Sequence
  derived and/or modified sequence opt3 from anti-HIV_CDR
cagcaacacuacaccacacccuggacu

SEQ ID NO: 28702 - RNA, 27 nt, Artificial Sequence
  derived and/or modified sequence opt3 from anti-HIV_CDR
caacagagcuucgccgugcccuacacc

SEQ ID NO: 28703 - RNA, 27 nt, Artificial Sequence
  derived and/or modified sequence opt3 from anti-HIV_CDR
cagcaauacaagagcuauuccggcacc

SEQ ID NO: 28704 - RNA, 27 nt, Artificial Sequence
  derived and/or modified sequence opt3 from anti-HIV_CDR
caccaguacgccuauagccccagaacc

SEQ ID NO: 28705 - RNA, 27 nt, Artificial Sequence
  derived and/or modified sequence opt3 from anti-HIV_CDR
cagcaauacaacagcuucccucccacc

SEQ ID NO: 28706 - RNA, 27 nt, Artificial Sequence
  derived and/or modified sequence opt3 from anti-HIV_CDR
cagcaaaccuacagcaaccccagaaug

SEQ ID NO: 28707 - RNA, 27 nt, Artificial Sequence
  derived and/or modified sequence opt3 from anti-HIV_CDR
cagcaauacgaggacccucccuggacc

SEQ ID NO: 28708 - RNA, 27 nt, Artificial Sequence
  derived and/or modified sequence opt3 from anti-HIV_CDR
caccaguacuucaacacccccagaaca

SEQ ID NO: 28709 - RNA, 27 nt, Artificial Sequence
  derived and/or modified sequence opt3 from anti-HIV_CDR
caccaguacuucagcacccccagaaca

SEQ ID NO: 28710 - RNA, 27 nt, Artificial Sequence
  derived and/or modified sequence opt3 from anti-HIV_CDR
cagcacagaagcaacuggcccuggacc

SEQ ID NO: 28711 - RNA, 27 nt, Artificial Sequence
  derived and/or modified sequence opt3 from anti-HIV_CDR
agaggcaggcggcagaucggggacuac

SEQ ID NO: 28712 - RNA, 27 nt, Artificial Sequence
  derived and/or modified sequence opt3 from anti-HIV_CDR
cagcaauacggccugagccccuggacc

SEQ ID NO: 28713 - RNA, 27 nt, Artificial Sequence
  derived and/or modified sequence opt3 from anti-HIV_CDR
cagcaaaccuacacaagccccaucacu

SEQ ID NO: 28714 - RNA, 27 nt, Artificial Sequence
  derived and/or modified sequence opt3 from anti-HIV_CDR
cagcaauacggcagcuccccucccacc

SEQ ID NO: 28715 - RNA, 27 nt, Artificial Sequence
  derived and/or modified sequence opt3 from anti-HIV_CDR
cagcaauacggcaccagcuccugcaca

SEQ ID NO: 28716 - RNA, 27 nt, Artificial Sequence
  derived and/or modified sequence opt3 from anti-HIV_CDR
cagcaauacgacgaugcccccaucacc

SEQ ID NO: 28717 - RNA, 27 nt, Artificial Sequence
  derived and/or modified sequence opt3 from anti-HIV_CDR
ggcccccugcucagauaccuugacagc

SEQ ID NO: 28718 - RNA, 27 nt, Artificial Sequence
  derived and/or modified sequence opt3 from anti-HIV_CDR
ugccugaagaaaaccagcuccuacgug

SEQ ID NO: 28719 - RNA, 27 nt, Artificial Sequence
  derived and/or modified sequence opt3 from anti-HIV_CDR
cagcaauacaaccacuggccccagacc

SEQ ID NO: 28720 - RNA, 27 nt, Artificial Sequence
  derived and/or modified sequence opt3 from anti-HIV_CDR
cagcaauacagcaaccugcccuauacc

SEQ ID NO: 28721 - RNA, 27 nt, Artificial Sequence
  derived and/or modified sequence opt3 from anti-HIV_CDR
cagcaauacgacaccuaucccggcaca

SEQ ID NO: 28722 - RNA, 27 nt, Artificial Sequence
  derived and/or modified sequence opt3 from anti-HIV_CDR
caggaguacagcuccacccccuauaac

SEQ ID NO: 28723 - RNA, 27 nt, Artificial Sequence
  derived and/or modified sequence opt3 from anti-HIV_CDR
ggcgccugggacgauacccuguacgug

SEQ ID NO: 28724 - RNA, 27 nt, Artificial Sequence
  derived and/or modified sequence opt3 from anti-HIV_CDR
gccgcuugggacgauacccuguacgug

SEQ ID NO: 28725 - RNA, 27 nt, Artificial Sequence
  derived and/or modified sequence opt3 from anti-HIV_CDR
cagcaauacuauagcgacuccaucacc

SEQ ID NO: 28726 - RNA, 27 nt, Artificial Sequence
  derived and/or modified sequence opt3 from anti-HIV_CDR
cagcaauacggcagaagccccuauacc

SEQ ID NO: 28727 - RNA, 27 nt, Artificial Sequence
  derived and/or modified sequence opt3 from anti-HIV_CDR
cagcaauacaccaacuaucccuggaca

SEQ ID NO: 28728 - RNA, 27 nt, Artificial Sequence
  derived and/or modified sequence opt3 from anti-HIV_CDR
cagcaaagacacaacuggcccaucagc

SEQ ID NO: 28729 - RNA, 27 nt, Artificial Sequence
  derived and/or modified sequence opt3 from anti-HIV_CDR
cagcaauaccacaacuggcccagaacc

SEQ ID NO: 28730 - RNA, 27 nt, Artificial Sequence
  derived and/or modified sequence opt3 from anti-HIV_CDR
cagcaaagaagcaccuggcccccuaca

SEQ ID NO: 28731 - RNA, 27 nt, Artificial Sequence
  derived and/or modified sequence opt3 from anti-HIV_CDR
cagcaauacgacagcuucuccuggacc

SEQ ID NO: 28732 - RNA, 27 nt, Artificial Sequence
  derived and/or modified sequence opt3 from anti-HIV_CDR
cagcaauacaacaaucugcccgugacc

SEQ ID NO: 28733 - RNA, 27 nt, Artificial Sequence
  derived and/or modified sequence opt3 from anti-HIV_CDR
cagcaauacaacagauauagcuacacc

SEQ ID NO: 28734 - RNA, 27 nt, Artificial Sequence
  derived and/or modified sequence opt3 from anti-HIV_CDR
caggaguacuauauccugcccugcagc

SEQ ID NO: 28735 - RNA, 27 nt, Artificial Sequence
  derived and/or modified sequence opt3 from anti-HIV_CDR
cagcaauacgacaaccugcucgcccac

SEQ ID NO: 28736 - RNA, 27 nt, Artificial Sequence
  derived and/or modified sequence opt3 from anti-HIV_CDR
caccagugcgacaaccugaucgccaga

SEQ ID NO: 28737 - RNA, 27 nt, Artificial Sequence
  derived and/or modified sequence opt3 from anti-HIV_CDR
caacagagcuucuccacccuguggaca

SEQ ID NO: 28738 - RNA, 27 nt, Artificial Sequence
  derived and/or modified sequence opt3 from anti-HIV_CDR
caccagagcuacuccacacccccuacc

SEQ ID NO: 28739 - RNA, 27 nt, Artificial Sequence
  derived and/or modified sequence opt3 from anti-HIV_CDR
cagcaaggcuacagcacccccuggaca

SEQ ID NO: 28740 - RNA, 27 nt, Artificial Sequence
  derived and/or modified sequence opt3 from anti-HIV_CDR
cagcaauacagcaccacacccagaacu

SEQ ID NO: 28741 - RNA, 27 nt, Artificial Sequence
  derived and/or modified sequence opt3 from anti-HIV_CDR
cagcuguacaacagcgugccccaaacc

SEQ ID NO: 28742 - RNA, 27 nt, Artificial Sequence
  derived and/or modified sequence opt3 from anti-HIV_CDR
cagcaaagaaccagcuggccccagaca

SEQ ID NO: 28743 - RNA, 27 nt, Artificial Sequence
  derived and/or modified sequence opt3 from anti-HIV_CDR
cagcaauucaacaccuacagccagaca

SEQ ID NO: 28744 - RNA, 27 nt, Artificial Sequence
  derived and/or modified sequence opt3 from anti-HIV_CDR
augcagagccugcaaacccccaucaca

SEQ ID NO: 28745 - RNA, 27 nt, Artificial Sequence
  derived and/or modified sequence opt3 from anti-HIV_CDR
cagcaauacaacagcuauccccugacc

SEQ ID NO: 28746 - RNA, 27 nt, Artificial Sequence
  derived and/or modified sequence opt3 from anti-HIV_CDR
cagcaauacaacagcuauuccggcacc

SEQ ID NO: 28747 - RNA, 27 nt, Artificial Sequence
  derived and/or modified sequence opt3 from anti-HIV_CDR
cagagcuacgacuccucucugucaggc

SEQ ID NO: 28748 - RNA, 27 nt, Artificial Sequence
  derived and/or modified sequence opt3 from anti-HIV_CDR
agccagggcaacaccgccaucgacuac

SEQ ID NO: 28749 - RNA, 27 nt, Artificial Sequence
  derived and/or modified sequence opt3 from anti-HIV_CDR
gaggaacccagagacgccuucgaucug

SEQ ID NO: 28750 - RNA, 27 nt, Artificial Sequence
  derived and/or modified sequence opt3 from anti-HIV_CDR
cagcaaagcuacaccacacccgugacu

SEQ ID NO: 28751 - RNA, 27 nt, Artificial Sequence
  derived and/or modified sequence opt3 from anti-HIV_CDR
gccggcagagaggggugguucgacccc

SEQ ID NO: 28752 - RNA, 27 nt, Artificial Sequence
  derived and/or modified sequence opt3 from anti-HIV_CDR
cagcaauacuauagcacaccccacacc

SEQ ID NO: 28753 - RNA, 27 nt, Artificial Sequence
  derived and/or modified sequence opt3 from anti-HIV_CDR
cagcaaagcuacuccaucgccggcacc

SEQ ID NO: 28754 - RNA, 27 nt, Artificial Sequence
  derived and/or modified sequence opt3 from anti-HIV_CDR
cagaacuacaauaagcccccuagaacc

SEQ ID NO: 28755 - RNA, 27 nt, Artificial Sequence
  derived and/or modified sequence opt3 from anti-HIV_CDR
augcagagcauccaacugccccucacc

SEQ ID NO: 28756 - RNA, 27 nt, Artificial Sequence
  derived and/or modified sequence opt3 from anti-HIV_CDR
augcaggcccugcaaaccagccucaca

SEQ ID NO: 28757 - RNA, 27 nt, Artificial Sequence
  derived and/or modified sequence opt3 from anti-HIV_CDR
cagcaauacagcuccucucccagaacc

SEQ ID NO: 28758 - RNA, 27 nt, Artificial Sequence
  derived and/or modified sequence opt3 from anti-HIV_CDR
caggccugggacagcuccaccgcugug

SEQ ID NO: 28759 - RNA, 27 nt, Artificial Sequence
  derived and/or modified sequence opt3 from anti-HIV_CDR
cagcacuacaacaauuggcccuauacc

SEQ ID NO: 28760 - RNA, 27 nt, Artificial Sequence
  derived and/or modified sequence opt3 from anti-HIV_CDR
cagcaauacgacagacugcccaucacc

SEQ ID NO: 28761 - RNA, 27 nt, Artificial Sequence
  derived and/or modified sequence opt3 from anti-HIV_CDR
cagcaauacggcagcucccccaucacc

SEQ ID NO: 28762 - RNA, 27 nt, Artificial Sequence
  derived and/or modified sequence opt3 from anti-HIV_CDR
cagcaauacgacguguggccccugacc

SEQ ID NO: 28763 - RNA, 27 nt, Artificial Sequence
  derived and/or modified sequence opt3 from anti-HIV_CDR
caccaguacgccagcucccccagaacc

SEQ ID NO: 28764 - RNA, 27 nt, Artificial Sequence
  derived and/or modified sequence opt3 from anti-HIV_CDR
augcagagccugcaccuccccuacacc

SEQ ID NO: 28765 - RNA, 27 nt, Artificial Sequence
  derived and/or modified sequence opt3 from anti-HIV_CDR
cagcaauacuauuccagcccccugacc

SEQ ID NO: 28766 - RNA, 27 nt, Artificial Sequence
  derived and/or modified sequence opt3 from anti-HIV_CDR
cagcaacacgacaccuuccccuuuaca

SEQ ID NO: 28767 - RNA, 27 nt, Artificial Sequence
  derived and/or modified sequence opt3 from anti-HIV_CDR
cagcaaagcuacuccacccccuauaca

SEQ ID NO: 28768 - RNA, 27 nt, Artificial Sequence
  derived and/or modified sequence opt3 from anti-HIV_CDR
cagcaauacaagaccuaucccgugaca

SEQ ID NO: 28769 - RNA, 27 nt, Artificial Sequence
  derived and/or modified sequence opt3 from anti-HIV_CDR
cagcaauacuauagcacccccgugaca

SEQ ID NO: 28770 - RNA, 27 nt, Artificial Sequence
  derived and/or modified sequence opt3 from anti-HIV_CDR
cagcaauacaacuggcccccuuucacc

SEQ ID NO: 28771 - RNA, 27 nt, Artificial Sequence
  derived and/or modified sequence opt3 from anti-HIV_CDR
augcagggcacccacuggcccuggaca

SEQ ID NO: 28772 - RNA, 27 nt, Artificial Sequence
  derived and/or modified sequence opt3 from anti-HIV_CDR
caccagugcggcagcucccccagaacc

SEQ ID NO: 28773 - RNA, 27 nt, Artificial Sequence
  derived and/or modified sequence opt3 from anti-HIV_CDR
cagcaauacaacagcuauuucagaacc

SEQ ID NO: 28774 - RNA, 27 nt, Artificial Sequence
  derived and/or modified sequence opt3 from anti-HIV_CDR
cagcaauaccacaacuggcccccuagc

SEQ ID NO: 28775 - RNA, 27 nt, Artificial Sequence
  derived and/or modified sequence opt3 from anti-HIV_CDR
augcagggcaccuacuggcuguggaca

SEQ ID NO: 28776 - RNA, 27 nt, Artificial Sequence
  derived and/or modified sequence opt3 from anti-HIV_CDR
cagcaaggcuucagcgcccccuuuacc

SEQ ID NO: 28777 - RNA, 27 nt, Artificial Sequence
  derived and/or modified sequence opt3 from anti-HIV_CDR
cagcaauacaacaccuauccccugaca

SEQ ID NO: 28778 - RNA, 27 nt, Artificial Sequence
  derived and/or modified sequence opt3 from anti-HIV_CDR
augcagggcacccacuggcccagaaca

SEQ ID NO: 28779 - RNA, 27 nt, Artificial Sequence
  derived and/or modified sequence opt3 from anti-HIV_CDR
uucggcagaacccccugguuugacccu

SEQ ID NO: 28780 - RNA, 27 nt, Artificial Sequence
  derived and/or modified sequence opt3 from anti-HIV_CDR
cagcaauacuucaccagcgugaucaca

SEQ ID NO: 28781 - RNA, 27 nt, Artificial Sequence
  derived and/or modified sequence opt3 from anti-HIV_CDR
caccauuacaugagcgaccugcagacc

SEQ ID NO: 28782 - RNA, 27 nt, Artificial Sequence
  derived and/or modified sequence opt3 from anti-HIV_CDR
caccauuacagcuccucuucacacacc

SEQ ID NO: 28783 - RNA, 27 nt, Artificial Sequence
  derived and/or modified sequence opt3 from anti-HIV_CDR
caccauuacaagagcgacugccagacc

SEQ ID NO: 28784 - RNA, 27 nt, Artificial Sequence
  derived and/or modified sequence opt3 from anti-HIV_CDR
cagcacagaagcuccuggccccugacc

SEQ ID NO: 28785 - RNA, 27 nt, Artificial Sequence
  derived and/or modified sequence opt3 from anti-HIV_CDR
cugcagcaccauagcuaccccuggacc

SEQ ID NO: 28786 - RNA, 27 nt, Artificial Sequence
  derived and/or modified sequence opt3 from anti-HIV_CDR
cagcaauacggcaccagccccgggaca

SEQ ID NO: 28787 - RNA, 27 nt, Artificial Sequence
  derived and/or modified sequence opt3 from anti-HIV_CDR
cagcaauacggcagcucccccaccaca

SEQ ID NO: 28788 - RNA, 27 nt, Artificial Sequence
  derived and/or modified sequence opt3 from anti-HIV_CDR
cagcaauacggcaccagccccacaacu

SEQ ID NO: 28789 - RNA, 27 nt, Artificial Sequence
  derived and/or modified sequence opt3 from anti-HIV_CDR
augcaggccacccacuggcccccuggc

SEQ ID NO: 28790 - RNA, 27 nt, Artificial Sequence
  derived and/or modified sequence opt3 from anti-HIV_CDR
cagagauacaacagggaccccuauauc

SEQ ID NO: 28791 - RNA, 27 nt, Artificial Sequence
  derived and/or modified sequence opt3 from anti-HIV_CDR
cagcaauacgacaaccugccccucgcc

SEQ ID NO: 28792 - RNA, 27 nt, Artificial Sequence
  derived and/or modified sequence opt3 from anti-HIV_CDR
agcuccuacucugccaccggcguggcu

SEQ ID NO: 28793 - RNA, 27 nt, Artificial Sequence
  derived and/or modified sequence opt3 from anti-HIV_CDR
cagcacuacggcaacagcagauggacc

SEQ ID NO: 28794 - RNA, 27 nt, Artificial Sequence
  derived and/or modified sequence opt3 from anti-HIV_CDR
cagcaauacgagaccuaucccuggaca

SEQ ID NO: 28795 - RNA, 27 nt, Artificial Sequence
  derived and/or modified sequence opt3 from anti-HIV_CDR
cagcaauacggcagcucccccucuacc

SEQ ID NO: 28796 - RNA, 27 nt, Artificial Sequence
  derived and/or modified sequence opt3 from anti-HIV_CDR
cagcaaagccagagaacaccccacacc

SEQ ID NO: 28797 - RNA, 27 nt, Artificial Sequence
  derived and/or modified sequence opt3 from anti-HIV_CDR
cagcaauacgacauccugccccucacc

SEQ ID NO: 28798 - RNA, 27 nt, Artificial Sequence
  derived and/or modified sequence opt3 from anti-HIV_CDR
cagcaaagcaacuccucucccuggacc

SEQ ID NO: 28799 - RNA, 27 nt, Artificial Sequence
  derived and/or modified sequence opt3 from anti-HIV_CDR
cagcaaagcuacgacacccccagaaca

SEQ ID NO: 28800 - RNA, 27 nt, Artificial Sequence
  derived and/or modified sequence opt3 from anti-HIV_CDR
cagcaauucggcagcucccccgggacc

SEQ ID NO: 28801 - RNA, 27 nt, Artificial Sequence
  derived and/or modified sequence opt3 from anti-HIV_CDR
caccaguacggcuccagcccccaaacc

SEQ ID NO: 28802 - RNA, 27 nt, Artificial Sequence
  derived and/or modified sequence opt3 from anti-HIV_CDR
caccaguacggcagcucuccccaaucc

SEQ ID NO: 28803 - RNA, 27 nt, Artificial Sequence
  derived and/or modified sequence opt3 from anti-HIV_CDR
cugcagcacaacagcuacccccucacc

SEQ ID NO: 28804 - RNA, 27 nt, Artificial Sequence
  derived and/or modified sequence opt3 from anti-HIV_CDR
cagcaauacaacgacuggcccaucacc

SEQ ID NO: 28805 - RNA, 27 nt, Artificial Sequence
  derived and/or modified sequence opt3 from anti-HIV_CDR
cagcaaaccuucacauuucccuacacu

SEQ ID NO: 28806 - RNA, 27 nt, Artificial Sequence
  derived and/or modified sequence opt3 from anti-HIV_CDR
cagcaaagcuacaccuuccccuauauc

SEQ ID NO: 28807 - RNA, 27 nt, Artificial Sequence
  derived and/or modified sequence opt3 from anti-HIV_CDR
caguacuauggcagcucccccuacacc

SEQ ID NO: 28808 - RNA, 27 nt, Artificial Sequence
  derived and/or modified sequence opt3 from anti-HIV_CDR
caacagagcuucggcacccccagaaca

SEQ ID NO: 28809 - RNA, 27 nt, Artificial Sequence
  derived and/or modified sequence opt3 from anti-HIV_CDR
cagcaauacaacgacuggcccagaacc

SEQ ID NO: 28810 - RNA, 27 nt, Artificial Sequence
  derived and/or modified sequence opt3 from anti-HIV_CDR
cagcaauacggcagcucccccagaacc

SEQ ID NO: 28811 - RNA, 27 nt, Artificial Sequence
  derived and/or modified sequence opt3 from anti-HIV_CDR
cugcagcacaacagauaccccuggacc

SEQ ID NO: 28812 - RNA, 27 nt, Artificial Sequence
  derived and/or modified sequence opt3 from anti-HIV_CDR
cugcagcacaacaauuaccccuggacc

SEQ ID NO: 28813 - RNA, 27 nt, Artificial Sequence
  derived and/or modified sequence opt3 from anti-HIV_CDR
cugcaguacagcaccuauccccucaca

SEQ ID NO: 28814 - RNA, 27 nt, Artificial Sequence
  derived and/or modified sequence opt3 from anti-HIV_CDR
cugcaguacaacgccuauccccucacc

SEQ ID NO: 28815 - RNA, 27 nt, Artificial Sequence
  derived and/or modified sequence opt3 from anti-HIV_CDR
cagcaauacgacagcgcccccgugacc

SEQ ID NO: 28816 - RNA, 27 nt, Artificial Sequence
  derived and/or modified sequence opt3 from anti-HIV_CDR
cagcaaaccuacacauuccccuauagc

SEQ ID NO: 28817 - RNA, 27 nt, Artificial Sequence
  derived and/or modified sequence opt3 from anti-HIV_CDR
ggcuacgacaacagcgggcccgauuau

SEQ ID NO: 28818 - RNA, 27 nt, Artificial Sequence
  derived and/or modified sequence opt3 from anti-HIV_CDR
cagcaauacaacaauuggcccccugcc

SEQ ID NO: 28819 - RNA, 27 nt, Artificial Sequence
  derived and/or modified sequence opt3 from anti-HIV_CDR
caccaguacgcccugagccccuggacc

SEQ ID NO: 28820 - RNA, 27 nt, Artificial Sequence
  derived and/or modified sequence opt3 from anti-HIV_CDR
cagaaguacgacaccgaucccaugaca

SEQ ID NO: 28821 - RNA, 27 nt, Artificial Sequence
  derived and/or modified sequence opt3 from anti-HIV_CDR
cagcaauacaacuauuaccccaucacc

SEQ ID NO: 28822 - RNA, 27 nt, Artificial Sequence
  derived and/or modified sequence opt3 from anti-HIV_CDR
cagcaaaccuucacagaccccgugacu

SEQ ID NO: 28823 - RNA, 27 nt, Artificial Sequence
  derived and/or modified sequence opt3 from anti-HIV_CDR
gccgcuugggacgauagccugcacgug

SEQ ID NO: 28824 - RNA, 27 nt, Artificial Sequence
  derived and/or modified sequence opt3 from anti-HIV_CDR
cagcaauacgccagcucccccuucacc

SEQ ID NO: 28825 - RNA, 27 nt, Artificial Sequence
  derived and/or modified sequence opt3 from anti-HIV_CDR
cagcaaagcuccucuacccccuucaca

SEQ ID NO: 28826 - RNA, 27 nt, Artificial Sequence
  derived and/or modified sequence opt3 from anti-HIV_CDR
cagcaaagaagcaacugggccaucacc

SEQ ID NO: 28827 - RNA, 27 nt, Artificial Sequence
  derived and/or modified sequence opt3 from anti-HIV_CDR
cagcaauacggcagcucccccuucacc

SEQ ID NO: 28828 - RNA, 27 nt, Artificial Sequence
  derived and/or modified sequence opt3 from anti-HIV_CDR
cagaaguacaacggcgcccccuggacc

SEQ ID NO: 28829 - RNA, 27 nt, Artificial Sequence
  derived and/or modified sequence opt3 from anti-HIV_CDR
cagaaguacaacaaugcccccuggacc

SEQ ID NO: 28830 - RNA, 27 nt, Artificial Sequence
  derived and/or modified sequence opt3 from anti-HIV_CDR
cagcaaagagugaacuggcccccuaau

SEQ ID NO: 28831 - RNA, 27 nt, Artificial Sequence
  derived and/or modified sequence opt3 from anti-HIV_CDR
cagcaaagaggccacuggccccugacc

SEQ ID NO: 28832 - RNA, 27 nt, Artificial Sequence
  derived and/or modified sequence opt3 from anti-HIV_CDR
cagcaauacagauauagcgugaucauu

SEQ ID NO: 28833 - RNA, 27 nt, Artificial Sequence
  derived and/or modified sequence opt3 from anti-HIV_CDR
cagcaaagcggcaccucccugcucaca

SEQ ID NO: 28834 - RNA, 27 nt, Artificial Sequence
  derived and/or modified sequence opt3 from anti-HIV_CDR
augaagucccagcacagccccagaacc

SEQ ID NO: 28835 - RNA, 27 nt, Artificial Sequence
  derived and/or modified sequence opt3 from anti-HIV_CDR
augcagccccugcaaaccccuuacaca

SEQ ID NO: 28836 - RNA, 27 nt, Artificial Sequence
  derived and/or modified sequence opt3 from anti-HIV_CDR
cagcaauacaccgccuaucccuggaca

SEQ ID NO: 28837 - RNA, 27 nt, Artificial Sequence
  derived and/or modified sequence opt3 from anti-HIV_CDR
cugcagaaccacaauuaccccagaacc

SEQ ID NO: 28838 - RNA, 27 nt, Artificial Sequence
  derived and/or modified sequence opt3 from anti-HIV_CDR
cugcagacccacagcuaccccagaaca

SEQ ID NO: 28839 - RNA, 30 nt, Artificial Sequence
  derived and/or modified sequence opt3 from anti-HIV_CDR
gccgcuugggacgauagcuucgacuacgug

SEQ ID NO: 28840 - RNA, 30 nt, Artificial Sequence
  derived and/or modified sequence opt3 from anti-HIV_CDR
cagcacagcuucggcuccccucccuggacc

SEQ ID NO: 28841 - RNA, 30 nt, Artificial Sequence
  derived and/or modified sequence opt3 from anti-HIV_CDR
agcuccuucacccccacaaacacucuggug

SEQ ID NO: 28842 - RNA, 30 nt, Artificial Sequence
  derived and/or modified sequence opt3 from anti-HIV_CDR
cagcaauacggcacccugcaccccagaaca

SEQ ID NO: 28843 - RNA, 30 nt, Artificial Sequence
  derived and/or modified sequence opt3 from anti-HIV_CDR
cagcaauacaacaauuggcccccuaucacc

SEQ ID NO: 28844 - RNA, 30 nt, Artificial Sequence
  derived and/or modified sequence opt3 from anti-HIV_CDR
cagcaauacuaucaguggcugagcuacacc

SEQ ID NO: 28845 - RNA, 30 nt, Artificial Sequence
  derived and/or modified sequence opt3 from anti-HIV_CDR
cagcaaagagccaacuggaggcugcucacc

SEQ ID NO: 28846 - RNA, 30 nt, Artificial Sequence
  derived and/or modified sequence opt3 from anti-HIV_CDR
agacacagcgacuacugcgaucuggacgug

SEQ ID NO: 28847 - RNA, 30 nt, Artificial Sequence
  derived and/or modified sequence opt3 from anti-HIV_CDR
agaaggagcgacuacugcgauuucgacgug

SEQ ID NO: 28848 - RNA, 30 nt, Artificial Sequence
  derived and/or modified sequence opt3 from anti-HIV_CDR
agacacaccgacuacugcgauuucgacgug

SEQ ID NO: 28849 - RNA, 30 nt, Artificial Sequence
  derived and/or modified sequence opt3 from anti-HIV_CDR
cagagaagcgacuacugggauuucgacgug

SEQ ID NO: 28850 - RNA, 30 nt, Artificial Sequence
  derived and/or modified sequence opt3 from anti-HIV_CDR
agacacagcgacuacugcgauuucgacauc

SEQ ID NO: 28851 - RNA, 30 nt, Artificial Sequence
  derived and/or modified sequence opt3 from anti-HIV_CDR
ugcgagguggacgccgaugaaaccaucaca

SEQ ID NO: 28852 - RNA, 30 nt, Artificial Sequence
  derived and/or modified sequence opt3 from anti-HIV_CDR
ugcgagguggacgccgaagagaccaucauu

SEQ ID NO: 28853 - RNA, 30 nt, Artificial Sequence
  derived and/or modified sequence opt3 from anti-HIV_CDR
cagagaagcgacuucugggauuuugacgug

SEQ ID NO: 28854 - RNA, 30 nt, Artificial Sequence
  derived and/or modified sequence opt3 from anti-HIV_CDR
agacacagcgacuacugcgauuucgacgug

SEQ ID NO: 28855 - RNA, 30 nt, Artificial Sequence
  derived and/or modified sequence opt3 from anti-HIV_CDR
ugcagcuacgccggcgggagaaccgugguc

SEQ ID NO: 28856 - RNA, 30 nt, Artificial Sequence
  derived and/or modified sequence opt3 from anti-HIV_CDR
gccgcuugggacgauagccuggacuacgug

SEQ ID NO: 28857 - RNA, 30 nt, Artificial Sequence
  derived and/or modified sequence opt3 from anti-HIV_CDR
cagcaaagaagcaacuggcccaggcugacc

SEQ ID NO: 28858 - RNA, 30 nt, Artificial Sequence
  derived and/or modified sequence opt3 from anti-HIV_CDR
cagcaauacaacaauuggcccccuuucacc

SEQ ID NO: 28859 - RNA, 30 nt, Artificial Sequence
  derived and/or modified sequence opt3 from anti-HIV_CDR
augcagggcaccuacuggcccccucugaca

SEQ ID NO: 28860 - RNA, 30 nt, Artificial Sequence
  derived and/or modified sequence opt3 from anti-HIV_CDR
cagcaauacggcagcucccugcucuauacc

SEQ ID NO: 28861 - RNA, 30 nt, Artificial Sequence
  derived and/or modified sequence opt3 from anti-HIV_CDR
caacagagcuucggcaucccucccuggacc

SEQ ID NO: 28862 - RNA, 30 nt, Artificial Sequence
  derived and/or modified sequence opt3 from anti-HIV_CDR
ugcagcuacgccggcuccuauucuuacgug

SEQ ID NO: 28863 - RNA, 30 nt, Artificial Sequence
  derived and/or modified sequence opt3 from anti-HIV_CDR
uacagcuaugccggcaacucccugggggug

SEQ ID NO: 28864 - RNA, 30 nt, Artificial Sequence
  derived and/or modified sequence opt3 from anti-HIV_CDR
agcuccuacaccaucucuucacccagagug

SEQ ID NO: 28865 - RNA, 30 nt, Artificial Sequence
  derived and/or modified sequence opt3 from anti-HIV_CDR
caggagugggaacugcaacccuucgacuac

SEQ ID NO: 28866 - RNA, 30 nt, Artificial Sequence; identical to SEQ ID NO: 13582
  derived and/or modified sequence opt3 from anti-HIV_CDR

SEQ ID NO: 28867 - RNA, 30 nt, Artificial Sequence
  derived and/or modified sequence opt3 from anti-HIV_CDR
gacagagauuacgacgaggauuucgacuuu

SEQ ID NO: 28868 - RNA, 30 nt, Artificial Sequence
  derived and/or modified sequence opt3 from anti-HIV_CDR
caggaguacggcagaagcccucccuuccca

SEQ ID NO: 28869 - RNA, 30 nt, Artificial Sequence
  derived and/or modified sequence opt3 from anti-HIV_CDR
acccuggacggcaacuuccacugggauuuu

SEQ ID NO: 28870 - RNA, 30 nt, Artificial Sequence
  derived and/or modified sequence opt3 from anti-HIV_CDR
uucacccagagacaaggcggguuugacuac

SEQ ID NO: 28871 - RNA, 30 nt, Artificial Sequence
  derived and/or modified sequence opt3 from anti-HIV_CDR
cagcaauacuauaaguggcccccuaucacc

SEQ ID NO: 28872 - RNA, 30 nt, Artificial Sequence
  derived and/or modified sequence opt3 from anti-HIV_CDR
cagcaauacggcagcuccgcccccuauacc

SEQ ID NO: 28873 - RNA, 30 nt, Artificial Sequence
  derived and/or modified sequence opt3 from anti-HIV_CDR
cagcaacugaacagcgacccucccuggacc

SEQ ID NO: 28874 - RNA, 30 nt, Artificial Sequence
  derived and/or modified sequence opt3 from anti-HIV_CDR
cagcaccauggcagcucccccaccuggaca

SEQ ID NO: 28875 - RNA, 30 nt, Artificial Sequence
  derived and/or modified sequence opt3 from anti-HIV_CDR
cagcaauacaagaaauggcccccuuggacc

SEQ ID NO: 28876 - RNA, 30 nt, Artificial Sequence
  derived and/or modified sequence opt3 from anti-HIV_CDR
cagcaauacggcuucagccugcccgugacc

SEQ ID NO: 28877 - RNA, 30 nt, Artificial Sequence
  derived and/or modified sequence opt3 from anti-HIV_CDR
cagagcuacaacggcgacccucccgugacc

SEQ ID NO: 28878 - RNA, 30 nt, Artificial Sequence
  derived and/or modified sequence opt3 from anti-HIV_CDR
cagcaauacggcagcuccagaagguggacc

SEQ ID NO: 28879 - RNA, 30 nt, Artificial Sequence
  derived and/or modified sequence opt3 from anti-HIV_CDR
cagcaauucaacagcuacccuccccugacc

SEQ ID NO: 28880 - RNA, 30 nt, Artificial Sequence
  derived and/or modified sequence opt3 from anti-HIV_CDR
agagagggcagccagggggccuucgacauc

SEQ ID NO: 28881 - RNA, 30 nt, Artificial Sequence
  derived and/or modified sequence opt3 from anti-HIV_CDR
ggcgacagcgggcccaccggauucgauuac

SEQ ID NO: 28882 - RNA, 30 nt, Artificial Sequence
  derived and/or modified sequence opt3 from anti-HIV_CDR
gugagaaggggcagcuccuaccccgacuau

SEQ ID NO: 28883 - RNA, 30 nt, Artificial Sequence
  derived and/or modified sequence opt3 from anti-HIV_CDR
agcgccuacuauagaaacugguucgacucc

SEQ ID NO: 28884 - RNA, 30 nt, Artificial Sequence
  derived and/or modified sequence opt3 from anti-HIV_CDR
cagagcuacgacuccucugugucagucguu

SEQ ID NO: 28885 - RNA, 30 nt, Artificial Sequence
  derived and/or modified sequence opt3 from anti-HIV_CDR
agcuccuacaccucuucacugacacucgug

SEQ ID NO: 28886 - RNA, 30 nt, Artificial Sequence
  derived and/or modified sequence opt3 from anti-HIV_CDR
uacgagggcaagagaagcgggauggacgug

SEQ ID NO: 28887 - RNA, 30 nt, Artificial Sequence
  derived and/or modified sequence opt3 from anti-HIV_CDR
cagcaauacggcagcucccccgaguauacc

SEQ ID NO: 28888 - RNA, 30 nt, Artificial Sequence
  derived and/or modified sequence opt3 from anti-HIV_CDR
caguacuaugaccacagacccgccaucgcu

SEQ ID NO: 28889 - RNA, 30 nt, Artificial Sequence
  derived and/or modified sequence opt3 from anti-HIV_CDR
cagcaauacgacaaccugcccagagugacc

SEQ ID NO: 28890 - RNA, 30 nt, Artificial Sequence
  derived and/or modified sequence opt3 from anti-HIV_CDR
ggcgccuacaccacaacuagcacgcuggug

SEQ ID NO: 28891 - RNA, 30 nt, Artificial Sequence
  derived and/or modified sequence opt3 from anti-HIV_CDR
cagcaauacaaguccuauagcccccugacc

SEQ ID NO: 28892 - RNA, 30 nt, Artificial Sequence
  derived and/or modified sequence opt3 from anti-HIV_CDR
cagcaaagcuacaacaccagaccccugaca

SEQ ID NO: 28893 - RNA, 30 nt, Artificial Sequence
  derived and/or modified sequence opt3 from anti-HIV_CDR
cagcaauacggcgggagcccucccgacacc

SEQ ID NO: 28894 - RNA, 30 nt, Artificial Sequence
  derived and/or modified sequence opt3 from anti-HIV_CDR
ugcagcuacaccuccucugccacagugguc

SEQ ID NO: 28895 - RNA, 30 nt, Artificial Sequence
  derived and/or modified sequence opt3 from anti-HIV_CDR
ugcagccacaccuccucugacacacuggug

SEQ ID NO: 28896 - RNA, 30 nt, Artificial Sequence
  derived and/or modified sequence opt3 from anti-HIV_CDR
cagcacuacggcaacagccccagagugacc

SEQ ID NO: 28897 - RNA, 30 nt, Artificial Sequence
  derived and/or modified sequence opt3 from anti-HIV_CDR
gacgccuucgugagcuccgcuauggauguc

SEQ ID NO: 28898 - RNA, 30 nt, Artificial Sequence
  derived and/or modified sequence opt3 from anti-HIV_CDR
cugagagccaccacacccggcuucgacuac

SEQ ID NO: 28899 - RNA, 30 nt, Artificial Sequence
  derived and/or modified sequence opt3 from anti-HIV_CDR
cugagagccaccauccccggcuucgacuac

SEQ ID NO: 28900 - RNA, 30 nt, Artificial Sequence
  derived and/or modified sequence opt3 from anti-HIV_CDR
cugagagccaccaucgcuggcuucgacuac

SEQ ID NO: 28901 - RNA, 30 nt, Artificial Sequence
  derived and/or modified sequence opt3 from anti-HIV_CDR
ugcagcuacgccggcuccuauaucugggug

SEQ ID NO: 28902 - RNA, 30 nt, Artificial Sequence
  derived and/or modified sequence opt3 from anti-HIV_CDR
ugcagcuacgccggcaccuauuccuacgug

SEQ ID NO: 28903 - RNA, 30 nt, Artificial Sequence
  derived and/or modified sequence opt3 from anti-HIV_CDR
agcuccuacgccggcucuaacaauuucgug

SEQ ID NO: 28904 - RNA, 30 nt, Artificial Sequence
  derived and/or modified sequence opt3 from anti-HIV_CDR
ggcagcuucaccacaucccugacucucgug

SEQ ID NO: 28905 - RNA, 30 nt, Artificial Sequence
  derived and/or modified sequence opt3 from anti-HIV_CDR
cagcaauacgccaccagcucccuguauaca

SEQ ID NO: 28906 - RNA, 30 nt, Artificial Sequence
  derived and/or modified sequence opt3 from anti-HIV_CDR
cagugguacggcacccugcaccccagaaca

SEQ ID NO: 28907 - RNA, 30 nt, Artificial Sequence
  derived and/or modified sequence opt3 from anti-HIV_CDR
agcuccuacucuucaaccaacacauaugug

SEQ ID NO: 28908 - RNA, 30 nt, Artificial Sequence
  derived and/or modified sequence opt3 from anti-HIV_CDR
accuucaucacagccagcugguuugacucc

SEQ ID NO: 28909 - RNA, 30 nt, Artificial Sequence
  derived and/or modified sequence opt3 from anti-HIV_CDR
accggcgggcugcucagauuccccgaggug

SEQ ID NO: 28910 - RNA, 30 nt, Artificial Sequence
  derived and/or modified sequence opt3 from anti-HIV_CDR
ugcagcuacgccggcuccuauaccuacgug

SEQ ID NO: 28911 - RNA, 30 nt, Artificial Sequence
  derived and/or modified sequence opt3 from anti-HIV_CDR
cagcaaagauacagcuggcccucccugacc

SEQ ID NO: 28912 - RNA, 30 nt, Artificial Sequence
  derived and/or modified sequence opt3 from anti-HIV_CDR
cugcagugcggcagcuccccucccuacacc

SEQ ID NO: 28913 - RNA, 30 nt, Artificial Sequence; identical to SEQ ID NO: 13629
  derived and/or modified sequence opt3 from anti-HIV_CDR

SEQ ID NO: 28914 - RNA, 30 nt, Artificial Sequence
  derived and/or modified sequence opt3 from anti-HIV_CDR
agcuccuacgccgcuaccaaccacugggug

SEQ ID NO: 28915 - RNA, 30 nt, Artificial Sequence
  derived and/or modified sequence opt3 from anti-HIV_CDR
caguacuauggcaccagcccucccuccaca

SEQ ID NO: 28916 - RNA, 30 nt, Artificial Sequence
  derived and/or modified sequence opt3 from anti-HIV_CDR
caguacuauggcagcucucccccuuccacc

SEQ ID NO: 28917 - RNA, 30 nt, Artificial Sequence
  derived and/or modified sequence opt3 from anti-HIV_CDR
caggaguucggcagagccccucccuaccca

SEQ ID NO: 28918 - RNA, 30 nt, Artificial Sequence
  derived and/or modified sequence opt3 from anti-HIV_CDR
caggaguacggcagaagcccucccuaucca

SEQ ID NO: 28919 - RNA, 30 nt, Artificial Sequence
  derived and/or modified sequence opt3 from anti-HIV_CDR
caggaguacggcagagccccucccuaucca

SEQ ID NO: 28920 - RNA, 30 nt, Artificial Sequence
  derived and/or modified sequence opt3 from anti-HIV_CDR
cacaucgccgugggcgggagcgaggaacau

SEQ ID NO: 28921 - RNA, 30 nt, Artificial Sequence
  derived and/or modified sequence opt3 from anti-HIV_CDR
cacaucgccgugggcgggagcgaggaccau

SEQ ID NO: 28922 - RNA, 30 nt, Artificial Sequence
  derived and/or modified sequence opt3 from anti-HIV_CDR
cacaucgccgugggcgggagagaggaagag

SEQ ID NO: 28923 - RNA, 33 nt, Artificial Sequence
  derived and/or modified sequence opt3 from anti-HIV_CDR
ggcgagaaguccagagggagcagggccgugcag

SEQ ID NO: 28924 - RNA, 33 nt, Artificial Sequence
  derived and/or modified sequence opt3 from anti-HIV_CDR
ggcgagaaguccuucgccagcagagcugugcag

SEQ ID NO: 28925 - RNA, 33 nt, Artificial Sequence
  derived and/or modified sequence opt3 from anti-HIV_CDR
ggcagacaggcccuggggagcagggcugugcaa

SEQ ID NO: 28926 - RNA, 33 nt, Artificial Sequence
  derived and/or modified sequence opt3 from anti-HIV_CDR
ggcgaggaaagccugggguccagaucugugauc

SEQ ID NO: 28927 - RNA, 33 nt, Artificial Sequence
  derived and/or modified sequence opt3 from anti-HIV_CDR
ggcgagaagucccuggggagcagagccgugcag

SEQ ID NO: 28928 - RNA, 33 nt, Artificial Sequence
  derived and/or modified sequence opt3 from anti-HIV_CDR
ggcaaggagagcaucggguccagagccgugcag

SEQ ID NO: 28929 - RNA, 33 nt, Artificial Sequence
  derived and/or modified sequence opt3 from anti-HIV_CDR
ggcgggaacaauaucggaagcaaguccgugcac

SEQ ID NO: 28930 - RNA, 33 nt, Artificial Sequence
  derived and/or modified sequence opt3 from anti-HIV_CDR
ggcgagaaguccaucgggagcagagccgugcag

SEQ ID NO: 28931 - RNA, 33 nt, Artificial Sequence
  derived and/or modified sequence opt3 from anti-HIV_CDR
aaggccagccaggacguguccaccgcugucgca

SEQ ID NO: 28932 - RNA, 33 nt, Artificial Sequence
  derived and/or modified sequence opt3 from anti-HIV_CDR
ggcagcagaaaccugucccacaggcuccuuucu

SEQ ID NO: 28933 - RNA, 33 nt, Artificial Sequence
  derived and/or modified sequence opt3 from anti-HIV_CDR
ggcaccuacgacagccagggguccacaagacug

SEQ ID NO: 28934 - RNA, 33 nt, Artificial Sequence
  derived and/or modified sequence opt3 from anti-HIV_CDR
cagcaaagaaccaucuggcccccuggcugcagc

SEQ ID NO: 28935 - RNA, 33 nt, Artificial Sequence
  derived and/or modified sequence opt3 from anti-HIV_CDR
ggcaccugggacagcucccugucugccgugcuc

SEQ ID NO: 28936 - RNA, 33 nt, Artificial Sequence
  derived and/or modified sequence opt3 from anti-HIV_CDR
gccagcugggacaacucccugucuggccccgug

SEQ ID NO: 28937 - RNA, 33 nt, Artificial Sequence
  derived and/or modified sequence opt3 from anti-HIV_CDR
gccagcugggacgauucccugucuggcugggug

SEQ ID NO: 28938 - RNA, 33 nt, Artificial Sequence
  derived and/or modified sequence opt3 from anti-HIV_CDR
cugcuccuucccuacuauggcgggccuuggauc

SEQ ID NO: 28939 - RNA, 33 nt, Artificial Sequence
  derived and/or modified sequence opt3 from anti-HIV_CDR
cagcacagaaccaacuggcccccuagcaucaca

SEQ ID NO: 28940 - RNA, 33 nt, Artificial Sequence
  derived and/or modified sequence opt3 from anti-HIV_CDR
cagagcuacgacagaucccugaggggcucugug

SEQ ID NO: 28941 - RNA, 33 nt, Artificial Sequence
  derived and/or modified sequence opt3 from anti-HIV_CDR
agcuccggcaacuacgacuucgccuuugauauc

SEQ ID NO: 28942 - RNA, 33 nt, Artificial Sequence
  derived and/or modified sequence opt3 from anti-HIV_CDR
agcuccggcaacuacgacuucgccuaugauauc

SEQ ID NO: 28943 - RNA, 33 nt, Artificial Sequence
  derived and/or modified sequence opt3 from anti-HIV_CDR
agcuccggcaacuucgaguuugccuucgaaauc

SEQ ID NO: 28944 - RNA, 33 nt, Artificial Sequence
  derived and/or modified sequence opt3 from anti-HIV_CDR
gccaccuacgacagccacggcuccaucagacug

SEQ ID NO: 28945 - RNA, 33 nt, Artificial Sequence
  derived and/or modified sequence opt3 from anti-HIV_CDR
ggcaccuacgacacaagccugucccucagacuu

SEQ ID NO: 28946 - RNA, 33 nt, Artificial Sequence
  derived and/or modified sequence opt3 from anti-HIV_CDR
gccgcuuucgacagcgcacugucccucccccuu

SEQ ID NO: 28947 - RNA, 33 nt, Artificial Sequence
  derived and/or modified sequence opt3 from anti-HIV_CDR
gccaccuacgacagcgauggcuccaucagacug

SEQ ID NO: 28948 - RNA, 33 nt, Artificial Sequence
  derived and/or modified sequence opt3 from anti-HIV_CDR
gccaccuacgacagcggcugguccaucagacug

SEQ ID NO: 28949 - RNA, 33 nt, Artificial Sequence
  derived and/or modified sequence opt3 from anti-HIV_CDR
gccaccuacgacacaggccugagccucagacuu

SEQ ID NO: 28950 - RNA, 33 nt, Artificial Sequence
  derived and/or modified sequence opt3 from anti-HIV_CDR
gccgcuuacgacagcacccugucccucagacuu

SEQ ID NO: 28951 - RNA, 33 nt, Artificial Sequence
  derived and/or modified sequence opt3 from anti-HIV_CDR
gccgcuuacgacagcgcagugucccugcccguc

SEQ ID NO: 28952 - RNA, 33 nt, Artificial Sequence
  derived and/or modified sequence opt3 from anti-HIV_CDR
gccaccuacgacacagaucugagccucagacuu

SEQ ID NO: 28953 - RNA, 33 nt, Artificial Sequence
  derived and/or modified sequence opt3 from anti-HIV_CDR
gccgcuuacgacagcucccugucucucagacuu

SEQ ID NO: 28954 - RNA, 33 nt, Artificial Sequence
  derived and/or modified sequence opt3 from anti-HIV_CDR
gccgcuuacgacagcaccuucucccugcccgug

SEQ ID NO: 28955 - RNA, 33 nt, Artificial Sequence
  derived and/or modified sequence opt3 from anti-HIV_CDR
gccaccuacgacagccagggcuccacaagacug

SEQ ID NO: 28956 - RNA, 33 nt, Artificial Sequence
  derived and/or modified sequence opt3 from anti-HIV_CDR
gccaccuacgacagccagagauccaucaggcug

SEQ ID NO: 28957 - RNA, 33 nt, Artificial Sequence
  derived and/or modified sequence opt3 from anti-HIV_CDR
gccguguacgacagcucccugucucucggccuu

SEQ ID NO: 28958 - RNA, 33 nt, Artificial Sequence
  derived and/or modified sequence opt3 from anti-HIV_CDR
cagcacagaagcaucuggccccugaugugcacc

SEQ ID NO: 28959 - RNA, 33 nt, Artificial Sequence
  derived and/or modified sequence opt3 from anti-HIV_CDR
cugcagcccguguacaucuucagaggcaccugg

SEQ ID NO: 28960 - RNA, 33 nt, Artificial Sequence
  derived and/or modified sequence opt3 from anti-HIV_CDR
ugcgagguggacgccgaugaaaccgucacaugu

SEQ ID NO: 28961 - RNA, 33 nt, Artificial Sequence
  derived and/or modified sequence opt3 from anti-HIV_CDR
ugcgagguggacgccgaagucaccaugacaguu

SEQ ID NO: 28962 - RNA, 33 nt, Artificial Sequence
  derived and/or modified sequence opt3 from anti-HIV_CDR
agcuccuacgccgacaccaacgauuucggcgug

SEQ ID NO: 28963 - RNA, 33 nt, Artificial Sequence
  derived and/or modified sequence opt3 from anti-HIV_CDR
ugcagcuucaccuacgugaaccccacauaucug

SEQ ID NO: 28964 - RNA, 33 nt, Artificial Sequence
  derived and/or modified sequence opt3 from anti-HIV_CDR
ggcaccugggacgggagccugacaacuggagug

SEQ ID NO: 28965 - RNA, 33 nt, Artificial Sequence
  derived and/or modified sequence opt3 from anti-HIV_CDR
cagagcuacgacaacucccugucuggcugggug

SEQ ID NO: 28966 - RNA, 33 nt, Artificial Sequence
  derived and/or modified sequence opt3 from anti-HIV_CDR
cagcaauacuauagcaucccucccuggaccuuc

SEQ ID NO: 28967 - RNA, 33 nt, Artificial Sequence
  derived and/or modified sequence opt3 from anti-HIV_CDR
augcagggcaccuacuggcccccuagcaucaca

SEQ ID NO: 28968 - RNA, 33 nt, Artificial Sequence
  derived and/or modified sequence opt3 from anti-HIV_CDR
cagagcuacgacuccucucugggcguggagguc

SEQ ID NO: 28969 - RNA, 33 nt, Artificial Sequence
  derived and/or modified sequence opt3 from anti-HIV_CDR
caggugugggacagcggcagagauuccuggguc

SEQ ID NO: 28970 - RNA, 33 nt, Artificial Sequence
  derived and/or modified sequence opt3 from anti-HIV_CDR
cagagcuacgacuccucucugucaggcugggug

SEQ ID NO: 28971 - RNA, 33 nt, Artificial Sequence
  derived and/or modified sequence opt3 from anti-HIV_CDR
ggcagcugggacgggucccugaacgccggagug

SEQ ID NO: 28972 - RNA, 33 nt, Artificial Sequence
  derived and/or modified sequence opt3 from anti-HIV_CDR
cugagcgccgacuccucuucaaccuaccaggug

SEQ ID NO: 28973 - RNA, 33 nt, Artificial Sequence
  derived and/or modified sequence opt3 from anti-HIV_CDR
ugcagcuacgccggcagagacaccuccugggug

SEQ ID NO: 28974 - RNA, 33 nt, Artificial Sequence
  derived and/or modified sequence opt3 from anti-HIV_CDR
cagcaaagaagcaacuggcccccuggccugacc

SEQ ID NO: 28975 - RNA, 33 nt, Artificial Sequence
  derived and/or modified sequence opt3 from anti-HIV_CDR
aagggcagaggguacggauauugguucgacagc

SEQ ID NO: 28976 - RNA, 33 nt, Artificial Sequence
  derived and/or modified sequence opt3 from anti-HIV_CDR
gagauggccgcuaccagcgacgcauucgauauc

SEQ ID NO: 28977 - RNA, 33 nt, Artificial Sequence
  derived and/or modified sequence opt3 from anti-HIV_CDR
agcaucuacuccaccggccccgccccuguguau

SEQ ID NO: 28978 - RNA, 33 nt, Artificial Sequence
  derived and/or modified sequence opt3 from anti-HIV_CDR
agaggcagccugcucaucaaguacuucgacuau

SEQ ID NO: 28979 - RNA, 33 nt, Artificial Sequence
  derived and/or modified sequence opt3 from anti-HIV_CDR
cagcaauacgacaaccugcccccuagagugacc

SEQ ID NO: 28980 - RNA, 33 nt, Artificial Sequence
  derived and/or modified sequence opt3 from anti-HIV_CDR
gacgugagacuggucgccguucccggcgcugau

SEQ ID NO: 28981 - RNA, 33 nt, Artificial Sequence
  derived and/or modified sequence opt3 from anti-HIV_CDR
cagcaaagaaccacauggcccccugaguacacu

SEQ ID NO: 28982 - RNA, 33 nt, Artificial Sequence
  derived and/or modified sequence opt3 from anti-HIV_CDR
gccgcuugggacgauagccugaacggcugggug

SEQ ID NO: 28983 - RNA, 33 nt, Artificial Sequence
  derived and/or modified sequence opt3 from anti-HIV_CDR
agaaggcggagcgccuggucccccuucgacucu

SEQ ID NO: 28984 - RNA, 33 nt, Artificial Sequence
  derived and/or modified sequence opt3 from anti-HIV_CDR
gccaccugggacagcucccugagaacagcucuc

SEQ ID NO: 28985 - RNA, 33 nt, Artificial Sequence
  derived and/or modified sequence opt3 from anti-HIV_CDR
ggcaccugggacagcucccugagagccgcucuc

SEQ ID NO: 28986 - RNA, 33 nt, Artificial Sequence
  derived and/or modified sequence opt3 from anti-HIV_CDR
cagcaaagaagcaucuggcccccuucccugacc

SEQ ID NO: 28987 - RNA, 33 nt, Artificial Sequence
  derived and/or modified sequence opt3 from anti-HIV_CDR
gaguuccagaccagcggcguggucagagaaggg

SEQ ID NO: 28988 - RNA, 33 nt, Artificial Sequence
  derived and/or modified sequence opt3 from anti-HIV_CDR
cacaucggcgccgggggacccuacagcgaguau

SEQ ID NO: 28989 - RNA, 33 nt, Artificial Sequence
  derived and/or modified sequence opt3 from anti-HIV_CDR
agaggccacagcuucaccucccccuuugacucu

SEQ ID NO: 28990 - RNA, 33 nt, Artificial Sequence
  derived and/or modified sequence opt3 from anti-HIV_CDR
cagcaccugaacagcuaccccagaauguauacc

SEQ ID NO: 28991 - RNA, 33 nt, Artificial Sequence
  derived and/or modified sequence opt3 from anti-HIV_CDR
cagcaaagaagcaacuggcccccuaagaucacc

SEQ ID NO: 28992 - RNA, 33 nt, Artificial Sequence
  derived and/or modified sequence opt3 from anti-HIV_CDR
gccgcuugggacgauagccugggcggggugguc

SEQ ID NO: 28993 - RNA, 33 nt, Artificial Sequence
  derived and/or modified sequence opt3 from anti-HIV_CDR
ggcaccugggacagcucccugucugccgugguc

SEQ ID NO: 28994 - RNA, 33 nt, Artificial Sequence
  derived and/or modified sequence opt3 from anti-HIV_CDR
cagcaaagagccaacuggcccccuggcgggacc

SEQ ID NO: 28995 - RNA, 33 nt, Artificial Sequence
  derived and/or modified sequence opt3 from anti-HIV_CDR
ggcgggggauaccccagagguaacauggacgug

SEQ ID NO: 28996 - RNA, 33 nt, Artificial Sequence
  derived and/or modified sequence opt3 from anti-HIV_CDR
cugcuccuucuguacuauggcgggcccuggauc

SEQ ID NO: 28997 - RNA, 33 nt, Artificial Sequence
  derived and/or modified sequence opt3 from anti-HIV_CDR
cagcaaagaggcaucuggccccugcagauuacc

SEQ ID NO: 28998 - RNA, 33 nt, Artificial Sequence
  derived and/or modified sequence opt3 from anti-HIV_CDR
agaagccccggcgggggauacgccuucgacauc

SEQ ID NO: 28999 - RNA, 33 nt, Artificial Sequence
  derived and/or modified sequence opt3 from anti-HIV_CDR
agcggccccgggcugcucagaggauucgacuac

SEQ ID NO: 29000 - RNA, 33 nt, Artificial Sequence
  derived and/or modified sequence opt3 from anti-HIV_CDR
cagcaaagaaccacaaggcccccugaguacacu

SEQ ID NO: 29001 - RNA, 33 nt, Artificial Sequence
  derived and/or modified sequence opt3 from anti-HIV_CDR
cagcaaagaaccacaaggcccccugacuacacu

SEQ ID NO: 29002 - RNA, 33 nt, Artificial Sequence
  derived and/or modified sequence opt3 from anti-HIV_CDR
cagggcagaaccacaaggcccccugacuacacu

SEQ ID NO: 29003 - RNA, 33 nt, Artificial Sequence
  derived and/or modified sequence opt3 from anti-HIV_CDR
cagcaaagaagcaccacacccccugaguacacu

SEQ ID NO: 29004 - RNA, 33 nt, Artificial Sequence
  derived and/or modified sequence opt3 from anti-HIV_CDR
cagcaaagaaccagcuggccccuggcccucucc

SEQ ID NO: 29005 - RNA, 33 nt, Artificial Sequence
  derived and/or modified sequence opt3 from anti-HIV_CDR
agaggccacagcuucucccugcccuuugacucu

SEQ ID NO: 29006 - RNA, 36 nt, Artificial Sequence
  derived and/or modified sequence opt3 from anti-HIV_CDR
cacuacugggacagcagaucccccaucucuugggug

SEQ ID NO: 29007 - RNA, 36 nt, Artificial Sequence
  derived and/or modified sequence opt3 from anti-HIV_CDR
cacaagugggacagcagaucuccccuguccugggug

SEQ ID NO: 29008 - RNA, 36 nt, Artificial Sequence
  derived and/or modified sequence opt3 from anti-HIV_CDR
cacaugugggacagcagauccggcuucucuugguca

SEQ ID NO: 29009 - RNA, 36 nt, Artificial Sequence
  derived and/or modified sequence opt3 from anti-HIV_CDR
cacaucugggacagcagagugcccaccaaguggguc

SEQ ID NO: 29010 - RNA, 36 nt, Artificial Sequence
  derived and/or modified sequence opt3 from anti-HIV_CDR
caggugugggacagcuccucugaucaccccuggguc

SEQ ID NO: 29011 - RNA, 36 nt, Artificial Sequence
  derived and/or modified sequence opt3 from anti-HIV_CDR
cacaucuacgacgccagaaggcccaccaacugggug

SEQ ID NO: 29012 - RNA, 36 nt, Artificial Sequence
  derived and/or modified sequence opt3 from anti-HIV_CDR
cuggacggcgaggccuucagauacuaucucgaucuu

SEQ ID NO: 29013 - RNA, 36 nt, Artificial Sequence
  derived and/or modified sequence opt3 from anti-HIV_CDR
ccccaguacaaccugggcagagacccucucgaugug

SEQ ID NO: 29014 - RNA, 36 nt, Artificial Sequence
  derived and/or modified sequence opt3 from anti-HIV_CDR
cccgagccuagcuccaucguggccccacuguacuau

SEQ ID NO: 29015 - RNA, 36 nt, Artificial Sequence
  derived and/or modified sequence opt3 from anti-HIV_CDR
ggcgggggagacgguagaaacuggcaucugcacccc

SEQ ID NO: 29016 - RNA, 36 nt, Artificial Sequence
  derived and/or modified sequence opt3 from anti-HIV_CDR
cccaagagcggcagagacuacugguccuucgaucug

SEQ ID NO: 29017 - RNA, 36 nt, Artificial Sequence
  derived and/or modified sequence opt3 from anti-HIV_CDR
cccagaggcgggagggacaacuggagcuuccacgug

SEQ ID NO: 29018 - RNA, 36 nt, Artificial Sequence
  derived and/or modified sequence opt3 from anti-HIV_CDR
ccccacagcccugacgaugccuggucccuggacgug

SEQ ID NO: 29019 - RNA, 36 nt, Artificial Sequence
  derived and/or modified sequence opt3 from anti-HIV_CDR
ccccugagaggcggggacaccuggcacuaccauagc

SEQ ID NO: 29020 - RNA, 36 nt, Artificial Sequence
  derived and/or modified sequence opt3 from anti-HIV_CDR
cugcagcccguguacauccucagaagcauuugccac

SEQ ID NO: 29021 - RNA, 36 nt, Artificial Sequence
  derived and/or modified sequence opt3 from anti-HIV_CDR
cugcagcccguguacauccucaagugcaacuggugu

SEQ ID NO: 29022 - RNA, 36 nt, Artificial Sequence
  derived and/or modified sequence opt3 from anti-HIV_CDR
gaguacagauucgacgauuggggcccccuggaccac

SEQ ID NO: 29023 - RNA, 36 nt, Artificial Sequence
  derived and/or modified sequence opt3 from anti-HIV_CDR
gccgcuugggacgauagccugaacggccacggggug

SEQ ID NO: 29024 - RNA, 36 nt, Artificial Sequence
  derived and/or modified sequence opt3 from anti-HIV_CDR
cuguacuucgacugggcuccccacgccuuugauauc

SEQ ID NO: 29025 - RNA, 36 nt, Artificial Sequence
  derived and/or modified sequence opt3 from anti-HIV_CDR
ggccuguacgacagcuccggguauuacuucggauau

SEQ ID NO: 29026 - RNA, 36 nt, Artificial Sequence
  derived and/or modified sequence opt3 from anti-HIV_CDR
cugggcugcagcgggggauccuguuacgaggacucu

SEQ ID NO: 29027 - RNA, 36 nt, Artificial Sequence; identical to SEQ ID NO: 13743
  derived and/or modified sequence opt3 from anti-HIV_CDR

SEQ ID NO: 29028 - RNA, 36 nt, Artificial Sequence; identical to SEQ ID NO: 13744
  derived and/or modified sequence opt3 from anti-HIV_CDR

SEQ ID NO: 29029 - RNA, 36 nt, Artificial Sequence
  derived and/or modified sequence opt3 from anti-HIV_CDR
gugaagcaguuccuggaguggcucuaccuugacuau

SEQ ID NO: 29030 - RNA, 36 nt, Artificial Sequence
  derived and/or modified sequence opt3 from anti-HIV_CDR
ggcgugagaagcaucgucggggcccacuucgacuac

SEQ ID NO: 29031 - RNA, 36 nt, Artificial Sequence
  derived and/or modified sequence opt3 from anti-HIV_CDR
ggcguggggaccagauacuaugucuacuucgacagc

SEQ ID NO: 29032 - RNA, 36 nt, Artificial Sequence
  derived and/or modified sequence opt3 from anti-HIV_CDR
gcccccuacaucagcuccucucaccuggacuauugg

SEQ ID NO: 29033 - RNA, 36 nt, Artificial Sequence
  derived and/or modified sequence opt3 from anti-HIV_CDR
agaggcaucgccgcugcaggguucuacuuucagcac

SEQ ID NO: 29034 - RNA, 36 nt, Artificial Sequence
  derived and/or modified sequence opt3 from anti-HIV_CDR
agaggcaucgccgcugcagccuucuacuuucagacc

SEQ ID NO: 29035 - RNA, 36 nt, Artificial Sequence
  derived and/or modified sequence opt3 from anti-HIV_CDR
agaggcaucgccgcugcaggguucuacuuucagaac

SEQ ID NO: 29036 - RNA, 36 nt, Artificial Sequence
  derived and/or modified sequence opt3 from anti-HIV_CDR
cagagcuacgacaccucccugacagauacuggcgug

SEQ ID NO: 29037 - RNA, 36 nt, Artificial Sequence
  derived and/or modified sequence opt3 from anti-HIV_CDR
cagagcuacgacaccucccugucugauacaggcgug

SEQ ID NO: 29038 - RNA, 36 nt, Artificial Sequence
  derived and/or modified sequence opt3 from anti-HIV_CDR
agaaccacacuggugaacuucggcgucuuugaccuc

SEQ ID NO: 29039 - RNA, 36 nt, Artificial Sequence
  derived and/or modified sequence opt3 from anti-HIV_CDR
cccguggucaacaccauccugccuuacugcgacguu

SEQ ID NO: 29040 - RNA, 36 nt, Artificial Sequence
  derived and/or modified sequence opt3 from anti-HIV_CDR
ugcuacagcggcagauccagguauuucuuugacucu

SEQ ID NO: 29041 - RNA, 36 nt, Artificial Sequence
  derived and/or modified sequence opt3 from anti-HIV_CDR
gccgcuugggacgauagccuggacggcuucugggug

SEQ ID NO: 29042 - RNA, 36 nt, Artificial Sequence
  derived and/or modified sequence opt3 from anti-HIV_CDR
cugagaaggggcuacuaugacagcggggaggauuac

SEQ ID NO: 29043 - RNA, 36 nt, Artificial Sequence
  derived and/or modified sequence opt3 from anti-HIV_CDR
cugagaaggggcuacuucgacagcgggggagaucac

SEQ ID NO: 29044 - RNA, 36 nt, Artificial Sequence
  derived and/or modified sequence opt3 from anti-HIV_CDR
agcuccuacaccucuucaaguacacugggcgugguc

SEQ ID NO: 29045 - RNA, 36 nt, Artificial Sequence
  derived and/or modified sequence opt3 from anti-HIV_CDR
cuggacggcgaggccuucagauacuauuuugauagc

SEQ ID NO: 29046 - RNA, 36 nt, Artificial Sequence
  derived and/or modified sequence opt3 from anti-HIV_CDR
agaaggggccagcggcugcucgccuacuucgacuau

SEQ ID NO: 29047 - RNA, 36 nt, Artificial Sequence
  derived and/or modified sequence opt3 from anti-HIV_CDR
ccccaguacaaccugggcagagagccucucaaugug

SEQ ID NO: 29048 - RNA, 36 nt, Artificial Sequence
  derived and/or modified sequence opt3 from anti-HIV_CDR
gcccaccaugacuucuggagagcucccguggauguc

SEQ ID NO: 29049 - RNA, 36 nt, Artificial Sequence
  derived and/or modified sequence opt3 from anti-HIV_CDR
ggcagaagggaggggcugaacuuccuccuugacuac

SEQ ID NO: 29050 - RNA, 36 nt, Artificial Sequence
  derived and/or modified sequence opt3 from anti-HIV_CDR
cccgagccuagcuccaucgugggcgcccuguacuau

SEQ ID NO: 29051 - RNA, 36 nt, Artificial Sequence
  derived and/or modified sequence opt3 from anti-HIV_CDR
ggccccgacgauuucuggagcggguacccuaaguau

SEQ ID NO: 29052 - RNA, 36 nt, Artificial Sequence
  derived and/or modified sequence opt3 from anti-HIV_CDR
gacuacagcgccgcuggcagacaccuguucgauucc

SEQ ID NO: 29053 - RNA, 36 nt, Artificial Sequence
  derived and/or modified sequence opt3 from anti-HIV_CDR
gacuacaccgccagaggcaggcacuucuuugauuau

SEQ ID NO: 29054 - RNA, 36 nt, Artificial Sequence
  derived and/or modified sequence opt3 from anti-HIV_CDR
gacuacaccgccagcggcagacacuucuuugauuau

SEQ ID NO: 29055 - RNA, 36 nt, Artificial Sequence
  derived and/or modified sequence opt3 from anti-HIV_CDR
cagagcuacgacuccucucugucaggcaguugggug

SEQ ID NO: 29056 - RNA, 36 nt, Artificial Sequence
  derived and/or modified sequence opt3 from anti-HIV_CDR
cccgcccaggcuggcguggggccuagauucgacuac

SEQ ID NO: 29057 - RNA, 36 nt, Artificial Sequence
  derived and/or modified sequence opt3 from anti-HIV_CDR
ggcgccaucaacagcucuccccuguacuucgacucc

SEQ ID NO: 29058 - RNA, 36 nt, Artificial Sequence
  derived and/or modified sequence opt3 from anti-HIV_CDR
ggcgacaucaccuccagcccccuguacuucgauuuu

SEQ ID NO: 29059 - RNA, 36 nt, Artificial Sequence
  derived and/or modified sequence opt3 from anti-HIV_CDR
ggcgccaucaacagcucccccucuuacuucgacuca

SEQ ID NO: 29060 - RNA, 36 nt, Artificial Sequence
  derived and/or modified sequence opt3 from anti-HIV_CDR
uggguggucaccgccgcugaggaauacuucgacuau

SEQ ID NO: 29061 - RNA, 39 nt, Artificial Sequence
  derived and/or modified sequence opt3 from anti-HIV_CDR
gacccccagguggaggucagaggcaacgccuucgauauc

SEQ ID NO: 29062 - RNA, 39 nt, Artificial Sequence
  derived and/or modified sequence opt3 from anti-HIV_CDR
gaccacggcgaucccagaaccggguacuauuucgacuac

SEQ ID NO: 29063 - RNA, 39 nt, Artificial Sequence
  derived and/or modified sequence opt3 from anti-HIV_CDR
gacgagagcggcuacgaucugaacuggcaccucgacucc

SEQ ID NO: 29064 - RNA, 39 nt, Artificial Sequence
  derived and/or modified sequence opt3 from anti-HIV_CDR
gacggcagcggggaugacagaaacuggcaccuggauccc

SEQ ID NO: 29065 - RNA, 39 nt, Artificial Sequence
  derived and/or modified sequence opt3 from anti-HIV_CDR
gacagaagggaugacggccuggauuggcuccuugacccc

SEQ ID NO: 29066 - RNA, 39 nt, Artificial Sequence
  derived and/or modified sequence opt3 from anti-HIV_CDR
gacggcgggggagaugacagaaccuggcugcucgaugcc

SEQ ID NO: 29067 - RNA, 39 nt, Artificial Sequence
  derived and/or modified sequence opt3 from anti-HIV_CDR
gacggcagcggggaugccagagacuggcaucugcacccc

SEQ ID NO: 29068 - RNA, 39 nt, Artificial Sequence
  derived and/or modified sequence opt3 from anti-HIV_CDR
gacggcagcggggaugacaccuccugguaccuggauccc

SEQ ID NO: 29069 - RNA, 39 nt, Artificial Sequence
  derived and/or modified sequence opt3 from anti-HIV_CDR
gacggcagcggggaugacaccuccuggcaccuggauccc

SEQ ID NO: 29070 - RNA, 39 nt, Artificial Sequence
  derived and/or modified sequence opt3 from anti-HIV_CDR
gacagaagggaugacgaucgggccuggcugcucgacccc

SEQ ID NO: 29071 - RNA, 39 nt, Artificial Sequence
  derived and/or modified sequence opt3 from anti-HIV_CDR
gacggcagcggggaugccagagacuggcaccuggauccc

SEQ ID NO: 29072 - RNA, 39 nt, Artificial Sequence
  derived and/or modified sequence opt3 from anti-HIV_CDR
gacggcagcggggaugccaccuccuggcaucugcacccc

SEQ ID NO: 29073 - RNA, 39 nt, Artificial Sequence
  derived and/or modified sequence opt3 from anti-HIV_CDR
gacgagagcggcgaugaccugaaguggcaccuccauccc

SEQ ID NO: 29074 - RNA, 39 nt, Artificial Sequence
  derived and/or modified sequence opt3 from anti-HIV_CDR
gacggcagcggggaugacaccuccuggcaucugcacccc

SEQ ID NO: 29075 - RNA, 39 nt, Artificial Sequence
  derived and/or modified sequence opt3 from anti-HIV_CDR
gcccagggcgacauccugaccgagggguacuucgauuau

SEQ ID NO: 29076 - RNA, 39 nt, Artificial Sequence
  derived and/or modified sequence opt3 from anti-HIV_CDR
gacagaauguucuggcagcaacuggccaaguacgauagc

SEQ ID NO: 29077 - RNA, 39 nt, Artificial Sequence
  derived and/or modified sequence opt3 from anti-HIV_CDR
agcaccugggacuacucccugucugcccacgaggaugug

SEQ ID NO: 29078 - RNA, 39 nt, Artificial Sequence
  derived and/or modified sequence opt3 from anti-HIV_CDR
gccgcuugggacgauagccuguccggccucaacugggug

SEQ ID NO: 29079 - RNA, 39 nt, Artificial Sequence
  derived and/or modified sequence opt3 from anti-HIV_CDR
cugagcuccgacagaaucguggucguuggccccgauuac

SEQ ID NO: 29080 - RNA, 39 nt, Artificial Sequence
  derived and/or modified sequence opt3 from anti-HIV_CDR
gaggccggcagcgugaccgcuacagggcccuucgacucc

SEQ ID NO: 29081 - RNA, 39 nt, Artificial Sequence
  derived and/or modified sequence opt3 from anti-HIV_CDR
gacuucggcagagccuacgcuaucggguauuuugaguac

SEQ ID NO: 29082 - RNA, 39 nt, Artificial Sequence
  derived and/or modified sequence opt3 from anti-HIV_CDR
gacagagcccccuacggcgcuuucgagccuuuugauuuc

SEQ ID NO: 29083 - RNA, 39 nt, Artificial Sequence
  derived and/or modified sequence opt3 from anti-HIV_CDR
aacggccacagcucccugggaggggguuacuucccccau

SEQ ID NO: 29084 - RNA, 39 nt, Artificial Sequence
  derived and/or modified sequence opt3 from anti-HIV_CDR
aacggccacagcgcccugggaggggaguacuuccagcau

SEQ ID NO: 29085 - RNA, 39 nt, Artificial Sequence
  derived and/or modified sequence opt3 from anti-HIV_CDR
gccgcuagaagggcauucuacuauuacuauauggacgug

SEQ ID NO: 29086 - RNA, 39 nt, Artificial Sequence
  derived and/or modified sequence opt3 from anti-HIV_CDR
gccaacuacuaugacagcuccggcuacgggcuggauauc

SEQ ID NO: 29087 - RNA, 39 nt, Artificial Sequence
  derived and/or modified sequence opt3 from anti-HIV_CDR
cacagcagacccggcgccccuccacauuacuucgacuau

SEQ ID NO: 29088 - RNA, 39 nt, Artificial Sequence
  derived and/or modified sequence opt3 from anti-HIV_CDR
ggccugaccguggccacacucuacgacgcuuucgauguc

SEQ ID NO: 29089 - RNA, 39 nt, Artificial Sequence
  derived and/or modified sequence opt3 from anti-HIV_CDR
agagacagguacaacuggaaguauuacuaucuggaugug

SEQ ID NO: 29090 - RNA, 39 nt, Artificial Sequence
  derived and/or modified sequence opt3 from anti-HIV_CDR
gacagaggcagcuccgggugguacggauggcuggauccc

SEQ ID NO: 29091 - RNA, 39 nt, Artificial Sequence
  derived and/or modified sequence opt3 from anti-HIV_CDR
gacagacugagcuccuucuggucuggcgggaucgaucag

SEQ ID NO: 29092 - RNA, 39 nt, Artificial Sequence
  derived and/or modified sequence opt3 from anti-HIV_CDR
gacgugaucgucggcgcccugcucggggcuuucgauauu

SEQ ID NO: 29093 - RNA, 39 nt, Artificial Sequence
  derived and/or modified sequence opt3 from anti-HIV_CDR
caccugaucgcccccaccgcuggcaacuacuucuauccu

SEQ ID NO: 29094 - RNA, 39 nt, Artificial Sequence
  derived and/or modified sequence opt3 from anti-HIV_CDR
gacagcagaccccaggcccugguggcugcacucgauguc

SEQ ID NO: 29095 - RNA, 39 nt, Artificial Sequence
  derived and/or modified sequence opt3 from anti-HIV_CDR
gacgagaucgugggcgcccugcucggggcuuucgauauu

SEQ ID NO: 29096 - RNA, 39 nt, Artificial Sequence
  derived and/or modified sequence opt3 from anti-HIV_CDR
agcgaccccgccaucgcugcagccggcucccuggaucuc

SEQ ID NO: 29097 - RNA, 39 nt, Artificial Sequence
  derived and/or modified sequence opt3 from anti-HIV_CDR
cccuacgugcagaccgucgccacaacuacguucgacuuu

SEQ ID NO: 29098 - RNA, 39 nt, Artificial Sequence
  derived and/or modified sequence opt3 from anti-HIV_CDR
ggccccaagagcguggccucccugucuuacuucgacaaa

SEQ ID NO: 29099 - RNA, 39 nt, Artificial Sequence
  derived and/or modified sequence opt3 from anti-HIV_CDR
ggcgcccugugguucgggcagcucagaggacuugacccc

SEQ ID NO: 29100 - RNA, 39 nt, Artificial Sequence
  derived and/or modified sequence opt3 from anti-HIV_CDR
gaccugagacccaugaggggcaacugggccaugcacgug

SEQ ID NO: 29101 - RNA, 39 nt, Artificial Sequence
  derived and/or modified sequence opt3 from anti-HIV_CDR
gacccccaggugaacagaaggggcaauugcuucgaucac

SEQ ID NO: 29102 - RNA, 39 nt, Artificial Sequence
  derived and/or modified sequence opt3 from anti-HIV_CDR
gacccccagaucgagauuagaggcaacgccuucgauaua

SEQ ID NO: 29103 - RNA, 39 nt, Artificial Sequence
  derived and/or modified sequence opt3 from anti-HIV_CDR
gugcccagaaccacagccacuaggaacgcuuucgacauc

SEQ ID NO: 29104 - RNA, 39 nt, Artificial Sequence
  derived and/or modified sequence opt3 from anti-HIV_CDR
cacaagagcgugcugcucugguucagagagcuugacuac

SEQ ID NO: 29105 - RNA, 39 nt, Artificial Sequence
  derived and/or modified sequence opt3 from anti-HIV_CDR
gacagcgaggauuacguggacuauuacuauauggauguc

SEQ ID NO: 29106 - RNA, 39 nt, Artificial Sequence
  derived and/or modified sequence opt3 from anti-HIV_CDR
cugcccagaaccacaggcaucaggaacgccuucgacauu

SEQ ID NO: 29107 - RNA, 39 nt, Artificial Sequence
  derived and/or modified sequence opt3 from anti-HIV_CDR
cugcccagaaccacaggcaucaggaacgccuucgacuuu

SEQ ID NO: 29108 - RNA, 42 nt, Artificial Sequence
  derived and/or modified sequence opt3 from anti-HIV_CDR
ggcacccugugguucggggagagcggacucagacuugaccac

SEQ ID NO: 29109 - RNA, 42 nt, Artificial Sequence
  derived and/or modified sequence opt3 from anti-HIV_CDR
guggccuacguccacguugugaccacaagaagccuggacaac

SEQ ID NO: 29110 - RNA, 42 nt, Artificial Sequence
  derived and/or modified sequence opt3 from anti-HIV_CDR
gccgacuacgaucugcucaccagcuccuaucacuucgacucu

SEQ ID NO: 29111 - RNA, 42 nt, Artificial Sequence
  derived and/or modified sequence opt3 from anti-HIV_CDR
accagaugcuucggcgccaacuguuuuaauuucauggacgug

SEQ ID NO: 29112 - RNA, 42 nt, Artificial Sequence
  derived and/or modified sequence opt3 from anti-HIV_CDR
ggcgggcuguacugcagcuccaucucuuguauuauggacgug

SEQ ID NO: 29113 - RNA, 42 nt, Artificial Sequence
  derived and/or modified sequence opt3 from anti-HIV_CDR
aacgagccccaguaccacagccugccuggcauguucgacuau

SEQ ID NO: 29114 - RNA, 42 nt, Artificial Sequence
  derived and/or modified sequence opt3 from anti-HIV_CDR
gagcccagagaaaugggcacccugacagccggguucgaguac

SEQ ID NO: 29115 - RNA, 42 nt, Artificial Sequence
  derived and/or modified sequence opt3 from anti-HIV_CDR
gccaccggcuacagcuauggguaccuggacgcuuucgauauc

SEQ ID NO: 29116 - RNA, 42 nt, Artificial Sequence
  derived and/or modified sequence opt3 from anti-HIV_CDR
ggcagccugugguucggggaguccggacucagacuugaccac

SEQ ID NO: 29117 - RNA, 42 nt, Artificial Sequence
  derived and/or modified sequence opt3 from anti-HIV_CDR
gacaacaccaucagcggcgugguccccagaugguucgauuac

SEQ ID NO: 29118 - RNA, 42 nt, Artificial Sequence
  derived and/or modified sequence opt3 from anti-HIV_CDR
aucuacgacggcagaggguauuacagcuauuucuuugaucug

SEQ ID NO: 29119 - RNA, 42 nt, Artificial Sequence
  derived and/or modified sequence opt3 from anti-HIV_CDR
gacagauucaacuggaaugauggcggguacuuuuucgacagc

SEQ ID NO: 29120 - RNA, 42 nt, Artificial Sequence
  derived and/or modified sequence opt3 from anti-HIV_CDR
ggccacagcuccucuuggaccaaguucaacugguuugggccc

SEQ ID NO: 29121 - RNA, 42 nt, Artificial Sequence
  derived and/or modified sequence opt3 from anti-HIV_CDR
agcaucgccgcugacgauuacuauuacuauuacauggacgug

SEQ ID NO: 29122 - RNA, 42 nt, Artificial Sequence
  derived and/or modified sequence opt3 from anti-HIV_CDR
agcuucuacgacaacggcggguauuaccugggacucgauuau

SEQ ID NO: 29123 - RNA, 42 nt, Artificial Sequence
  derived and/or modified sequence opt3 from anti-HIV_CDR
gacaaggaugccagcauuuacggcuauagaauccugaaccac

SEQ ID NO: 29124 - RNA, 42 nt, Artificial Sequence
  derived and/or modified sequence opt3 from anti-HIV_CDR
gugcugaccgaccucgaucagggcaaccccagaauggacguc

SEQ ID NO: 29125 - RNA, 42 nt, Artificial Sequence
  derived and/or modified sequence opt3 from anti-HIV_CDR
agagagaucaaguucggcgaacugagcuuuuacuucgacucc

SEQ ID NO: 29126 - RNA, 42 nt, Artificial Sequence
  derived and/or modified sequence opt3 from anti-HIV_CDR
agagagaucagguucggcgaacugagcuuuuacuucgacuau

SEQ ID NO: 29127 - RNA, 42 nt, Artificial Sequence
  derived and/or modified sequence opt3 from anti-HIV_CDR
ccccacagcccuaccaacaucccauccagaccgcuggacuac

SEQ ID NO: 29128 - RNA, 42 nt, Artificial Sequence
  derived and/or modified sequence opt3 from anti-HIV_CDR
ggcgacuacgauauccugaccagcuccuaucaguucgacuac

SEQ ID NO: 29129 - RNA, 42 nt, Artificial Sequence
  derived and/or modified sequence opt3 from anti-HIV_CDR
agcaccccucugguguggcccccagccaacggccucgacguc

SEQ ID NO: 29130 - RNA, 42 nt, Artificial Sequence
  derived and/or modified sequence opt3 from anti-HIV_CDR
accagaaacacaggcaauagccugcccuacugguucgaccuc

SEQ ID NO: 29131 - RNA, 45 nt, Artificial Sequence
  derived and/or modified sequence opt3 from anti-HIV_CDR
gagaagggccaguggcugaccgugcccccuuacuauuucgacagc

SEQ ID NO: 29132 - RNA, 45 nt, Artificial Sequence
  derived and/or modified sequence opt3 from anti-HIV_CDR
ggcagcgggagauggaccaucggagccaggauuuacuucgacaac

SEQ ID NO: 29133 - RNA, 45 nt, Artificial Sequence
  derived and/or modified sequence opt3 from anti-HIV_CDR
cuggaggccgacggcgcugauuacagccccaagauguucgacuuu

SEQ ID NO: 29134 - RNA, 45 nt, Artificial Sequence
  derived and/or modified sequence opt3 from anti-HIV_CDR
cuggaggccgacggcggggauuacagccccaagauguucgacuau

SEQ ID NO: 29135 - RNA, 45 nt, Artificial Sequence
  derived and/or modified sequence opt3 from anti-HIV_CDR
cuggaggccgacggcgauaacuacagccccaagaugguggacuau

SEQ ID NO: 29136 - RNA, 45 nt, Artificial Sequence
  derived and/or modified sequence opt3 from anti-HIV_CDR
cuggaggccgacggcgaugacuacagccccaagauguucgauuau

SEQ ID NO: 29137 - RNA, 45 nt, Artificial Sequence
  derived and/or modified sequence opt3 from anti-HIV_CDR
cuggaggccgacggcagcgauuacucccccaagauguucgacuuu

SEQ ID NO: 29138 - RNA, 45 nt, Artificial Sequence
  derived and/or modified sequence opt3 from anti-HIV_CDR
cuggaggccgacggcgaugacuacagccccaagauguucgaucac

SEQ ID NO: 29139 - RNA, 45 nt, Artificial Sequence
  derived and/or modified sequence opt3 from anti-HIV_CDR
cuggaggccgacggcgaugacuacagccccaagaugguggauuau

SEQ ID NO: 29140 - RNA, 45 nt, Artificial Sequence
  derived and/or modified sequence opt3 from anti-HIV_CDR
gcccccagacuggaccucggcgagcuuagcuccggguuccacuuu

SEQ ID NO: 29141 - RNA, 45 nt, Artificial Sequence
  derived and/or modified sequence opt3 from anti-HIV_CDR
gcccccagacuggagcucggcgaacuuagcuccggguuccacuac

SEQ ID NO: 29142 - RNA, 45 nt, Artificial Sequence
  derived and/or modified sequence opt3 from anti-HIV_CDR
ggcaggcugcucaugcaguggcccccuagagggggauucgaccca

SEQ ID NO: 29143 - RNA, 45 nt, Artificial Sequence
  derived and/or modified sequence opt3 from anti-HIV_CDR
ggcaggcuguucaugcaguggcccccuagagggggauuugaccca

SEQ ID NO: 29144 - RNA, 45 nt, Artificial Sequence
  derived and/or modified sequence opt3 from anti-HIV_CDR
ggcagacuguucgugcaguggcccccucaagggggauuugaccca

SEQ ID NO: 29145 - RNA, 45 nt, Artificial Sequence
  derived and/or modified sequence opt3 from anti-HIV_CDR
ggcagacuguucaugcaguggcccccucaagggggauuugaccca

SEQ ID NO: 29146 - RNA, 45 nt, Artificial Sequence
  derived and/or modified sequence opt3 from anti-HIV_CDR
ggcagacuguucgugcaguggcccccucaagggggauuugacacc

SEQ ID NO: 29147 - RNA, 45 nt, Artificial Sequence
  derived and/or modified sequence opt3 from anti-HIV_CDR
aacaauaacaccagaaagagcaucaauauuggccccgggagggcc

SEQ ID NO: 29148 - RNA, 45 nt, Artificial Sequence
  derived and/or modified sequence opt3 from anti-HIV_CDR
cccggcuacugcaacaauaacaucuguacccacugguucgacaca

SEQ ID NO: 29149 - RNA, 45 nt, Artificial Sequence
  derived and/or modified sequence opt3 from anti-HIV_CDR
gaccugcuccccgauuacccugugagcuccgccccagaggacuuc

SEQ ID NO: 29150 - RNA, 45 nt, Artificial Sequence
  derived and/or modified sequence opt3 from anti-HIV_CDR
gagagcuggcuguacuccaacggcgacuauuacuauauggaugug

SEQ ID NO: 29151 - RNA, 45 nt, Artificial Sequence
  derived and/or modified sequence opt3 from anti-HIV_CDR
agauacugcagcuccaccacauguuauaggggccacuucgacuac

SEQ ID NO: 29152 - RNA, 45 nt, Artificial Sequence
  derived and/or modified sequence opt3 from anti-HIV_CDR
cagaccacagacgagggcagacaauggcuggugggguuccagcac

SEQ ID NO: 29153 - RNA, 45 nt, Artificial Sequence
  derived and/or modified sequence opt3 from anti-HIV_CDR
cccagcuacggcggguaugacgaucagggaugguacuucgaguau

SEQ ID NO: 29154 - RNA, 45 nt, Artificial Sequence
  derived and/or modified sequence opt3 from anti-HIV_CDR
gccgcuauccccauuggcgacagcaaguacuccuauuucgauucu

SEQ ID NO: 29155 - RNA, 45 nt, Artificial Sequence
  derived and/or modified sequence opt3 from anti-HIV_CDR
gcucccccuccaggcagcaccgagugggccuacuauuucgacuac

SEQ ID NO: 29156 - RNA, 45 nt, Artificial Sequence
  derived and/or modified sequence opt3 from anti-HIV_CDR
gcccaguuccacaacagcggcuacuauuacuccgggcuggacuau

SEQ ID NO: 29157 - RNA, 45 nt, Artificial Sequence
  derived and/or modified sequence opt3 from anti-HIV_CDR
ggcggguacgacuauggagaucacuacuauuacuauauggacgug

SEQ ID NO: 29158 - RNA, 45 nt, Artificial Sequence
  derived and/or modified sequence opt3 from anti-HIV_CDR
ggcacccagagcuacuccgccguggcucccgggugguucgacccu

SEQ ID NO: 29159 - RNA, 45 nt, Artificial Sequence
  derived and/or modified sequence opt3 from anti-HIV_CDR
aucaaggggcccccuagaggcaacuucggaguggccuuuuacuuc

SEQ ID NO: 29160 - RNA, 45 nt, Artificial Sequence
  derived and/or modified sequence opt3 from anti-HIV_CDR
aagguguacagcgacggcugguccccucccaccggguucgucuau

SEQ ID NO: 29161 - RNA, 45 nt, Artificial Sequence
  derived and/or modified sequence opt3 from anti-HIV_CDR
agauacaaguaucugcccggcgaccagcacaugccuugggauaac

SEQ ID NO: 29162 - RNA, 45 nt, Artificial Sequence
  derived and/or modified sequence opt3 from anti-HIV_CDR
agauacaaguaucugcccggcgaccagcacaugccuugggauuac

SEQ ID NO: 29163 - RNA, 45 nt, Artificial Sequence
  derived and/or modified sequence opt3 from anti-HIV_CDR
ggcgggggauacgccguggucggucccaaguauggccuggacguu

SEQ ID NO: 29164 - RNA, 45 nt, Artificial Sequence
  derived and/or modified sequence opt3 from anti-HIV_CDR
cuggacagcuccucuggcugggaggaagugggguacuucgauaga

SEQ ID NO: 29165 - RNA, 45 nt, Artificial Sequence
  derived and/or modified sequence opt3 from anti-HIV_CDR
gagaacuacagcgacggcugggaagagguggggcacuucgauuau

SEQ ID NO: 29166 - RNA, 45 nt, Artificial Sequence
  derived and/or modified sequence opt3 from anti-HIV_CDR
gagaacuacagcgacggcugggaagagguggggcacuucgauucc

SEQ ID NO: 29167 - RNA, 45 nt, Artificial Sequence
  derived and/or modified sequence opt3 from anti-HIV_CDR
gagaacuacagcgacggcuggaaugaaguggggcacuucgauuuu

SEQ ID NO: 29168 - RNA, 45 nt, Artificial Sequence
  derived and/or modified sequence opt3 from anti-HIV_CDR
gagaacuacagcgacggcugguaugaaguggggcacuucgaucug

SEQ ID NO: 29169 - RNA, 45 nt, Artificial Sequence
  derived and/or modified sequence opt3 from anti-HIV_CDR
gacagaaggcgguuccuggaguggagccucuacggcauggaugug

SEQ ID NO: 29170 - RNA, 45 nt, Artificial Sequence
  derived and/or modified sequence opt3 from anti-HIV_CDR
ggccccagaguguucuuugagagcuccggguacuauuucagggac

SEQ ID NO: 29171 - RNA, 45 nt, Artificial Sequence
  derived and/or modified sequence opt3 from anti-HIV_CDR
ggccccagagugcuguucgagagcuccgggcacuaccucagggac

SEQ ID NO: 29172 - RNA, 45 nt, Artificial Sequence
  derived and/or modified sequence opt3 from anti-HIV_CDR
ggccccagaguguucuuugagagcuccggguacuauuucaggaac

SEQ ID NO: 29173 - RNA, 45 nt, Artificial Sequence
  derived and/or modified sequence opt3 from anti-HIV_CDR
gagggcgggagccugugguucggaggugccaacuggcucgacccc

SEQ ID NO: 29174 - RNA, 45 nt, Artificial Sequence
  derived and/or modified sequence opt3 from anti-HIV_CDR
gccgacuacgauaacaucugggacagcagaggcggguucgaucug

SEQ ID NO: 29175 - RNA, 45 nt, Artificial Sequence
  derived and/or modified sequence opt3 from anti-HIV_CDR
gugggcgggaccgucuggagcggauacuccaacuaucuggacuac

SEQ ID NO: 29176 - RNA, 45 nt, Artificial Sequence
  derived and/or modified sequence opt3 from anti-HIV_CDR
gacaacagagaucaguggcuggugcucaggagcugguucgacccc

SEQ ID NO: 29177 - RNA, 45 nt, Artificial Sequence
  derived and/or modified sequence opt3 from anti-HIV_CDR
gagaagggccagugggugacccugcccccuuacuauuucgacagc

SEQ ID NO: 29178 - RNA, 48 nt, Artificial Sequence
  derived and/or modified sequence opt3 from anti-HIV_CDR
uacuucagcgacaccgauagauccgaguauucucccucacugaggagu

SEQ ID NO: 29179 - RNA, 48 nt, Artificial Sequence
  derived and/or modified sequence opt3 from anti-HIV_CDR
uacaucagcgacagagaguccgccaccuauaaucccucucugaacuca

SEQ ID NO: 29180 - RNA, 48 nt, Artificial Sequence
  derived and/or modified sequence opt3 from anti-HIV_CDR
uacuucagcgacaccgagaaguccaacuauaaucccucucugagauca

SEQ ID NO: 29181 - RNA, 48 nt, Artificial Sequence
  derived and/or modified sequence opt3 from anti-HIV_CDR
uacaucagcgacagagccuccgcuaccuauaaucccucucugaacuca

SEQ ID NO: 29182 - RNA, 48 nt, Artificial Sequence
  derived and/or modified sequence opt3 from anti-HIV_CDR
uacgugcaccauagcggcgacaccaacuauaaucccucccugaagaga

SEQ ID NO: 29183 - RNA, 48 nt, Artificial Sequence
  derived and/or modified sequence opt3 from anti-HIV_CDR
uacgugcacaagagcggcgacaccaacuauucccccucucugaaauca

SEQ ID NO: 29184 - RNA, 48 nt, Artificial Sequence
  derived and/or modified sequence opt3 from anti-HIV_CDR
uacgugcacgacagcggcgauaccaacuauaaucccucccugaagucu

SEQ ID NO: 29185 - RNA, 48 nt, Artificial Sequence
  derived and/or modified sequence opt3 from anti-HIV_CDR
uacaucagcaaguccgagucugccaacuauaaucccucacugaacagu

SEQ ID NO: 29186 - RNA, 48 nt, Artificial Sequence
  derived and/or modified sequence opt3 from anti-HIV_CDR
uacaucuauuacagcggcuccaccaacuauaaucccucucugaaguca

SEQ ID NO: 29187 - RNA, 48 nt, Artificial Sequence
  derived and/or modified sequence opt3 from anti-HIV_CDR
uacgugcacgacagcggcgauaucaacuauaaucccucccugaagaac

SEQ ID NO: 29188 - RNA, 48 nt, Artificial Sequence
  derived and/or modified sequence opt3 from anti-HIV_CDR
agcuacuaugacuucuccaucggcgaugggaacgacgccuuugaugug

SEQ ID NO: 29189 - RNA, 48 nt, Artificial Sequence
  derived and/or modified sequence opt3 from anti-HIV_CDR
ggcuucagagggagccccuuuuccucuggaucacuguacuucgacagu

SEQ ID NO: 29190 - RNA, 48 nt, Artificial Sequence
  derived and/or modified sequence opt3 from anti-HIV_CDR
gugaucagcggcagaauuaccauauucuacuauaacuacaucgacguc

SEQ ID NO: 29191 - RNA, 48 nt, Artificial Sequence
  derived and/or modified sequence opt3 from anti-HIV_CDR
gacggccugggggagguggcccccgauuacagauauggaaucgacguc

SEQ ID NO: 29192 - RNA, 48 nt, Artificial Sequence
  derived and/or modified sequence opt3 from anti-HIV_CDR
gacggccugggggagcucgcccccgcuuaccaguauggaaucgaugug

SEQ ID NO: 29193 - RNA, 48 nt, Artificial Sequence
  derived and/or modified sequence opt3 from anti-HIV_CDR
gacggccugggggagcucgcccccgcuuaccacuauggaaucgaugug

SEQ ID NO: 29194 - RNA, 48 nt, Artificial Sequence
  derived and/or modified sequence opt3 from anti-HIV_CDR
gacggccugggggagguggcccccgcuuaccucuauggaaucgaugca

SEQ ID NO: 29195 - RNA, 48 nt, Artificial Sequence
  derived and/or modified sequence opt3 from anti-HIV_CDR
gccgugaagggcuucugguuugacgaggucuacaacugguucgggccc

SEQ ID NO: 29196 - RNA, 48 nt, Artificial Sequence
  derived and/or modified sequence opt3 from anti-HIV_CDR
gccgugaagggcuucugguuugacgaucccuacaccugguucgggccu

SEQ ID NO: 29197 - RNA, 48 nt, Artificial Sequence
  derived and/or modified sequence opt3 from anti-HIV_CDR
gccgugaagggcuucugguuugacgagcccagcaccugguucgggccu

SEQ ID NO: 29198 - RNA, 48 nt, Artificial Sequence
  derived and/or modified sequence opt3 from anti-HIV_CDR
gccgugaagggccugugguucgacgagaccuacacaugguuugggccc

SEQ ID NO: 29199 - RNA, 48 nt, Artificial Sequence
  derived and/or modified sequence opt3 from anti-HIV_CDR
gccguggcuggccugugguucgaggacgcauacaacugguuugggccc

SEQ ID NO: 29200 - RNA, 48 nt, Artificial Sequence
  derived and/or modified sequence opt3 from anti-HIV_CDR
gccgaggcugaaagccagucccacucuagacccaucauguucgacuac

SEQ ID NO: 29201 - RNA, 48 nt, Artificial Sequence
  derived and/or modified sequence opt3 from anti-HIV_CDR
gccgaggcugcaagcgacucccacucuagacccaucauguucgaucau

SEQ ID NO: 29202 - RNA, 48 nt, Artificial Sequence
  derived and/or modified sequence opt3 from anti-HIV_CDR
cuggaggccgaaagcgacucccacucuagacccaucauguucgaucau

SEQ ID NO: 29203 - RNA, 48 nt, Artificial Sequence
  derived and/or modified sequence opt3 from anti-HIV_CDR
gccgaggcugaaagccagucccacucuagacccaucauguucgacuca

SEQ ID NO: 29204 - RNA, 48 nt, Artificial Sequence
  derived and/or modified sequence opt3 from anti-HIV_CDR
gccgaggcugaaagccagucccacucuagacccaucauguucgacuuu

SEQ ID NO: 29205 - RNA, 48 nt, Artificial Sequence
  derived and/or modified sequence opt3 from anti-HIV_CDR
gacaacccccugcuccagagcggcgaguucuccucuucacuugaaaau

SEQ ID NO: 29206 - RNA, 48 nt, Artificial Sequence
  derived and/or modified sequence opt3 from anti-HIV_CDR
gacaacccccugcuccagagcggcgaguucuccucuucacuugauaau

SEQ ID NO: 29207 - RNA, 48 nt, Artificial Sequence
  derived and/or modified sequence opt3 from anti-HIV_CDR
ggcagagacuacaacuucuggggaggggguggcaagaucaauuuuccc

SEQ ID NO: 29208 - RNA, 48 nt, Artificial Sequence
  derived and/or modified sequence opt3 from anti-HIV_CDR
accaacugggccaaugacuucgugacaggcuacuauagauuugauuuc

SEQ ID NO: 29209 - RNA, 48 nt, Artificial Sequence
  derived and/or modified sequence opt3 from anti-HIV_CDR
gccggccacugcagcuccaccucuucaguguacugucccuucgacaug

SEQ ID NO: 29210 - RNA, 48 nt, Artificial Sequence
  derived and/or modified sequence opt3 from anti-HIV_CDR
caggugagcuccuacucuucaaguggcuauagaagggaguucgacuac

SEQ ID NO: 29211 - RNA, 48 nt, Artificial Sequence
  derived and/or modified sequence opt3 from anti-HIV_CDR
agaauggccacccugacaggcggguacuauuacuauuacauggacgug

SEQ ID NO: 29212 - RNA, 48 nt, Artificial Sequence
  derived and/or modified sequence opt3 from anti-HIV_CDR
gagggcggguacagcgacuucugguccggauauucugguuuugauuac

SEQ ID NO: 29213 - RNA, 48 nt, Artificial Sequence
  derived and/or modified sequence opt3 from anti-HIV_CDR
cuguacuauaacuucggcagcggguacgacaccggaaucggugaucac

SEQ ID NO: 29214 - RNA, 48 nt, Artificial Sequence
  derived and/or modified sequence opt3 from anti-HIV_CDR
gccagggagggcagaugguucagcgacaacuacuaugcuauggaugug

SEQ ID NO: 29215 - RNA, 48 nt, Artificial Sequence
  derived and/or modified sequence opt3 from anti-HIV_CDR
gacagagugggcaggcggcugggggagcucagcgccggauucgauuac

SEQ ID NO: 29216 - RNA, 48 nt, Artificial Sequence
  derived and/or modified sequence opt3 from anti-HIV_CDR
gccagacccaggagcccuugggacuccaccggcuggucugugggguac

SEQ ID NO: 29217 - RNA, 48 nt, Artificial Sequence
  derived and/or modified sequence opt3 from anti-HIV_CDR
agcuacuaugacuucagauccgauucuggcaacgacgccuuugauauc

SEQ ID NO: 29218 - RNA, 48 nt, Artificial Sequence
  derived and/or modified sequence opt3 from anti-HIV_CDR
agcuacuaugacuuccagaccgauuccggcaacgacgccuuugaugug

SEQ ID NO: 29219 - RNA, 48 nt, Artificial Sequence
  derived and/or modified sequence opt3 from anti-HIV_CDR
gacaaccccgugcugcagcucggcgagcuuagcuccucucuggauuac

SEQ ID NO: 29220 - RNA, 48 nt, Artificial Sequence
  derived and/or modified sequence opt3 from anti-HIV_CDR
ggcuucagagggagccccuuuuccucuggaucaauguacuucgacagu

SEQ ID NO: 29221 - RNA, 48 nt, Artificial Sequence
  derived and/or modified sequence opt3 from anti-HIV_CDR
ggcuucagagggagcccccuguccucuggaucacucuacuuugacagu

SEQ ID NO: 29222 - RNA, 48 nt, Artificial Sequence
  derived and/or modified sequence opt3 from anti-HIV_CDR
ggcuucagagggaacguguuuagcaccggaugguucuaccuggacuuu

SEQ ID NO: 29223 - RNA, 48 nt, Artificial Sequence
  derived and/or modified sequence opt3 from anti-HIV_CDR
gacagacugagcuucuccgugcaggucgagcaaggcguucucgauuac

SEQ ID NO: 29224 - RNA, 48 nt, Artificial Sequence
  derived and/or modified sequence opt3 from anti-HIV_CDR
gacagacugagcuucuccgugcaggucgagcaaggcguucuccaguuu

SEQ ID NO: 29225 - RNA, 48 nt, Artificial Sequence
  derived and/or modified sequence opt3 from anti-HIV_CDR
gugcugagcggcagaaucaccauuuucuacuauuacuauauggacguc

SEQ ID NO: 29226 - RNA, 51 nt, Artificial Sequence
  derived and/or modified sequence opt3 from anti-HIV_CDR
uacaucagcuccgggucuucaacccugcacuaugccgacacagugaagggc

SEQ ID NO: 29227 - RNA, 51 nt, Artificial Sequence
  derived and/or modified sequence opt3 from anti-HIV_CDR
agauaccuggacuggagccccaucggcagggauaccuaugggacagacgug

SEQ ID NO: 29228 - RNA, 51 nt, Artificial Sequence
  derived and/or modified sequence opt3 from anti-HIV_CDR
agauacuucgacuggagccccuuuaggcgggauaccuauggcacagacgug

SEQ ID NO: 29229 - RNA, 51 nt, Artificial Sequence
  derived and/or modified sequence opt3 from anti-HIV_CDR
ggcagagacuacaacuucuggagcgggggagguagguauuacuuugauuuc

SEQ ID NO: 29230 - RNA, 51 nt, Artificial Sequence
  derived and/or modified sequence opt3 from anti-HIV_CDR
ggcauccaggaggacuacgauuucuggagagaauauagggagcuggacuac

SEQ ID NO: 29231 - RNA, 51 nt, Artificial Sequence
  derived and/or modified sequence opt3 from anti-HIV_CDR
gugcugaacaauaacaccagaaagagcaucaauauuggccccgggagggcc

SEQ ID NO: 29232 - RNA, 51 nt, Artificial Sequence
  derived and/or modified sequence opt3 from anti-HIV_CDR
gaccugaacuucggcguggucacccccuacuauuacuauuaccucgauguu

SEQ ID NO: 29233 - RNA, 51 nt, Artificial Sequence
  derived and/or modified sequence opt3 from anti-HIV_CDR
cacggcagaaccguguucggggucguuaggaacuacuauuacauggacgug

SEQ ID NO: 29234 - RNA, 51 nt, Artificial Sequence
  derived and/or modified sequence opt3 from anti-HIV_CDR
cacuacuauggcagcgggcugaccaaggacuacuaugaguacaucgaugug

SEQ ID NO: 29235 - RNA, 51 nt, Artificial Sequence
  derived and/or modified sequence opt3 from anti-HIV_CDR
accuacuauaacuucuggagcgaccagucccaaggccuggauuuugacuac

SEQ ID NO: 29236 - RNA, 51 nt, Artificial Sequence
  derived and/or modified sequence opt3 from anti-HIV_CDR
ggcgugugggaggcccccgacgggagcuccuacuauuacuauauggcugau

SEQ ID NO: 29237 - RNA, 51 nt, Artificial Sequence
  derived and/or modified sequence opt3 from anti-HIV_CDR
gaccagggcggguaccccgugagcccugucggaccaaagugguucgauccg

SEQ ID NO: 29238 - RNA, 51 nt, Artificial Sequence
  derived and/or modified sequence opt3 from anti-HIV_CDR
agagacaaguaccaguauaucgauagcuccggcgacuaccccuucgauagg

SEQ ID NO: 29239 - RNA, 51 nt, Artificial Sequence
  derived and/or modified sequence opt3 from anti-HIV_CDR
cagcugagagcccccaccacaagguuccggcacggcggguacuuugagaac

SEQ ID NO: 29240 - RNA, 51 nt, Artificial Sequence
  derived and/or modified sequence opt3 from anti-HIV_CDR
caggugagagcccccacccugagguuccggcacggcggguacuuugagaca

SEQ ID NO: 29241 - RNA, 51 nt, Artificial Sequence
  derived and/or modified sequence opt3 from anti-HIV_CDR
gugagcaucaccuacgccggccugauugucguucccggggcuuucgacgug

SEQ ID NO: 29242 - RNA, 51 nt, Artificial Sequence
  derived and/or modified sequence opt3 from anti-HIV_CDR
guggccaucagcuacgcuggccugauugucguucccgggccuuucgacgug

SEQ ID NO: 29243 - RNA, 51 nt, Artificial Sequence
  derived and/or modified sequence opt3 from anti-HIV_CDR
agccugaccggcagacuccaccuuggggagcuguccucuggaaucgguccc

SEQ ID NO: 29244 - RNA, 51 nt, Artificial Sequence
  derived and/or modified sequence opt3 from anti-HIV_CDR
ggcgggagcgcccugaucaccauuuucggaguggaccccaaguuugauccu

SEQ ID NO: 29245 - RNA, 51 nt, Artificial Sequence
  derived and/or modified sequence opt3 from anti-HIV_CDR
auggcccugaccagcggccccuacgacguguccggguauuacuucgauuau

SEQ ID NO: 29246 - RNA, 51 nt, Artificial Sequence
  derived and/or modified sequence opt3 from anti-HIV_CDR
auggcccuggcuagcggccccuacgacguguccggguauuacuucgauuau

SEQ ID NO: 29247 - RNA, 51 nt, Artificial Sequence
  derived and/or modified sequence opt3 from anti-HIV_CDR
auggcccugcccagcggcccucucgacagauccggguacuauuucgaugac

SEQ ID NO: 29248 - RNA, 54 nt, Artificial Sequence
  derived and/or modified sequence opt3 from anti-HIV_CDR
gugguccccauguucagcaucuuuggcguugugaaggccaacuacuucgacuau

SEQ ID NO: 29249 - RNA, 54 nt, Artificial Sequence
  derived and/or modified sequence opt3 from anti-HIV_CDR
aacagaaggguggccaugcccgaggcuaugauccugagcuucuacauggacguc

SEQ ID NO: 29250 - RNA, 54 nt, Artificial Sequence
  derived and/or modified sequence opt3 from anti-HIV_CDR
ggccugugcagagggggaaacuguaggcucggucccagcggcuggcuugacccu

SEQ ID NO: 29251 - RNA, 54 nt, Artificial Sequence
  derived and/or modified sequence opt3 from anti-HIV_CDR
acacccccucacuacgacgugcugaccggcuauccaagcuccguccucgaguuc

SEQ ID NO: 29252 - RNA, 54 nt, Artificial Sequence
  derived and/or modified sequence opt3 from anti-HIV_CDR
auccccuaccacagcgaguccuauuacaagguggucauuggcggguucgacguu

SEQ ID NO: 29253 - RNA, 54 nt, Artificial Sequence
  derived and/or modified sequence opt3 from anti-HIV_CDR
gccgaccccuucaagguggcucaggaugagggccuguuugucaucuucgacuac

SEQ ID NO: 29254 - RNA, 54 nt, Artificial Sequence
  derived and/or modified sequence opt3 from anti-HIV_CDR
gccgaccccuucaagguggcucaggaugagggccuguacgucaucuuugacuau

SEQ ID NO: 29255 - RNA, 54 nt, Artificial Sequence
  derived and/or modified sequence opt3 from anti-HIV_CDR
gccgacagauucaagguggcucaggaugagggccuguuugucaucuucgacuac

SEQ ID NO: 29256 - RNA, 54 nt, Artificial Sequence
  derived and/or modified sequence opt3 from anti-HIV_CDR
ggcagacagaccuucagggccaucuggagcgggcccccugcuguguuugacauu

SEQ ID NO: 29257 - RNA, 54 nt, Artificial Sequence
  derived and/or modified sequence opt3 from anti-HIV_CDR
ggcagacagaccuucagggccaucuggagcgggcccccuguggucuuugacauu

SEQ ID NO: 29258 - RNA, 54 nt, Artificial Sequence
  derived and/or modified sequence opt3 from anti-HIV_CDR
agcagaggcgacuacaacuucugguccggguaucccgaguaccacuuugauagg

SEQ ID NO: 29259 - RNA, 54 nt, Artificial Sequence
  derived and/or modified sequence opt3 from anti-HIV_CDR
cugcccaagagcagaauggugggcggggaccaccucccuuucuacccagauuuu

SEQ ID NO: 29260 - RNA, 54 nt, Artificial Sequence
  derived and/or modified sequence opt3 from anti-HIV_CDR
cugaccggccccagcggguacugcgacuccucuggauguuauugguucgauccu

SEQ ID NO: 29261 - RNA, 54 nt, Artificial Sequence
  derived and/or modified sequence opt3 from anti-HIV_CDR
ggcgggagcaugaucagaggagugcccuccccuuucuacuaugguauggacguc

SEQ ID NO: 29262 - RNA, 54 nt, Artificial Sequence
  derived and/or modified sequence opt3 from anti-HIV_CDR
cuguucggcgccaagagacucgggguggcucccagcggauacuauauggacguc

SEQ ID NO: 29263 - RNA, 54 nt, Artificial Sequence
  derived and/or modified sequence opt3 from anti-HIV_CDR
gacagauacgaggccgcuugguucggcgcagauaagguguaugggauggacguc

SEQ ID NO: 29264 - RNA, 54 nt, Artificial Sequence
  derived and/or modified sequence opt3 from anti-HIV_CDR
gagcacagacugcccccuccaaccggcaggcggacacgcaacugguucgacccg

SEQ ID NO: 29265 - RNA, 54 nt, Artificial Sequence
  derived and/or modified sequence opt3 from anti-HIV_CDR
ggcagagggagcuuccagggauuucaacaguacgaguauuacgguauggacgug

SEQ ID NO: 29266 - RNA, 54 nt, Artificial Sequence
  derived and/or modified sequence opt3 from anti-HIV_CDR
ggcagaggguacagccacggauuccagcaauauaacuacuaugguauggacgug

SEQ ID NO: 29267 - RNA, 54 nt, Artificial Sequence
  derived and/or modified sequence opt3 from anti-HIV_CDR
ggcagagggagcuucaccggauuugaccaguaccacuauuacgguauggaugug

SEQ ID NO: 29268 - RNA, 54 nt, Artificial Sequence
  derived and/or modified sequence opt3 from anti-HIV_CDR
ggcagagggagcaccuuccccuccgcccaguuuucuuacuucggacuggacgug

SEQ ID NO: 29269 - RNA, 54 nt, Artificial Sequence
  derived and/or modified sequence opt3 from anti-HIV_CDR
gaccuggccagauacggcgugaccagcaucguccccgaguucggguuugauuuc

SEQ ID NO: 29270 - RNA, 54 nt, Artificial Sequence
  derived and/or modified sequence opt3 from anti-HIV_CDR
agaggcaggcugaacauccccagcccuuccgccauucucaccgcuuucgacgug

SEQ ID NO: 29271 - RNA, 54 nt, Artificial Sequence
  derived and/or modified sequence opt3 from anti-HIV_CDR
ggccccgggagcauggugagaggacugaucgucaccuccuacgguauggacguu

SEQ ID NO: 29272 - RNA, 54 nt, Artificial Sequence
  derived and/or modified sequence opt3 from anti-HIV_CDR
aagagagugaccaucuucggcgucguugacacacccaggggguacuuugauuau

SEQ ID NO: 29273 - RNA, 54 nt, Artificial Sequence
  derived and/or modified sequence opt3 from anti-HIV_CDR
ggccagagaaacgugcugcacuuccucgagaggaagaaugacgccuuugauauc

SEQ ID NO: 29274 - RNA, 54 nt, Artificial Sequence
  derived and/or modified sequence opt3 from anti-HIV_CDR
gagcagaaggacuacgauuucuggaacggccuguauaaauacgggauggacgug

SEQ ID NO: 29275 - RNA, 57 nt, Artificial Sequence
  derived and/or modified sequence opt3 from anti-HIV_CDR
gacaccacaacuuucacgaccuuuggcgggggacccaacauggguggcuucgauccu

SEQ ID NO: 29276 - RNA, 57 nt, Artificial Sequence
  derived and/or modified sequence opt3 from anti-HIV_CDR
gccggccuggacuacaacuucuggaaugggaagggaagaaaaggugcuuuugaugug

SEQ ID NO: 29277 - RNA, 57 nt, Artificial Sequence
  derived and/or modified sequence opt3 from anti-HIV_CDR
aacgaggccgacuaccacgauggcaaugggcauagccugagaggaauguucgacuau

SEQ ID NO: 29278 - RNA, 57 nt, Artificial Sequence
  derived and/or modified sequence opt3 from anti-HIV_CDR
aacgagccccaguaccacgacggcaaugggcauagccugccuggaauguucgauucc

SEQ ID NO: 29279 - RNA, 57 nt, Artificial Sequence
  derived and/or modified sequence opt3 from anti-HIV_CDR
aacgagccccaguaccacgacgauaauggccauagccugccugggaugaucgacuau

SEQ ID NO: 29280 - RNA, 57 nt, Artificial Sequence
  derived and/or modified sequence opt3 from anti-HIV_CDR
aacgagccccaguaccacgacggcaaugggcauagccugccuggaauguucgauuuu

SEQ ID NO: 29281 - RNA, 57 nt, Artificial Sequence
  derived and/or modified sequence opt3 from anti-HIV_CDR
aacgagccccaguacuucgacggcagcgggcacucccugccuggaauguuugauuau

SEQ ID NO: 29282 - RNA, 57 nt, Artificial Sequence
  derived and/or modified sequence opt3 from anti-HIV_CDR
agagaggccgacuaccacgauggcaacgggcauacccugcccggaauguucgacuuu

SEQ ID NO: 29283 - RNA, 57 nt, Artificial Sequence
  derived and/or modified sequence opt3 from anti-HIV_CDR
aacgagccccaguacuaugacggcagcgggcacucccugccuggaauguucgauuac

SEQ ID NO: 29284 - RNA, 57 nt, Artificial Sequence
  derived and/or modified sequence opt3 from anti-HIV_CDR
aacgagccccaguaccacgacggcaaugggcauagccugccuggaauguucgauuau

SEQ ID NO: 29285 - RNA, 57 nt, Artificial Sequence
  derived and/or modified sequence opt3 from anti-HIV_CDR
caggacagcgauuuccacgacggccaugggcacacccugagaggaauguuugauucc

SEQ ID NO: 29286 - RNA, 57 nt, Artificial Sequence
  derived and/or modified sequence opt3 from anti-HIV_CDR
cuggacugggugagaggcgucaugaaccucguugagaaucacuacgccauggaugug

SEQ ID NO: 29287 - RNA, 57 nt, Artificial Sequence
  derived and/or modified sequence opt3 from anti-HIV_CDR
accaacggcacagagaucuucagacccgggggaggugacaugagggauaauuggcgg

SEQ ID NO: 29288 - RNA, 57 nt, Artificial Sequence
  derived and/or modified sequence opt3 from anti-HIV_CDR
gacggcagauacagcggggaugaccaguauuacuaucacuacuauuacauggaugug

SEQ ID NO: 29289 - RNA, 57 nt, Artificial Sequence
  derived and/or modified sequence opt3 from anti-HIV_CDR
cugaccaagaaccccagccaggacuucuggggcuccuaccucuauuacuuugaggau

SEQ ID NO: 29290 - RNA, 57 nt, Artificial Sequence
  derived and/or modified sequence opt3 from anti-HIV_CDR
ggcgccaccuacuauuacgacagcuccgggcaccagucuagaagggcuuucgauauc

SEQ ID NO: 29291 - RNA, 57 nt, Artificial Sequence
  derived and/or modified sequence opt3 from anti-HIV_CDR
gccuuccaggcuagcauggugagaggcgucaucguugaccccuacgggauggaugug

SEQ ID NO: 29292 - RNA, 57 nt, Artificial Sequence
  derived and/or modified sequence opt3 from anti-HIV_CDR
cacagagccgacuacgauuucuggaacggcagcaaucugaggggguauuuugacccc

SEQ ID NO: 29293 - RNA, 57 nt, Artificial Sequence
  derived and/or modified sequence opt3 from anti-HIV_CDR
cacagagccaacuacgacuucuggggcgggagcaaucugaggggauauuuugauccc

SEQ ID NO: 29294 - RNA, 57 nt, Artificial Sequence
  derived and/or modified sequence opt3 from anti-HIV_CDR
ggcuuccacuuuuggagcgggaccggaacaagacccaggaacugguacuucgaccug

SEQ ID NO: 29295 - RNA, 57 nt, Artificial Sequence
  derived and/or modified sequence opt3 from anti-HIV_CDR
aacuaccugaucgagagcagauaugacgaaaaggauuacuauuacgccauggacgug

SEQ ID NO: 29296 - RNA, 57 nt, Artificial Sequence
  derived and/or modified sequence opt3 from anti-HIV_CDR
agcagaggcuacgccuaugacuccgggggacacuacuuccccaccugguuugauccu

SEQ ID NO: 29297 - RNA, 57 nt, Artificial Sequence
  derived and/or modified sequence opt3 from anti-HIV_CDR
gacaccacaacuuucggcgccuuugggggaagccccaacauggguggccuggauccu

SEQ ID NO: 29298 - RNA, 57 nt, Artificial Sequence
  derived and/or modified sequence opt3 from anti-HIV_CDR
caccugguggucgccguugcugcaggccccgacuacuucagcuaugggauggaugug

SEQ ID NO: 29299 - RNA, 57 nt, Artificial Sequence
  derived and/or modified sequence opt3 from anti-HIV_CDR
gacaccacaacuuucagcuccuuuggcucucccccuaacaugggagggcuggaucca

SEQ ID NO: 29300 - RNA, 57 nt, Artificial Sequence
  derived and/or modified sequence opt3 from anti-HIV_CDR
gacaccacaacuuucggcgccuuugggggaggugcuaacaugggcgggcuggauccc

SEQ ID NO: 29301 - RNA, 57 nt, Artificial Sequence
  derived and/or modified sequence opt3 from anti-HIV_CDR
gacaccacaacuuucacgagcuuuggcuccccucccagaaugggagggcuggaucca

SEQ ID NO: 29302 - RNA, 57 nt, Artificial Sequence
  derived and/or modified sequence opt3 from anti-HIV_CDR
gacaccacaacuuucagcuccuuuggcucucccccucacaugggagggcuggaucca

SEQ ID NO: 29303 - RNA, 57 nt, Artificial Sequence
  derived and/or modified sequence opt3 from anti-HIV_CDR
gacagagugagcgauuacgacuucugguccggcaagaggggguauggaauggauguc

SEQ ID NO: 29304 - RNA, 57 nt, Artificial Sequence
  derived and/or modified sequence opt3 from anti-HIV_CDR
gagcugagcggcgaauaccacuucugguccgggaccuauagauacggaguggacguc

SEQ ID NO: 29305 - RNA, 57 nt, Artificial Sequence
  derived and/or modified sequence opt3 from anti-HIV_CDR
cacggcgccagcgagaacuacgggcccggauccuauucugcugaacauuuccagcac

SEQ ID NO: 29306 - RNA, 57 nt, Artificial Sequence
  derived and/or modified sequence opt3 from anti-HIV_CDR
cacggcgccagcgcuaacuacgggcccggauccuauucugcagagcauuuccagcac

SEQ ID NO: 29307 - RNA, 60 nt, Artificial Sequence
  derived and/or modified sequence opt3 from anti-HIV_CDR
cacgaggcccccagauacagcuaugcuuucaggcgguacuaucauuacggccuggacgug

SEQ ID NO: 29308 - RNA, 60 nt, Artificial Sequence
  derived and/or modified sequence opt3 from anti-HIV_CDR
accagcacauacgaccagugguccggccugcaccaugauggggugauggccuucucuuca

SEQ ID NO: 29309 - RNA, 60 nt, Artificial Sequence
  derived and/or modified sequence opt3 from anti-HIV_CDR
ggcgaguucgacagcuccggguuugauuacgaaucuugguaucccuacuauauggacgug

SEQ ID NO: 29310 - RNA, 60 nt, Artificial Sequence
  derived and/or modified sequence opt3 from anti-HIV_CDR
ggccagaccgaccugaacgaugacuucuggagcgaguacuccacacccggguuugauuau

SEQ ID NO: 29311 - RNA, 60 nt, Artificial Sequence
  derived and/or modified sequence opt3 from anti-HIV_CDR
ggccagaccgaccugaacgaugaccucuggagcgauuacuccacacccggguucgacuau

SEQ ID NO: 29312 - RNA, 60 nt, Artificial Sequence
  derived and/or modified sequence opt3 from anti-HIV_CDR
aaccugaucgaggaaagccagacccaacaggagauuaaugaaagagaccuccuugcccug

SEQ ID NO: 29313 - RNA, 60 nt, Artificial Sequence
  derived and/or modified sequence opt3 from anti-HIV_CDR
aaccugaucgaggaaagccagauucaacaggagaagaaugaaaaagagcuccuugaacug

SEQ ID NO: 29314 - RNA, 60 nt, Artificial Sequence
  derived and/or modified sequence opt3 from anti-HIV_CDR
agccugaucgagaacucccagauucaacaggaaaagaaugagcaggaccuccuucagcug

SEQ ID NO: 29315 - RNA, 60 nt, Artificial Sequence
  derived and/or modified sequence opt3 from anti-HIV_CDR
agccugaucgaggaaucccagauucaacaggagaagaacgaaaaagagcuccuugaacug

SEQ ID NO: 29316 - RNA, 60 nt, Artificial Sequence
  derived and/or modified sequence opt3 from anti-HIV_CDR
agacugaucgaggaaagccagacccaacaggagaagaacgaacaggagcuccuugaacug

SEQ ID NO: 29317 - RNA, 60 nt, Artificial Sequence
  derived and/or modified sequence opt3 from anti-HIV_CDR
agccugaucgaggaaucccagacccaacaggagaagaacgaaaaagagcuccuugaacug

SEQ ID NO: 29318 - RNA, 60 nt, Artificial Sequence
  derived and/or modified sequence opt3 from anti-HIV_CDR
aaccugcucgaggaaagccagaaucaacaggagaagaacgaacaggagcuucuggaauug

SEQ ID NO: 29319 - RNA, 60 nt, Artificial Sequence
  derived and/or modified sequence opt3 from anti-HIV_CDR
acccugaucgaggaaagccagaaccaacaggagaagaaugaacucgagcuucuggaauug

SEQ ID NO: 29320 - RNA, 60 nt, Artificial Sequence
  derived and/or modified sequence opt3 from anti-HIV_CDR
acccugcaggaggaaagccaaaaccagcaggagaagaaugaacaggagcuccuugaacug

SEQ ID NO: 29321 - RNA, 60 nt, Artificial Sequence
  derived and/or modified sequence opt3 from anti-HIV_CDR
agccugcucgaggaaucccagaaccaacaggagaagaaugaacaggagcuucuggaauug

SEQ ID NO: 29322 - RNA, 60 nt, Artificial Sequence
  derived and/or modified sequence opt3 from anti-HIV_CDR
acccugaucgaggaaagccagaaccaacaggagaagaaucagcaggaacuccuucaacug

SEQ ID NO: 29323 - RNA, 60 nt, Artificial Sequence
  derived and/or modified sequence opt3 from anti-HIV_CDR
acccugaucgaggaaagccagaaccaacaggagaagaaugaacaggagcuccuuggccug

SEQ ID NO: 29324 - RNA, 60 nt, Artificial Sequence
  derived and/or modified sequence opt3 from anti-HIV_CDR
acccugaucgaggaaagccagaaccaacaggagaagaaugaacaggagcuccuugaacug

SEQ ID NO: 29325 - RNA, 60 nt, Artificial Sequence
  derived and/or modified sequence opt3 from anti-HIV_CDR
agccugaucgaggacucccagauucaacaggaaaagaacgagaaagaacuccuugagcug

SEQ ID NO: 29326 - RNA, 60 nt, Artificial Sequence
  derived and/or modified sequence opt3 from anti-HIV_CDR
agccugcucgagaagucccagacccaacaggagaaaaacgaacaggaacuucuggaguug

SEQ ID NO: 29327 - RNA, 60 nt, Artificial Sequence
  derived and/or modified sequence opt3 from anti-HIV_CDR
agccugaucgaggaaucccagaaccaacaggagaagaaugaacaggagcuccuugaacug

SEQ ID NO: 29328 - RNA, 60 nt, Artificial Sequence
  derived and/or modified sequence opt3 from anti-HIV_CDR
ggcgaccugcucggguacaccgauagcugguaugaguucgacuacuauuacauggaugug

SEQ ID NO: 29329 - RNA, 60 nt, Artificial Sequence
  derived and/or modified sequence opt3 from anti-HIV_CDR
gacaccaacggcacagagaucuucagacccgggggaggugauaugagggacaauuggcgg

SEQ ID NO: 29330 - RNA, 60 nt, Artificial Sequence
  derived and/or modified sequence opt3 from anti-HIV_CDR
gacguggucgagagacccggcuucggggauuuuagguacgacuauuacggaauggauguu

SEQ ID NO: 29331 - RNA, 60 nt, Artificial Sequence
  derived and/or modified sequence opt3 from anti-HIV_CDR
gaccagagagauugcagcaccaacagguguuucggcguguuuggguacuauauggacguc

SEQ ID NO: 29332 - RNA, 60 nt, Artificial Sequence
  derived and/or modified sequence opt3 from anti-HIV_CDR
gacagaugggugaggccccaguucccuagcauggauuuucaauacaacggccuggacguc

SEQ ID NO: 29333 - RNA, 60 nt, Artificial Sequence
  derived and/or modified sequence opt3 from anti-HIV_CDR
gacagcggcuucgaucuggacuacuaugauaccaacgagcucuacuuuggguucgacuau

SEQ ID NO: 29334 - RNA, 60 nt, Artificial Sequence
  derived and/or modified sequence opt3 from anti-HIV_CDR
aaguaccccgccuauuacgacauccugaccgcuaacuauagaagcuacuauuucgauuac

SEQ ID NO: 29335 - RNA, 60 nt, Artificial Sequence
  derived and/or modified sequence opt3 from anti-HIV_CDR
aaguaccccgccuauuacgacauccugaccggcuauuacagaaacuauuacuucgauuau

SEQ ID NO: 29336 - RNA, 60 nt, Artificial Sequence
  derived and/or modified sequence opt3 from anti-HIV_CDR
agagugaaguucccccugugguuuggcgagaccacauacuauuacuaugggauggacguc

SEQ ID NO: 29337 - RNA, 60 nt, Artificial Sequence
  derived and/or modified sequence opt3 from anti-HIV_CDR
gagagaagcaccaaguacuccuucuggucugccgugaugaggcccgacgcuuuugaucug

SEQ ID NO: 29338 - RNA, 60 nt, Artificial Sequence
  derived and/or modified sequence opt3 from anti-HIV_CDR
cacgaggcccccagauacagcuaugcuuucaggaacuacuaucauuacggccuggacgug

SEQ ID NO: 29339 - RNA, 60 nt, Artificial Sequence
  derived and/or modified sequence opt3 from anti-HIV_CDR
gagaacgugcugauggaaagcgacgauuacaaugacuauuacuauuacuauauggauguc

SEQ ID NO: 29340 - RNA, 60 nt, Artificial Sequence
  derived and/or modified sequence opt3 from anti-HIV_CDR
gagagagugcuggucuuccccgaccaggaugccgacuauuauuacuacuuuuucgauguu

SEQ ID NO: 29341 - RNA, 60 nt, Artificial Sequence
  derived and/or modified sequence opt3 from anti-HIV_CDR
gagagagugcuggucguucccgaccaggaugccgacuacuauuacuauuucuuugaugug

SEQ ID NO: 29342 - RNA, 63 nt, Artificial Sequence
  derived and/or modified sequence opt3 from anti-HIV_CDR
gacagaagcuccgccaucggcuacuguucuucaauuaguugcuauaaggggagcuucgauaua

SEQ ID NO: 29343 - RNA, 63 nt, Artificial Sequence
  derived and/or modified sequence opt3 from anti-HIV_CDR
guggucaagaucgagccccugggcguugccccuaccaaagcuaagagaguggcaagggaaaaa

SEQ ID NO: 29344 - RNA, 63 nt, Artificial Sequence
  derived and/or modified sequence opt3 from anti-HIV_CDR
guggucagaaucgagccccugggcguugccccuaccaaggcuaaaaggguggaacgggagaag

SEQ ID NO: 29345 - RNA, 63 nt, Artificial Sequence
  derived and/or modified sequence opt3 from anti-HIV_CDR
guggucagaaucgagccccugggcauugccccuaccagggcuaagcggguugaacgcgagaaa

SEQ ID NO: 29346 - RNA, 63 nt, Artificial Sequence
  derived and/or modified sequence opt3 from anti-HIV_CDR
guggucaagaucgagcccauuggcguugccccuaccaaagcuagaaggguggaacgggagaag

SEQ ID NO: 29347 - RNA, 63 nt, Artificial Sequence
  derived and/or modified sequence opt3 from anti-HIV_CDR
guggucaagaucgagccccugggcguugccccuaccagagcuaaaaggguggaacgggagaag

SEQ ID NO: 29348 - RNA, 63 nt, Artificial Sequence
  derived and/or modified sequence opt3 from anti-HIV_CDR
gugguccagaucgagccccugggcguugccccuaccagagcuaagaggguggaacgggagaaa

SEQ ID NO: 29349 - RNA, 63 nt, Artificial Sequence
  derived and/or modified sequence opt3 from anti-HIV_CDR
guggucagaaucgagccccugggcguugccccuaccaaggcuaaaagggugcagcgggaaaag

SEQ ID NO: 29350 - RNA, 63 nt, Artificial Sequence
  derived and/or modified sequence opt3 from anti-HIV_CDR
guggucaagaucgagccccugggcguugccccuaccaaagcuaagagagugcagaggaaaaag

SEQ ID NO: 29351 - RNA, 63 nt, Artificial Sequence
  derived and/or modified sequence opt3 from anti-HIV_CDR
gugaucaagauugagccccugauagucgccccuaccaaagcuaagagaguucagagggaaaaa

SEQ ID NO: 29352 - RNA, 63 nt, Artificial Sequence
  derived and/or modified sequence opt3 from anti-HIV_CDR
guggucaagaucgagccccugggcguugccccuaccaaagcuagaagggugcagcgggaaaag

SEQ ID NO: 29353 - RNA, 63 nt, Artificial Sequence
  derived and/or modified sequence opt3 from anti-HIV_CDR
guggucaagaucgagcugcucggcguugcccccaccaaagcuaagagagugcagagggaaaaa

SEQ ID NO: 29354 - RNA, 63 nt, Artificial Sequence
  derived and/or modified sequence opt3 from anti-HIV_CDR
guggucaccaucgagccccugggcguugccccuacaaaggcuaaaagagugcagagggaaaag

SEQ ID NO: 29355 - RNA, 63 nt, Artificial Sequence
  derived and/or modified sequence opt3 from anti-HIV_CDR
guggucaagaucgagccccugggcguugccccuaccaaagcuaagagagugcagagggaaaaa

SEQ ID NO: 29356 - RNA, 63 nt, Artificial Sequence
  derived and/or modified sequence opt3 from anti-HIV_CDR
gaccuggugagcgucuccccucccuacggcaacuaugggccagauaauaacugguucgacuuu

SEQ ID NO: 29357 - RNA, 63 nt, Artificial Sequence
  derived and/or modified sequence opt3 from anti-HIV_CDR
augaaucccccuugguucagaggcgggagcaacaacccauacuccuauuacuauauggacgug

SEQ ID NO: 29358 - RNA, 63 nt, Artificial Sequence
  derived and/or modified sequence opt3 from anti-HIV_CDR
gacuggaucggcuacgauuaugacgggagcggaucccaccugagagaugagucuuucgacauu

SEQ ID NO: 29359 - RNA, 63 nt, Artificial Sequence
  derived and/or modified sequence opt3 from anti-HIV_CDR
ugcagcaucgugggcaacggggacuuccuggaggaagauucccacuaccccgccauggacguc

SEQ ID NO: 29360 - RNA, 63 nt, Artificial Sequence
  derived and/or modified sequence opt3 from anti-HIV_CDR
gacuucgugagcaucuacggcgucgccuauuuuaccgggggaggucccuccucuccugauauu

SEQ ID NO: 29361 - RNA, 66 nt, Artificial Sequence
  derived and/or modified sequence opt3 from anti-HIV_CDR
aaggccaaagacuacuauuacgagagcuccgauuauucucccuacuauuacuauuacauggacgug

SEQ ID NO: 29362 - RNA, 66 nt, Artificial Sequence
  derived and/or modified sequence opt3 from anti-HIV_CDR
gaccacggcaucaagcccgauaacuacuaugacauuagcggguacaaucuggauuauuucgacuac

SEQ ID NO: 29363 - RNA, 66 nt, Artificial Sequence
  derived and/or modified sequence opt3 from anti-HIV_CDR
ggcagccuguacgacuauagagauaacgccgaccucaagcccuccuacuauuacgcuauggaugug

SEQ ID NO: 29364 - RNA, 66 nt, Artificial Sequence
  derived and/or modified sequence opt3 from anti-HIV_CDR
gacgaggccagcuggguggaagcugcagaugagugggacgaacaccuguucagagagauggccguc

SEQ ID NO: 29365 - RNA, 66 nt, Artificial Sequence
  derived and/or modified sequence opt3 from anti-HIV_CDR
gacgaggugagcugggucgaagccgcugaugagugggacgaacaccuguucagagagauggcaguu

SEQ ID NO: 29366 - RNA, 66 nt, Artificial Sequence
  derived and/or modified sequence opt3 from anti-HIV_CDR
gacgagggcagcuggguggaagccgcugaugagugggacgaacaccuguucagagagauggcaguc

SEQ ID NO: 29367 - RNA, 66 nt, Artificial Sequence
  derived and/or modified sequence opt3 from anti-HIV_CDR
gaccagagaggcagguacagcuucggguuugugaccggacaaacaaaggucuccgccaucucugau

SEQ ID NO: 29368 - RNA, 66 nt, Artificial Sequence
  derived and/or modified sequence opt3 from anti-HIV_CDR
gaccagcugggcagauacagcuucggguuugugaccggacaaaacaaggucuccgccaucucugau

SEQ ID NO: 29369 - RNA, 66 nt, Artificial Sequence
  derived and/or modified sequence opt3 from anti-HIV_CDR
gaccaggugggcagauacagcuucggguuugccaccggacaacagagggucuccgcuaucucugau

SEQ ID NO: 29370 - RNA, 69 nt, Artificial Sequence
  derived and/or modified sequence opt3 from anti-HIV_CDR
guggucaagaucgagccccugggcguugccccuaccaaagcuaagagaagggugguacagcgggaaaaa

SEQ ID NO: 29371 - RNA, 69 nt, Artificial Sequence
  derived and/or modified sequence opt3 from anti-HIV_CDR
agaaucagcuccucuucaugguacaugguggacaacagucacacccugcauuucuauuacauggauguc

SEQ ID NO: 29372 - RNA, 69 nt, Artificial Sequence
  derived and/or modified sequence opt3 from anti-HIV_CDR
gacaagcccgccuacgaugaguaugcugaagagaccaucgcaccucacaacuaccaugccauggaccug

SEQ ID NO: 29373 - RNA, 69 nt, Artificial Sequence
  derived and/or modified sequence opt3 from anti-HIV_CDR
cagaacaucgccgcuagagcagccgagaagcuguacgaaaaugacuauuacuucuauggcauggaugug

SEQ ID NO: 29374 - RNA, 69 nt, Artificial Sequence
  derived and/or modified sequence opt3 from anti-HIV_CDR
cagaacaucgccgcuagaaccgcagagaggcuguacgaaaaugacuauuacuucuauggcauggaugug

SEQ ID NO: 29375 - RNA, 72 nt, Artificial Sequence
  derived and/or modified sequence opt3 from anti-HIV_CDR
gcccagcaaggcaagagaaucuacgggauugugagcuucggagaguuuuucuauuacuauuacauggacgcu

SEQ ID NO: 29376 - RNA, 72 nt, Artificial Sequence
  derived and/or modified sequence opt3 from anti-HIV_CDR
acccagcaaggcaagagaaucuacgggguggucagcuucggagaguuuuuccacuauuacuauauggacgcc

SEQ ID NO: 29377 - RNA, 72 nt, Artificial Sequence
  derived and/or modified sequence opt3 from anti-HIV_CDR
gccagaaggggccagcggaucuacgggguggucagcuucggagaguuuuucuauuacuauuccauggacguu

SEQ ID NO: 29378 - RNA, 72 nt, Artificial Sequence
  derived and/or modified sequence opt3 from anti-HIV_CDR
acccugcacggcagaaggaucuacgggauuguggccuucaacgagugguuuacauauuucuacauggacguc

SEQ ID NO: 29379 - RNA, 72 nt, Artificial Sequence
  derived and/or modified sequence opt3 from anti-HIV_CDR
accaagcacggcagaaggaucuacgggauuguggccuucaacgagugguuuacauauuucuacauggacguc

SEQ ID NO: 29380 - RNA, 72 nt, Artificial Sequence
  derived and/or modified sequence opt3 from anti-HIV_CDR
gccagacacggccagaggaucuacgggguggucagcuucggagaguuuuucaccuauuacuccauggacguu

SEQ ID NO: 29381 - RNA, 72 nt, Artificial Sequence
  derived and/or modified sequence opt3 from anti-HIV_CDR
acccagcaaggcaagagaaucuacgggguggucagcuucggagacuauuacuauuacuauuacauggauguu

SEQ ID NO: 29382 - RNA, 72 nt, Artificial Sequence
  derived and/or modified sequence opt3 from anti-HIV_CDR
accaagcacggcagaaggaucuacgggguggucgccuucggagagugguuuacauauuucuacauggacguu

SEQ ID NO: 29383 - RNA, 72 nt, Artificial Sequence
  derived and/or modified sequence opt3 from anti-HIV_CDR
gccgugaucaccgaccugcacacauucggcgauuacgagcucgaagaccccagcuauuacuauauggauguc

SEQ ID NO: 29384 - RNA, 72 nt, Artificial Sequence
  derived and/or modified sequence opt3 from anti-HIV_CDR
gacagaggcgauaccaggcugcucgacuacggggauuaugaggacgaacgguacuauuacggaauggaugug

SEQ ID NO: 29385 - RNA, 72 nt, Artificial Sequence
  derived and/or modified sequence opt3 from anti-HIV_CDR
ggcaccagauacgacuucuggagcggguuuuccaacagggauggacgggcccuggcugguuauuucgacuac

SEQ ID NO: 29386 - RNA, 72 nt, Artificial Sequence
  derived and/or modified sequence opt3 from anti-HIV_CDR
gacggcaaggggaaagccuacuaugauuucuggagcggauacagaaaccagaaguauuacggucuggacgug

SEQ ID NO: 29387 - RNA, 72 nt, Artificial Sequence
  derived and/or modified sequence opt3 from anti-HIV_CDR
gccgugaucaccgaccugcacacauucgcugauuacgagcucggcgaccccagcuauuuuuacauggauguc

SEQ ID NO: 29388 - RNA, 72 nt, Artificial Sequence
  derived and/or modified sequence opt3 from anti-HIV_CDR
agcgugaucaccgaccugcacacauucggcgauuacgaguccggggaccccucuuauuacuauauggauguc

SEQ ID NO: 29389 - RNA, 81 nt, Artificial Sequence
  derived and/or modified sequence opt3 from anti-HIV_CDR
gacuuccccagauuucacaggcuggugggcaacuacgauuucuggcgggggacccucgaccgcuuuagcuauauggaucuu

SEQ ID NO: 29390 - RNA, 105 nt, Artificial Sequence
  derived and/or modified sequence opt3 from anti-HIV_CDR
agaauccuggccguggagagguaccucaaggaccagcaacuucugggcauuugggggugcagcggaaaaauaaucugucccaccauggucccuuggaacuccucu

SEQ ID NO: 29391 - RNA, 105 nt, Artificial Sequence
  derived and/or modified sequence opt3 from anti-HIV_CDR
agagugcuggccgucgagagguaccuccaggaccaacggcuucugggcaugugggggugcagcggaaagcacaucuguaccacauucguucccuggaacuccucu

SEQ ID NO: 29392 - RNA, 105 nt, Artificial Sequence
  derived and/or modified sequence opt3 from anti-HIV_CDR
agagugcuggccgucgagagcuaccucaaggaccagcaacuucugggcaucugggggugcuccggaaaacacauuuguaccacaacuguucccuggaacucuuca

SEQ ID NO: 29393 - RNA, 105 nt, Artificial Sequence
  derived and/or modified sequence opt3 from anti-HIV_CDR
agagugcuggccgucgagagguaccuccgggaccagcaacuucugggcaucugggggugcagcggacgccacauuuguaccacaaauguucccuggaacuccucu

SEQ ID NO: 29394 - RNA, 105 nt, Artificial Sequence
  derived and/or modified sequence opt3 from anti-HIV_CDR
agaauccuggccguggagagguaccucaaggaccagcaacuucugggcauuugggggugcagcggaaaauugauauguaccacaacuguccccuggaacuccucu

SEQ ID NO: 29395 - RNA, 105 nt, Artificial Sequence
  derived and/or modified sequence opt3 from anti-HIV_CDR
agaauccuggccguggagagguaccucaaggaccagcaacuucugggcauuugggggugcagcggaaaacacauauguaccacaaauguccccuggaacuccucu

SEQ ID NO: 29396 - RNA, 105 nt, Artificial Sequence
  derived and/or modified sequence opt3 from anti-HIV_CDR
agagugcuggccgucgagagguaccuccgggaccagcaacuucugggcaucugggggugcagcggaaaguugauuuguaccacaacuguucccuggaacgcuucc

SEQ ID NO: 29397 - RNA, 105 nt, Artificial Sequence
  derived and/or modified sequence opt3 from anti-HIV_CDR
agagugcuggccgucgagagguaccuccgggaccagcaacuucugggcaucugggggugcagcggaaaguugauuuguaccacagcuguucccuggaacgcaucc

SEQ ID NO: 29398 - RNA, 105 nt, Artificial Sequence
  derived and/or modified sequence opt3 from anti-HIV_CDR
agagugcuggccgucgagagguaccucaaggaccagcaacuucugggcaucugggggugcagcggaaaauugauuuguaccacaacuguucccuggaacgcuucc

SEQ ID NO: 29399 - RNA, 105 nt, Artificial Sequence
  derived and/or modified sequence opt3 from anti-HIV_CDR
agaauccuggccguggagagguaccucaaggaccagcaacuucugggcuucugggggugcagcggaaaauugauuuguaccacagcuguccccuggaacgcaucc

SEQ ID NO: 29400 - RNA, 105 nt, Artificial Sequence
  derived and/or modified sequence opt3 from anti-HIV_CDR
agagugcuggccgucgagagguaccuccgggaccagcaacuucugggcaucugggggugcagcggaaaguugauuuguaccacaacuguucccuggaacacgucc

SEQ ID NO: 29401 - RNA, 105 nt, Artificial Sequence
  derived and/or modified sequence opt3 from anti-HIV_CDR
agagugcuggccgucgagagguaccucaaggaccagcaacuucugggcaucugggggugcagcggaaaauugauuuguaccacagcuguucccuggaacgcaucc

SEQ ID NO: 29402 - RNA, 105 nt, Artificial Sequence
  derived and/or modified sequence opt3 from anti-HIV_CDR
agagugcuggccgucgagagguaccucaaggaccagcaacuucugggcuucugggggugcagcggaaaauugaucuguaccacaacuguucccuggaacgcuucc

SEQ ID NO: 29403 - RNA, 105 nt, Artificial Sequence
  derived and/or modified sequence opt3 from anti-HIV_CDR
agaauccuggccguggagagguaccucaaggaccagcaacuucugggcauuugggggugcagcggaaaauugauauguaccacagcuguccccuggaacgcaucc

SEQ ID NO: 29404-29429 - skipped (26 entries)

SEQ ID NO: 29430 - RNA, 12 nt, Artificial Sequence
  derived and/or modified sequence opt3 from anti-influenza_CDR
gacgugcccgau

SEQ ID NO: 29431 - RNA, 12 nt, Artificial Sequence
  derived and/or modified sequence opt3 from anti-influenza_CDR
agacugagcggc

SEQ ID NO: 29432 - RNA, 12 nt, Artificial Sequence
  derived and/or modified sequence opt3 from anti-influenza_CDR
uucugggaccug

SEQ ID NO: 29433 - RNA, 15 nt, Artificial Sequence
  derived and/or modified sequence opt3 from anti-influenza_CDR
accggccugagaaac

SEQ ID NO: 29434 - RNA, 15 nt, Artificial Sequence
  derived and/or modified sequence opt3 from anti-influenza_CDR
cagcaaagcagaacc

SEQ ID NO: 29435 - RNA, 15 nt, Artificial Sequence
  derived and/or modified sequence opt3 from anti-influenza_CDR
cagcugagcagaacc

SEQ ID NO: 29436 - RNA, 15 nt, Artificial Sequence
  derived and/or modified sequence opt3 from anti-influenza_CDR
agcaacuacaucacc

SEQ ID NO: 29437 - RNA, 15 nt, Artificial Sequence
  derived and/or modified sequence opt3 from anti-influenza_CDR
gacuacagcuggaac

SEQ ID NO: 29438 - RNA, 15 nt, Artificial Sequence
  derived and/or modified sequence opt3 from anti-influenza_CDR
aacuacgccuucagc

SEQ ID NO: 29439 - RNA, 15 nt, Artificial Sequence
  derived and/or modified sequence opt3 from anti-influenza_CDR
aagaacgccaucagc

SEQ ID NO: 29440 - RNA, 15 nt, Artificial Sequence
  derived and/or modified sequence opt3 from anti-influenza_CDR
agccacuggaugacc

SEQ ID NO: 29441 - RNA, 15 nt, Artificial Sequence
  derived and/or modified sequence opt3 from anti-influenza_CDR
aacuacgacaucaau

SEQ ID NO: 29442 - RNA, 15 nt, Artificial Sequence
  derived and/or modified sequence opt3 from anti-influenza_CDR
gacuacggcgugacc

SEQ ID NO: 29443 - RNA, 15 nt, Artificial Sequence
  derived and/or modified sequence opt3 from anti-influenza_CDR
aacuacggcaucaau

SEQ ID NO: 29444 - RNA, 15 nt, Artificial Sequence
  derived and/or modified sequence opt3 from anti-influenza_CDR
ggcuacaccaucaca

SEQ ID NO: 29445 - RNA, 15 nt, Artificial Sequence
  derived and/or modified sequence opt3 from anti-influenza_CDR
aacuacggcaucagc

SEQ ID NO: 29446 - RNA, 15 nt, Artificial Sequence
  derived and/or modified sequence opt3 from anti-influenza_CDR
gacgauuacuggacc

SEQ ID NO: 29447 - RNA, 15 nt, Artificial Sequence
  derived and/or modified sequence opt3 from anti-influenza_CDR
accuacgccaugcac

SEQ ID NO: 29448 - RNA, 15 nt, Artificial Sequence
  derived and/or modified sequence opt3 from anti-influenza_CDR
agcuacgccaugcac

SEQ ID NO: 29449 - RNA, 15 nt, Artificial Sequence
  derived and/or modified sequence opt3 from anti-influenza_CDR
agcuacuauuggaac

SEQ ID NO: 29450 - RNA, 15 nt, Artificial Sequence
  derived and/or modified sequence opt3 from anti-influenza_CDR
accuaccccguggcc

SEQ ID NO: 29451 - RNA, 15 nt, Artificial Sequence
  derived and/or modified sequence opt3 from anti-influenza_CDR
cacuacuucuggagc

SEQ ID NO: 29452 - RNA, 15 nt, Artificial Sequence
  derived and/or modified sequence opt3 from anti-influenza_CDR
gacuacuauuggacc

SEQ ID NO: 29453 - RNA, 15 nt, Artificial Sequence
  derived and/or modified sequence opt3 from anti-influenza_CDR
gacuacuauuggagc

SEQ ID NO: 29454 - RNA, 15 nt, Artificial Sequence
  derived and/or modified sequence opt3 from anti-influenza_CDR
ggcuacuauaugcac

SEQ ID NO: 29455 - RNA, 15 nt, Artificial Sequence
  derived and/or modified sequence opt3 from anti-influenza_CDR
agccacuacuggucc

SEQ ID NO: 29456 - RNA, 15 nt, Artificial Sequence
  derived and/or modified sequence opt3 from anti-influenza_CDR
aacuacuggaucggc

SEQ ID NO: 29457 - RNA, 15 nt, Artificial Sequence
  derived and/or modified sequence opt3 from anti-influenza_CDR
aacuacgccaucauu

SEQ ID NO: 29458 - RNA, 15 nt, Artificial Sequence
  derived and/or modified sequence opt3 from anti-influenza_CDR
gacuacuauauccac

SEQ ID NO: 29459 - RNA, 15 nt, Artificial Sequence
  derived and/or modified sequence opt3 from anti-influenza_CDR
ggcuacgacaugcac

SEQ ID NO: 29460 - RNA, 15 nt, Artificial Sequence
  derived and/or modified sequence opt3 from anti-influenza_CDR
ggcuacuauauccac

SEQ ID NO: 29461 - RNA, 15 nt, Artificial Sequence
  derived and/or modified sequence opt3 from anti-influenza_CDR
ggcuacuaugugcac

SEQ ID NO: 29462 - RNA, 15 nt, Artificial Sequence
  derived and/or modified sequence opt3 from anti-influenza_CDR
aacuacuggaugagc

SEQ ID NO: 29463 - RNA, 15 nt, Artificial Sequence
  derived and/or modified sequence opt3 from anti-influenza_CDR
ggcgagagcacccug

SEQ ID NO: 29464 - RNA, 15 nt, Artificial Sequence
  derived and/or modified sequence opt3 from anti-influenza_CDR
aacuacuauuggagc

SEQ ID NO: 29465 - RNA, 15 nt, Artificial Sequence
  derived and/or modified sequence opt3 from anti-influenza_CDR
agcaacuacaugucc

SEQ ID NO: 29466 - RNA, 15 nt, Artificial Sequence
  derived and/or modified sequence opt3 from anti-influenza_CDR
agcgacuacuggucc

SEQ ID NO: 29467 - RNA, 15 nt, Artificial Sequence
  derived and/or modified sequence opt3 from anti-influenza_CDR
agcuacaacuggauc

SEQ ID NO: 29468 - RNA, 15 nt, Artificial Sequence
  derived and/or modified sequence opt3 from anti-influenza_CDR
agcaccuacaugaac

SEQ ID NO: 29469 - RNA, 15 nt, Artificial Sequence
  derived and/or modified sequence opt3 from anti-influenza_CDR
aacuacgccaugagc

SEQ ID NO: 29470 - RNA, 15 nt, Artificial Sequence
  derived and/or modified sequence opt3 from anti-influenza_CDR
agcgacuucuggucc

SEQ ID NO: 29471 - RNA, 15 nt, Artificial Sequence
  derived and/or modified sequence opt3 from anti-influenza_CDR
uacuaugccaugagc

SEQ ID NO: 29472 - RNA, 15 nt, Artificial Sequence
  derived and/or modified sequence opt3 from anti-influenza_CDR
ggcuacuauguguac

SEQ ID NO: 29473 - RNA, 15 nt, Artificial Sequence
  derived and/or modified sequence opt3 from anti-influenza_CDR
agcuacgccaucucc

SEQ ID NO: 29474 - RNA, 15 nt, Artificial Sequence
  derived and/or modified sequence opt3 from anti-influenza_CDR
agcuacuccuggucu

SEQ ID NO: 29475 - RNA, 15 nt, Artificial Sequence
  derived and/or modified sequence opt3 from anti-influenza_CDR
aacagcuucuggggc

SEQ ID NO: 29476 - RNA, 15 nt, Artificial Sequence
  derived and/or modified sequence opt3 from anti-influenza_CDR
gccuaccacuggagc

SEQ ID NO: 29477 - RNA, 15 nt, Artificial Sequence
  derived and/or modified sequence opt3 from anti-influenza_CDR
gacaacuacaucaau

SEQ ID NO: 29478 - RNA, 15 nt, Artificial Sequence
  derived and/or modified sequence opt3 from anti-influenza_CDR
agcggcuucuccgug

SEQ ID NO: 29479 - RNA, 15 nt, Artificial Sequence
  derived and/or modified sequence opt3 from anti-influenza_CDR
gccuacgcuuucacc

SEQ ID NO: 29480 - RNA, 15 nt, Artificial Sequence
  derived and/or modified sequence opt3 from anti-influenza_CDR
ggcagcgccaucucc

SEQ ID NO: 29481 - RNA, 15 nt, Artificial Sequence
  derived and/or modified sequence opt3 from anti-influenza_CDR
agcuacgccaucacc

SEQ ID NO: 29482 - RNA, 15 nt, Artificial Sequence
  derived and/or modified sequence opt3 from anti-influenza_CDR
agcuacuauaugcac

SEQ ID NO: 29483 - RNA, 15 nt, Artificial Sequence
  derived and/or modified sequence opt3 from anti-influenza_CDR
aucuacgccaugagc

SEQ ID NO: 29484 - RNA, 15 nt, Artificial Sequence
  derived and/or modified sequence opt3 from anti-influenza_CDR
agcuacuccaugaac

SEQ ID NO: 29485 - RNA, 15 nt, Artificial Sequence
  derived and/or modified sequence opt3 from anti-influenza_CDR
agcuacggcaucucc

SEQ ID NO: 29486 - RNA, 15 nt, Artificial Sequence
  derived and/or modified sequence opt3 from anti-influenza_CDR
uucuacagcaugucc

SEQ ID NO: 29487 - RNA, 15 nt, Artificial Sequence
  derived and/or modified sequence opt3 from anti-influenza_CDR
acccacgccaucagc

SEQ ID NO: 29488 - RNA, 15 nt, Artificial Sequence
  derived and/or modified sequence opt3 from anti-influenza_CDR
ggcuacgccaucagc

SEQ ID NO: 29489 - RNA, 15 nt, Artificial Sequence
  derived and/or modified sequence opt3 from anti-influenza_CDR
agcaacuccaucucu

SEQ ID NO: 29490 - RNA, 15 nt, Artificial Sequence
  derived and/or modified sequence opt3 from anti-influenza_CDR
aacuucgccaucaau

SEQ ID NO: 29491 - RNA, 15 nt, Artificial Sequence
  derived and/or modified sequence opt3 from anti-influenza_CDR
agcaacgccgugucc

SEQ ID NO: 29492 - RNA, 15 nt, Artificial Sequence
  derived and/or modified sequence opt3 from anti-influenza_CDR
gacaacgccaucagc

SEQ ID NO: 29493 - RNA, 15 nt, Artificial Sequence
  derived and/or modified sequence opt3 from anti-influenza_CDR
uucagcgagguggaa

SEQ ID NO: 29494 - RNA, 15 nt, Artificial Sequence
  derived and/or modified sequence opt3 from anti-influenza_CDR
gcccaccauaugcac

SEQ ID NO: 29495 - RNA, 15 nt, Artificial Sequence
  derived and/or modified sequence opt3 from anti-influenza_CDR
agccaguggaucggc

SEQ ID NO: 29496 - RNA, 15 nt, Artificial Sequence
  derived and/or modified sequence opt3 from anti-influenza_CDR
gacuacgccaugaac

SEQ ID NO: 29497 - RNA, 15 nt, Artificial Sequence
  derived and/or modified sequence opt3 from anti-influenza_CDR
aacgccuggaugagc

SEQ ID NO: 29498 - RNA, 15 nt, Artificial Sequence
  derived and/or modified sequence opt3 from anti-influenza_CDR
gacuacgccaucaac

SEQ ID NO: 29499 - RNA, 15 nt, Artificial Sequence
  derived and/or modified sequence opt3 from anti-influenza_CDR
agacacggcaucagc

SEQ ID NO: 29500 - RNA, 15 nt, Artificial Sequence
  derived and/or modified sequence opt3 from anti-influenza_CDR
gagcugagcauccac

SEQ ID NO: 29501 - RNA, 15 nt, Artificial Sequence
  derived and/or modified sequence opt3 from anti-influenza_CDR
agcuccaacuacuau

SEQ ID NO: 29502 - RNA, 15 nt, Artificial Sequence
  derived and/or modified sequence opt3 from anti-influenza_CDR
accuacgccaugagc

SEQ ID NO: 29503 - RNA, 15 nt, Artificial Sequence
  derived and/or modified sequence opt3 from anti-influenza_CDR
aacuacgccaucagc

SEQ ID NO: 29504 - RNA, 18 nt, Artificial Sequence
  derived and/or modified sequence opt3 from anti-influenza_CDR
uucggcgccaucgcuggg

SEQ ID NO: 29505 - RNA, 18 nt, Artificial Sequence
  derived and/or modified sequence opt3 from anti-influenza_CDR
caggacaucagcagauac

SEQ ID NO: 29506 - RNA, 18 nt, Artificial Sequence
  derived and/or modified sequence opt3 from anti-influenza_CDR
cagaacaucggccccugg

SEQ ID NO: 29507 - RNA, 18 nt, Artificial Sequence
  derived and/or modified sequence opt3 from anti-influenza_CDR
cagagcgugaacagaagg

SEQ ID NO: 29508 - RNA, 18 nt, Artificial Sequence
  derived and/or modified sequence opt3 from anti-influenza_CDR
cagagcaucuccaccuac

SEQ ID NO: 29509 - RNA, 18 nt, Artificial Sequence
  derived and/or modified sequence opt3 from anti-influenza_CDR
cagggcaucauuaccuac

SEQ ID NO: 29510 - RNA, 18 nt, Artificial Sequence
  derived and/or modified sequence opt3 from anti-influenza_CDR
cagggcaucagcuccuac

SEQ ID NO: 29511 - RNA, 18 nt, Artificial Sequence
  derived and/or modified sequence opt3 from anti-influenza_CDR
caggacgugagcaccugg

SEQ ID NO: 29512 - RNA, 18 nt, Artificial Sequence
  derived and/or modified sequence opt3 from anti-influenza_CDR
caggacaucuacauuuau

SEQ ID NO: 29513 - RNA, 18 nt, Artificial Sequence
  derived and/or modified sequence opt3 from anti-influenza_CDR
gagaacaucuggaauaac

SEQ ID NO: 29514 - RNA, 18 nt, Artificial Sequence
  derived and/or modified sequence opt3 from anti-influenza_CDR
ggcuucaccgugacaagc

SEQ ID NO: 29515 - RNA, 18 nt, Artificial Sequence
  derived and/or modified sequence opt3 from anti-influenza_CDR
caggacaucagcggccac

SEQ ID NO: 29516 - RNA, 18 nt, Artificial Sequence
  derived and/or modified sequence opt3 from anti-influenza_CDR
agccugcucaccgaggug

SEQ ID NO: 29517 - RNA, 18 nt, Artificial Sequence
  derived and/or modified sequence opt3 from anti-influenza_CDR
ggcagcuccaucucuaac

SEQ ID NO: 29518 - RNA, 18 nt, Artificial Sequence
  derived and/or modified sequence opt3 from anti-influenza_CDR
ggcgggagcaucaccucc

SEQ ID NO: 29519 - RNA, 18 nt, Artificial Sequence
  derived and/or modified sequence opt3 from anti-influenza_CDR
ggcgggagcaucuccucu

SEQ ID NO: 29520 - RNA, 18 nt, Artificial Sequence
  derived and/or modified sequence opt3 from anti-influenza_CDR
ggccugagcguguccucu

SEQ ID NO: 29521 - RNA, 18 nt, Artificial Sequence
  derived and/or modified sequence opt3 from anti-influenza_CDR
ggcgccagcaucuccucu

SEQ ID NO: 29522 - RNA, 18 nt, Artificial Sequence
  derived and/or modified sequence opt3 from anti-influenza_CDR
ggcgacagcaucuccucu

SEQ ID NO: 29523 - RNA, 18 nt, Artificial Sequence
  derived and/or modified sequence opt3 from anti-influenza_CDR
ggcgggagcaucuccaac

SEQ ID NO: 29524 - RNA, 18 nt, Artificial Sequence
  derived and/or modified sequence opt3 from anti-influenza_CDR
ggcgggagcaucuccgcc

SEQ ID NO: 29525 - RNA, 18 nt, Artificial Sequence
  derived and/or modified sequence opt3 from anti-influenza_CDR
ggcuucagcguguccgac

SEQ ID NO: 29526 - RNA, 18 nt, Artificial Sequence
  derived and/or modified sequence opt3 from anti-influenza_CDR
agcagaucccuggacgug

SEQ ID NO: 29527 - RNA, 18 nt, Artificial Sequence
  derived and/or modified sequence opt3 from anti-influenza_CDR
agaagccagcaaaccgug

SEQ ID NO: 29528 - RNA, 18 nt, Artificial Sequence
  derived and/or modified sequence opt3 from anti-influenza_CDR
cagaccaucaacaauuac

SEQ ID NO: 29529 - RNA, 18 nt, Artificial Sequence
  derived and/or modified sequence opt3 from anti-influenza_CDR
aacaugggccccaccagc

SEQ ID NO: 29530 - RNA, 18 nt, Artificial Sequence
  derived and/or modified sequence opt3 from anti-influenza_CDR
cagguggucggcaccaac

SEQ ID NO: 29531 - RNA, 18 nt, Artificial Sequence
  derived and/or modified sequence opt3 from anti-influenza_CDR
cagggcaucaacacccac

SEQ ID NO: 29532 - RNA, 18 nt, Artificial Sequence
  derived and/or modified sequence opt3 from anti-influenza_CDR
caggacaucagaaacagg

SEQ ID NO: 29533 - RNA, 18 nt, Artificial Sequence
  derived and/or modified sequence opt3 from anti-influenza_CDR
cagggcaucgggagcaac

SEQ ID NO: 29534 - RNA, 18 nt, Artificial Sequence
  derived and/or modified sequence opt3 from anti-influenza_CDR
cagaccaucuacagaugg

SEQ ID NO: 29535 - RNA, 18 nt, Artificial Sequence
  derived and/or modified sequence opt3 from anti-influenza_CDR
cagaccaucacaagauuc

SEQ ID NO: 29536 - RNA, 18 nt, Artificial Sequence
  derived and/or modified sequence opt3 from anti-influenza_CDR
agacugggcgagaaguuc

SEQ ID NO: 29537 - RNA, 18 nt, Artificial Sequence
  derived and/or modified sequence opt3 from anti-influenza_CDR
aagcugggcgacaaauuc

SEQ ID NO: 29538 - RNA, 18 nt, Artificial Sequence
  derived and/or modified sequence opt3 from anti-influenza_CDR
cagggccuggggagcaac

SEQ ID NO: 29539 - RNA, 18 nt, Artificial Sequence
  derived and/or modified sequence opt3 from anti-influenza_CDR
uacaucggcagcaagucc

SEQ ID NO: 29540 - RNA, 18 nt, Artificial Sequence
  derived and/or modified sequence opt3 from anti-influenza_CDR
cagcugaucagcuccuac

SEQ ID NO: 29541 - RNA, 18 nt, Artificial Sequence
  derived and/or modified sequence opt3 from anti-influenza_CDR
cagagcguguccucuaac

SEQ ID NO: 29542 - RNA, 18 nt, Artificial Sequence
  derived and/or modified sequence opt3 from anti-influenza_CDR
caggugaucagcuccuac

SEQ ID NO: 29543 - RNA, 18 nt, Artificial Sequence
  derived and/or modified sequence opt3 from anti-influenza_CDR
cagagcgugaacagaaau

SEQ ID NO: 29544 - RNA, 18 nt, Artificial Sequence
  derived and/or modified sequence opt3 from anti-influenza_CDR
gacaucggcagcaagucc

SEQ ID NO: 29545 - RNA, 18 nt, Artificial Sequence
  derived and/or modified sequence opt3 from anti-influenza_CDR
cagagcguguccaccaac

SEQ ID NO: 29546 - RNA, 18 nt, Artificial Sequence
  derived and/or modified sequence opt3 from anti-influenza_CDR
augaucgccggcuggcac

SEQ ID NO: 29547 - RNA, 18 nt, Artificial Sequence
  derived and/or modified sequence opt3 from anti-influenza_CDR
caggacaucagcaccugg

SEQ ID NO: 29548 - RNA, 18 nt, Artificial Sequence
  derived and/or modified sequence opt3 from anti-influenza_CDR
gagaagaucuacagcaac

SEQ ID NO: 29549 - RNA, 21 nt, Artificial Sequence
  derived and/or modified sequence opt3 from anti-influenza_CDR
aucuacuauaacuacaauauu

SEQ ID NO: 29550 - RNA, 21 nt, Artificial Sequence
  derived and/or modified sequence opt3 from anti-influenza_CDR
cagagcaucuccucuggcuac

SEQ ID NO: 29551 - RNA, 21 nt, Artificial Sequence
  derived and/or modified sequence opt3 from anti-influenza_CDR
cagagcguguccucuucauac

SEQ ID NO: 29552 - RNA, 21 nt, Artificial Sequence
  derived and/or modified sequence opt3 from anti-influenza_CDR
cagaccgugagcuccucuuac

SEQ ID NO: 29553 - RNA, 21 nt, Artificial Sequence
  derived and/or modified sequence opt3 from anti-influenza_CDR
agcaacaaugccguguggaac

SEQ ID NO: 29554 - RNA, 21 nt, Artificial Sequence
  derived and/or modified sequence opt3 from anti-influenza_CDR
agcaacuccgccguguggaau

SEQ ID NO: 29555 - RNA, 21 nt, Artificial Sequence
  derived and/or modified sequence opt3 from anti-influenza_CDR
gccgcuaccacacugcagagc

SEQ ID NO: 29556 - RNA, 21 nt, Artificial Sequence
  derived and/or modified sequence opt3 from anti-influenza_CDR
agcaacagagccaccuggaau

SEQ ID NO: 29557 - RNA, 21 nt, Artificial Sequence
  derived and/or modified sequence opt3 from anti-influenza_CDR
gccaccagcacacugcagucc

SEQ ID NO: 29558 - RNA, 21 nt, Artificial Sequence
  derived and/or modified sequence opt3 from anti-influenza_CDR
agcaacuccgccaccuggaau

SEQ ID NO: 29559 - RNA, 21 nt, Artificial Sequence
  derived and/or modified sequence opt3 from anti-influenza_CDR
gccagcuccacccugcagucu

SEQ ID NO: 29560 - RNA, 21 nt, Artificial Sequence
  derived and/or modified sequence opt3 from anti-influenza_CDR
agcuacaacgccguguggaau

SEQ ID NO: 29561 - RNA, 21 nt, Artificial Sequence
  derived and/or modified sequence opt3 from anti-influenza_CDR
gccgcuagcuccagacugucu

SEQ ID NO: 29562 - RNA, 21 nt, Artificial Sequence
  derived and/or modified sequence opt3 from anti-influenza_CDR
gccgcuagcuccagaggcucu

SEQ ID NO: 29563 - RNA, 21 nt, Artificial Sequence
  derived and/or modified sequence opt3 from anti-influenza_CDR
aucuaccacagcggcuccgcc

SEQ ID NO: 29564 - RNA, 21 nt, Artificial Sequence
  derived and/or modified sequence opt3 from anti-influenza_CDR
aucuacuauagcggcgugacc

SEQ ID NO: 29565 - RNA, 21 nt, Artificial Sequence
  derived and/or modified sequence opt3 from anti-influenza_CDR
agcuccuaccuggccugguau

SEQ ID NO: 29566 - RNA, 21 nt, Artificial Sequence
  derived and/or modified sequence opt3 from anti-influenza_CDR
cagagccuguccucuucaagu

SEQ ID NO: 29567 - RNA, 21 nt, Artificial Sequence
  derived and/or modified sequence opt3 from anti-influenza_CDR
cagagcguguccaucucuuac

SEQ ID NO: 29568 - RNA, 21 nt, Artificial Sequence
  derived and/or modified sequence opt3 from anti-influenza_CDR
gacgugaccgagagacccagc

SEQ ID NO: 29569 - RNA, 21 nt, Artificial Sequence
  derived and/or modified sequence opt3 from anti-influenza_CDR
gccgcuagcacccugcucgac

SEQ ID NO: 29570 - RNA, 21 nt, Artificial Sequence
  derived and/or modified sequence opt3 from anti-influenza_CDR
gccgcuagcacccugcacucc

SEQ ID NO: 29571 - RNA, 21 nt, Artificial Sequence
  derived and/or modified sequence opt3 from anti-influenza_CDR
ggcgccagcucccugcagggg

SEQ ID NO: 29572 - RNA, 21 nt, Artificial Sequence
  derived and/or modified sequence opt3 from anti-influenza_CDR
accaacggcgugaaugucggg

SEQ ID NO: 29573 - RNA, 21 nt, Artificial Sequence
  derived and/or modified sequence opt3 from anti-influenza_CDR
gacgccagcaccagagcuaca

SEQ ID NO: 29574 - RNA, 21 nt, Artificial Sequence
  derived and/or modified sequence opt3 from anti-influenza_CDR
agcgagaccuacuauuggucc

SEQ ID NO: 29575 - RNA, 21 nt, Artificial Sequence
  derived and/or modified sequence opt3 from anti-influenza_CDR
gaggccgugaaccuggaaagc

SEQ ID NO: 29576 - RNA, 21 nt, Artificial Sequence
  derived and/or modified sequence opt3 from anti-influenza_CDR
ggcgccagcaccagagcuaca

SEQ ID NO: 29577 - RNA, 21 nt, Artificial Sequence
  derived and/or modified sequence opt3 from anti-influenza_CDR
gugagcggcuacuauuggucc

SEQ ID NO: 29578 - RNA, 21 nt, Artificial Sequence
  derived and/or modified sequence opt3 from anti-influenza_CDR
aucaccggcgugagagucggg

SEQ ID NO: 29579 - RNA, 21 nt, Artificial Sequence
  derived and/or modified sequence opt3 from anti-influenza_CDR
gacgccagcaacagagcuacc

SEQ ID NO: 29580 - RNA, 21 nt, Artificial Sequence
  derived and/or modified sequence opt3 from anti-influenza_CDR
gaggugaccaacuggcccagc

SEQ ID NO: 29581 - RNA, 21 nt, Artificial Sequence
  derived and/or modified sequence opt3 from anti-influenza_CDR
aaggacagcgagagacccucc

SEQ ID NO: 29582 - RNA, 21 nt, Artificial Sequence
  derived and/or modified sequence opt3 from anti-influenza_CDR
agcggcaacuacuauuggaau

SEQ ID NO: 29583 - RNA, 21 nt, Artificial Sequence
  derived and/or modified sequence opt3 from anti-influenza_CDR
agcaccacaaucagacacucc

SEQ ID NO: 29584 - RNA, 21 nt, Artificial Sequence
  derived and/or modified sequence opt3 from anti-influenza_CDR
gacgauagcggcagacccucc

SEQ ID NO: 29585 - RNA, 21 nt, Artificial Sequence
  derived and/or modified sequence opt3 from anti-influenza_CDR
agaaacgaccugaggcccagc

SEQ ID NO: 29586 - RNA, 21 nt, Artificial Sequence
  derived and/or modified sequence opt3 from anti-influenza_CDR
agcguggaccacuacuggucc

SEQ ID NO: 29587 - RNA, 21 nt, Artificial Sequence
  derived and/or modified sequence opt3 from anti-influenza_CDR
gccgugagcauccugcagucc

SEQ ID NO: 29588 - RNA, 21 nt, Artificial Sequence
  derived and/or modified sequence opt3 from anti-influenza_CDR
gacgauaccgacagacccagc

SEQ ID NO: 29589 - RNA, 21 nt, Artificial Sequence
  derived and/or modified sequence opt3 from anti-influenza_CDR
gagaacaauaagagacccagc

SEQ ID NO: 29590 - RNA, 21 nt, Artificial Sequence
  derived and/or modified sequence opt3 from anti-influenza_CDR
gacagcuccaacagagccccc

SEQ ID NO: 29591 - RNA, 21 nt, Artificial Sequence
  derived and/or modified sequence opt3 from anti-influenza_CDR
gaggugaccaagagacccagc

SEQ ID NO: 29592 - RNA, 21 nt, Artificial Sequence
  derived and/or modified sequence opt3 from anti-influenza_CDR
gccaccagcaacacacacucc

SEQ ID NO: 29593 - RNA, 21 nt, Artificial Sequence
  derived and/or modified sequence opt3 from anti-influenza_CDR
gccgcuagcaaccuggagaau

SEQ ID NO: 29594 - RNA, 21 nt, Artificial Sequence
  derived and/or modified sequence opt3 from anti-influenza_CDR
gccgcuagcggccugcagucc

SEQ ID NO: 29595 - RNA, 21 nt, Artificial Sequence
  derived and/or modified sequence opt3 from anti-influenza_CDR
ggcuucaccgugagcuccaac

SEQ ID NO: 29596 - RNA, 21 nt, Artificial Sequence
  derived and/or modified sequence opt3 from anti-influenza_CDR
ggcgggggauacagcuggaac

SEQ ID NO: 29597 - RNA, 21 nt, Artificial Sequence
  derived and/or modified sequence opt3 from anti-influenza_CDR
ggcgccagcaaccugcagucc

SEQ ID NO: 29598 - RNA, 21 nt, Artificial Sequence
  derived and/or modified sequence opt3 from anti-influenza_CDR
ggcgccaccaaccugcagagc

SEQ ID NO: 29599 - RNA, 21 nt, Artificial Sequence
  derived and/or modified sequence opt3 from anti-influenza_CDR
ggcgccagcaaccugcacucc

SEQ ID NO: 29600 - RNA, 21 nt, Artificial Sequence
  derived and/or modified sequence opt3 from anti-influenza_CDR
ggcgccagcacccugcagucc

SEQ ID NO: 29601 - RNA, 21 nt, Artificial Sequence
  derived and/or modified sequence opt3 from anti-influenza_CDR
gacaacagcgauagacccucc

SEQ ID NO: 29602 - RNA, 21 nt, Artificial Sequence
  derived and/or modified sequence opt3 from anti-influenza_CDR
ggcgccagcucccugcagucu

SEQ ID NO: 29603 - RNA, 21 nt, Artificial Sequence
  derived and/or modified sequence opt3 from anti-influenza_CDR
ggcaacagcaauagacccucc

SEQ ID NO: 29604 - RNA, 21 nt, Artificial Sequence
  derived and/or modified sequence opt3 from anti-influenza_CDR
gccgcuagcucccugcagucu

SEQ ID NO: 29605 - RNA, 21 nt, Artificial Sequence
  derived and/or modified sequence opt3 from anti-influenza_CDR
gccgcuagcucccugcacucu

SEQ ID NO: 29606 - RNA, 21 nt, Artificial Sequence
  derived and/or modified sequence opt3 from anti-influenza_CDR
ggcgccagcacccugcagaac

SEQ ID NO: 29607 - RNA, 21 nt, Artificial Sequence
  derived and/or modified sequence opt3 from anti-influenza_CDR
ggcgccaccgaccugcagagc

SEQ ID NO: 29608 - RNA, 21 nt, Artificial Sequence
  derived and/or modified sequence opt3 from anti-influenza_CDR
agcggcgccuacuauuggacc

SEQ ID NO: 29609 - RNA, 21 nt, Artificial Sequence
  derived and/or modified sequence opt3 from anti-influenza_CDR
gugagcgacaacuacaucaau

SEQ ID NO: 29610 - RNA, 21 nt, Artificial Sequence
  derived and/or modified sequence opt3 from anti-influenza_CDR
ugggccagcaccagagagucc

SEQ ID NO: 29611 - RNA, 21 nt, Artificial Sequence
  derived and/or modified sequence opt3 from anti-influenza_CDR
agcaacaaucagagacccucc

SEQ ID NO: 29612 - RNA, 21 nt, Artificial Sequence
  derived and/or modified sequence opt3 from anti-influenza_CDR
gaggugagcaacagacccucc

SEQ ID NO: 29613 - RNA, 21 nt, Artificial Sequence
  derived and/or modified sequence opt3 from anti-influenza_CDR
aagaacacccagagacccagc

SEQ ID NO: 29614 - RNA, 21 nt, Artificial Sequence
  derived and/or modified sequence opt3 from anti-influenza_CDR
gacaacaauaagagacccagc

SEQ ID NO: 29615 - RNA, 21 nt, Artificial Sequence
  derived and/or modified sequence opt3 from anti-influenza_CDR
gacgccagcacccugagaucc

SEQ ID NO: 29616 - RNA, 21 nt, Artificial Sequence
  derived and/or modified sequence opt3 from anti-influenza_CDR
caggacaacagaaggcccagc

SEQ ID NO: 29617 - RNA, 21 nt, Artificial Sequence
  derived and/or modified sequence opt3 from anti-influenza_CDR
gacgugagcaagagacccucc

SEQ ID NO: 29618 - RNA, 21 nt, Artificial Sequence
  derived and/or modified sequence opt3 from anti-influenza_CDR
gacgccagcuccagagcuacc

SEQ ID NO: 29619 - RNA, 21 nt, Artificial Sequence
  derived and/or modified sequence opt3 from anti-influenza_CDR
cugggcagcaacagagccucc

SEQ ID NO: 29620 - RNA, 21 nt, Artificial Sequence
  derived and/or modified sequence opt3 from anti-influenza_CDR
ggcgccagcaccagagcugca

SEQ ID NO: 29621 - RNA, 21 nt, Artificial Sequence
  derived and/or modified sequence opt3 from anti-influenza_CDR
gacgauagcgacagacccucc

SEQ ID NO: 29622 - RNA, 21 nt, Artificial Sequence
  derived and/or modified sequence opt3 from anti-influenza_CDR
agagacggccagaggcccagc

SEQ ID NO: 29623 - RNA, 21 nt, Artificial Sequence
  derived and/or modified sequence opt3 from anti-influenza_CDR
ggcgccagcuccagagcuacc

SEQ ID NO: 29624 - RNA, 21 nt, Artificial Sequence
  derived and/or modified sequence opt3 from anti-influenza_CDR
ggcgccagcuccagagcuucu

SEQ ID NO: 29625 - RNA, 21 nt, Artificial Sequence
  derived and/or modified sequence opt3 from anti-influenza_CDR
gccgcuagcacccugcagucc

SEQ ID NO: 29626 - RNA, 21 nt, Artificial Sequence
  derived and/or modified sequence opt3 from anti-influenza_CDR
cuggugagcaagagagccucc

SEQ ID NO: 29627 - RNA, 21 nt, Artificial Sequence
  derived and/or modified sequence opt3 from anti-influenza_CDR
gacgugaccuacagacccagc

SEQ ID NO: 29628 - RNA, 21 nt, Artificial Sequence
  derived and/or modified sequence opt3 from anti-influenza_CDR
augcaggcccuggagaccccc

SEQ ID NO: 29629 - RNA, 21 nt, Artificial Sequence
  derived and/or modified sequence opt3 from anti-influenza_CDR
cagaacuacggcagccccuuc

SEQ ID NO: 29630 - RNA, 21 nt, Artificial Sequence
  derived and/or modified sequence opt3 from anti-influenza_CDR
cagcaauacggcagccugccc

SEQ ID NO: 29631 - RNA, 21 nt, Artificial Sequence
  derived and/or modified sequence opt3 from anti-influenza_CDR
uggggcagcuaccuggagucc

SEQ ID NO: 29632 - RNA, 21 nt, Artificial Sequence
  derived and/or modified sequence opt3 from anti-influenza_CDR
agcgccuccaccagagcuaca

SEQ ID NO: 29633 - RNA, 21 nt, Artificial Sequence
  derived and/or modified sequence opt3 from anti-influenza_CDR
ggcgccagcaccagagcuucc

SEQ ID NO: 29634 - RNA, 21 nt, Artificial Sequence
  derived and/or modified sequence opt3 from anti-influenza_CDR
ggcgccagcaccagagacaca

SEQ ID NO: 29635 - RNA, 21 nt, Artificial Sequence
  derived and/or modified sequence opt3 from anti-influenza_CDR
aaggugagcacccuggagucc

SEQ ID NO: 29636 - RNA, 21 nt, Artificial Sequence
  derived and/or modified sequence opt3 from anti-influenza_CDR
agcaacaccgagagacccucc

SEQ ID NO: 29637 - RNA, 21 nt, Artificial Sequence
  derived and/or modified sequence opt3 from anti-influenza_CDR
aagaucagcaacagagacucc

SEQ ID NO: 29638 - RNA, 21 nt, Artificial Sequence
  derived and/or modified sequence opt3 from anti-influenza_CDR
agcgccucccacagauacucu

SEQ ID NO: 29639 - RNA, 21 nt, Artificial Sequence
  derived and/or modified sequence opt3 from anti-influenza_CDR
cagagcgugagauccaacaau

SEQ ID NO: 29640 - RNA, 21 nt, Artificial Sequence
  derived and/or modified sequence opt3 from anti-influenza_CDR
cagagcgugagauccggcuac

SEQ ID NO: 29641 - RNA, 21 nt, Artificial Sequence
  derived and/or modified sequence opt3 from anti-influenza_CDR
aucuacuauagaggcagcacc

SEQ ID NO: 29642 - RNA, 21 nt, Artificial Sequence
  derived and/or modified sequence opt3 from anti-influenza_CDR
guguacuauagcggcaucacc

SEQ ID NO: 29643 - RNA, 21 nt, Artificial Sequence
  derived and/or modified sequence opt3 from anti-influenza_CDR
agccacuucgccaaccugaag

SEQ ID NO: 29644 - RNA, 21 nt, Artificial Sequence
  derived and/or modified sequence opt3 from anti-influenza_CDR
cugaacaagagcaaacccuac

SEQ ID NO: 29645 - RNA, 21 nt, Artificial Sequence
  derived and/or modified sequence opt3 from anti-influenza_CDR
aagcuggccaacaccggcaca

SEQ ID NO: 29646 - RNA, 21 nt, Artificial Sequence
  derived and/or modified sequence opt3 from anti-influenza_CDR
gccgcuagcacccugacaucc

SEQ ID NO: 29647 - RNA, 21 nt, Artificial Sequence
  derived and/or modified sequence opt3 from anti-influenza_CDR
gacgccagcaagcuggcuucc

SEQ ID NO: 29648 - RNA, 21 nt, Artificial Sequence
  derived and/or modified sequence opt3 from anti-influenza_CDR
uucgccagcagacuggcuucc

SEQ ID NO: 29649 - RNA, 21 nt, Artificial Sequence
  derived and/or modified sequence opt3 from anti-influenza_CDR
agcgccuccacccuggcuucu

SEQ ID NO: 29650 - RNA, 21 nt, Artificial Sequence
  derived and/or modified sequence opt3 from anti-influenza_CDR
gaggugagccagagacccucc

SEQ ID NO: 29651 - RNA, 21 nt, Artificial Sequence
  derived and/or modified sequence opt3 from anti-influenza_CDR
ggcgggacccugaacaauuac

SEQ ID NO: 29652 - RNA, 21 nt, Artificial Sequence
  derived and/or modified sequence opt3 from anti-influenza_CDR
gacaucgugaugacccagagc

SEQ ID NO: 29653 - RNA, 24 nt, Artificial Sequence
  derived and/or modified sequence opt3 from anti-influenza_CDR
ggcuucaccuuuagcaacuacgcc

SEQ ID NO: 29654 - RNA, 24 nt, Artificial Sequence
  derived and/or modified sequence opt3 from anti-influenza_CDR
ggcuucaccuuuagcaacuacggg

SEQ ID NO: 29655 - RNA, 24 nt, Artificial Sequence
  derived and/or modified sequence opt3 from anti-influenza_CDR
ggcuucaccuuuagcuccuacgcc

SEQ ID NO: 29656 - RNA, 24 nt, Artificial Sequence
  derived and/or modified sequence opt3 from anti-influenza_CDR
ggcuucaccuuuagcacauacgcc

SEQ ID NO: 29657 - RNA, 24 nt, Artificial Sequence
  derived and/or modified sequence opt3 from anti-influenza_CDR
ggcgggaucuucauuagccaggcc

SEQ ID NO: 29658 - RNA, 24 nt, Artificial Sequence
  derived and/or modified sequence opt3 from anti-influenza_CDR
ggcgggaucuucagccccuacgcc

SEQ ID NO: 29659 - RNA, 24 nt, Artificial Sequence
  derived and/or modified sequence opt3 from anti-influenza_CDR
ggcgggcccuucagcggauuugcc

SEQ ID NO: 29660 - RNA, 24 nt, Artificial Sequence
  derived and/or modified sequence opt3 from anti-influenza_CDR
ggcgggaccuucaacagccacgcc

SEQ ID NO: 29661 - RNA, 24 nt, Artificial Sequence
  derived and/or modified sequence opt3 from anti-influenza_CDR
ggcagcaacaucggguccaauacc

SEQ ID NO: 29662 - RNA, 24 nt, Artificial Sequence
  derived and/or modified sequence opt3 from anti-influenza_CDR
ggcgugaccuucagcauguacgcc

SEQ ID NO: 29663 - RNA, 24 nt, Artificial Sequence
  derived and/or modified sequence opt3 from anti-influenza_CDR
ggcgugaccuucagcauguacaca

SEQ ID NO: 29664 - RNA, 24 nt, Artificial Sequence
  derived and/or modified sequence opt3 from anti-influenza_CDR
ggcgugaccagcuccaacuacccc

SEQ ID NO: 29665 - RNA, 24 nt, Artificial Sequence
  derived and/or modified sequence opt3 from anti-influenza_CDR
aucauugccauauucggcaccaca

SEQ ID NO: 29666 - RNA, 24 nt, Artificial Sequence
  derived and/or modified sequence opt3 from anti-influenza_CDR
aucauuccccuguucggcaccgcc

SEQ ID NO: 29667 - RNA, 24 nt, Artificial Sequence
  derived and/or modified sequence opt3 from anti-influenza_CDR
aucauuccccuguucggcaccaca

SEQ ID NO: 29668 - RNA, 24 nt, Artificial Sequence
  derived and/or modified sequence opt3 from anti-influenza_CDR
aucauucccauguucggcgccacc

SEQ ID NO: 29669 - RNA, 24 nt, Artificial Sequence
  derived and/or modified sequence opt3 from anti-influenza_CDR
aucauucccauguucggcaccaca

SEQ ID NO: 29670 - RNA, 24 nt, Artificial Sequence
  derived and/or modified sequence opt3 from anti-influenza_CDR
aucaacagcggcgggggagccacc

SEQ ID NO: 29671 - RNA, 24 nt, Artificial Sequence
  derived and/or modified sequence opt3 from anti-influenza_CDR
aucagcgccguguucggcaccgcu

SEQ ID NO: 29672 - RNA, 24 nt, Artificial Sequence
  derived and/or modified sequence opt3 from anti-influenza_CDR
aucagcuacgacgccaacuauaag

SEQ ID NO: 29673 - RNA, 24 nt, Artificial Sequence
  derived and/or modified sequence opt3 from anti-influenza_CDR
aucagcuacgacggcaacuauaag

SEQ ID NO: 29674 - RNA, 24 nt, Artificial Sequence
  derived and/or modified sequence opt3 from anti-influenza_CDR
aucagcuacgacggcuccaacaag

SEQ ID NO: 29675 - RNA, 24 nt, Artificial Sequence
  derived and/or modified sequence opt3 from anti-influenza_CDR
aucagcuacgacggcuccaaccag

SEQ ID NO: 29676 - RNA, 24 nt, Artificial Sequence
  derived and/or modified sequence opt3 from anti-influenza_CDR
cagcaauacuauagaagccccucc

SEQ ID NO: 29677 - RNA, 24 nt, Artificial Sequence
  derived and/or modified sequence opt3 from anti-influenza_CDR
gugcugccccucuucggcgucacc

SEQ ID NO: 29678 - RNA, 24 nt, Artificial Sequence
  derived and/or modified sequence opt3 from anti-influenza_CDR
ggcgggaccuucagcuccgacgcc

SEQ ID NO: 29679 - RNA, 24 nt, Artificial Sequence
  derived and/or modified sequence opt3 from anti-influenza_CDR
aucauucccguguuccagaccgcc

SEQ ID NO: 29680 - RNA, 24 nt, Artificial Sequence
  derived and/or modified sequence opt3 from anti-influenza_CDR
accagcaacaucggcuccaaugcc

SEQ ID NO: 29681 - RNA, 24 nt, Artificial Sequence
  derived and/or modified sequence opt3 from anti-influenza_CDR
ggcuacagcuucaccuccagaugg

SEQ ID NO: 29682 - RNA, 24 nt, Artificial Sequence
  derived and/or modified sequence opt3 from anti-influenza_CDR
aucuaccccagcgacuccgaugug

SEQ ID NO: 29683 - RNA, 24 nt, Artificial Sequence
  derived and/or modified sequence opt3 from anti-influenza_CDR
cagcaauacgacaacuggcugagc

SEQ ID NO: 29684 - RNA, 24 nt, Artificial Sequence
  derived and/or modified sequence opt3 from anti-influenza_CDR
ggcgggaccuucagcaacuacgga

SEQ ID NO: 29685 - RNA, 24 nt, Artificial Sequence
  derived and/or modified sequence opt3 from anti-influenza_CDR
ggcgccagcaucuccucuucauac

SEQ ID NO: 29686 - RNA, 24 nt, Artificial Sequence
  derived and/or modified sequence opt3 from anti-influenza_CDR
ggcgggaccuucagcuccuacgac

SEQ ID NO: 29687 - RNA, 24 nt, Artificial Sequence
  derived and/or modified sequence opt3 from anti-influenza_CDR
aucauucccauauacggcaccgcc

SEQ ID NO: 29688 - RNA, 24 nt, Artificial Sequence
  derived and/or modified sequence opt3 from anti-influenza_CDR
ggcuacaccagcacaacuuauggg

SEQ ID NO: 29689 - RNA, 24 nt, Artificial Sequence
  derived and/or modified sequence opt3 from anti-influenza_CDR
aucaaccccuacaauggcaacccu

SEQ ID NO: 29690 - RNA, 24 nt, Artificial Sequence
  derived and/or modified sequence opt3 from anti-influenza_CDR
aucugguacgacggcgauaacaag

SEQ ID NO: 29691 - RNA, 24 nt, Artificial Sequence
  derived and/or modified sequence opt3 from anti-influenza_CDR
ggcuucaccuuuagcgacuucugg

SEQ ID NO: 29692 - RNA, 24 nt, Artificial Sequence
  derived and/or modified sequence opt3 from anti-influenza_CDR
aucgaccaggauggcaacgagaga

SEQ ID NO: 29693 - RNA, 24 nt, Artificial Sequence
  derived and/or modified sequence opt3 from anti-influenza_CDR
agcuccaacaucggcaagaauuac

SEQ ID NO: 29694 - RNA, 24 nt, Artificial Sequence
  derived and/or modified sequence opt3 from anti-influenza_CDR
ggcuacaccuucacaaacuauugg

SEQ ID NO: 29695 - RNA, 24 nt, Artificial Sequence
  derived and/or modified sequence opt3 from anti-influenza_CDR
aucuucccucccgacagccagacc

SEQ ID NO: 29696 - RNA, 24 nt, Artificial Sequence
  derived and/or modified sequence opt3 from anti-influenza_CDR
ggcuacagcuucuccgacuauugg

SEQ ID NO: 29697 - RNA, 24 nt, Artificial Sequence
  derived and/or modified sequence opt3 from anti-influenza_CDR
aucuaccccgccagcuccgagauu

SEQ ID NO: 29698 - RNA, 24 nt, Artificial Sequence
  derived and/or modified sequence opt3 from anti-influenza_CDR
agcggcgacuccgggaccuggaac

SEQ ID NO: 29699 - RNA, 24 nt, Artificial Sequence
  derived and/or modified sequence opt3 from anti-influenza_CDR
ggcgggacccugaacaauuacgcc

SEQ ID NO: 29700 - RNA, 24 nt, Artificial Sequence
  derived and/or modified sequence opt3 from anti-influenza_CDR
aucagccccauuuucggcacccug

SEQ ID NO: 29701 - RNA, 24 nt, Artificial Sequence
  derived and/or modified sequence opt3 from anti-influenza_CDR
ggcguguucuuuagcucccacgcc

SEQ ID NO: 29702 - RNA, 24 nt, Artificial Sequence
  derived and/or modified sequence opt3 from anti-influenza_CDR
aucagccccauguucggcaccaca

SEQ ID NO: 29703 - RNA, 24 nt, Artificial Sequence
  derived and/or modified sequence opt3 from anti-influenza_CDR
ggcuucaccuuuagcagauucggg

SEQ ID NO: 29704 - RNA, 24 nt, Artificial Sequence
  derived and/or modified sequence opt3 from anti-influenza_CDR
aucugguacgacggcagcaacaag

SEQ ID NO: 29705 - RNA, 24 nt, Artificial Sequence
  derived and/or modified sequence opt3 from anti-influenza_CDR
cagaccuacggcggggugagcaca

SEQ ID NO: 29706 - RNA, 24 nt, Artificial Sequence
  derived and/or modified sequence opt3 from anti-influenza_CDR
gacagcgccggcaacagacacucc

SEQ ID NO: 29707 - RNA, 24 nt, Artificial Sequence
  derived and/or modified sequence opt3 from anti-influenza_CDR
uucagaggcgggaacagccugucc

SEQ ID NO: 29708 - RNA, 24 nt, Artificial Sequence
  derived and/or modified sequence opt3 from anti-influenza_CDR
ggcuacaccuucacaacuuauugg

SEQ ID NO: 29709 - RNA, 24 nt, Artificial Sequence
  derived and/or modified sequence opt3 from anti-influenza_CDR
aucgaccccuacgauagcgagacc

SEQ ID NO: 29710 - RNA, 24 nt, Artificial Sequence
  derived and/or modified sequence opt3 from anti-influenza_CDR
aucagaaaguuccugaacugguac

SEQ ID NO: 29711 - RNA, 24 nt, Artificial Sequence
  derived and/or modified sequence opt3 from anti-influenza_CDR
cagcaauacgacggccugcccuuc

SEQ ID NO: 29712 - RNA, 24 nt, Artificial Sequence
  derived and/or modified sequence opt3 from anti-influenza_CDR
aucagaaacagccugaauugguac

SEQ ID NO: 29713 - RNA, 24 nt, Artificial Sequence
  derived and/or modified sequence opt3 from anti-influenza_CDR
cagcaagccaacagcuucccccug

SEQ ID NO: 29714 - RNA, 24 nt, Artificial Sequence
  derived and/or modified sequence opt3 from anti-influenza_CDR
agccugcucaccgagguggaaaca

SEQ ID NO: 29715 - RNA, 24 nt, Artificial Sequence
  derived and/or modified sequence opt3 from anti-influenza_CDR
cagcaaagcuacuccaugcccgcc

SEQ ID NO: 29716 - RNA, 24 nt, Artificial Sequence
  derived and/or modified sequence opt3 from anti-influenza_CDR
ggcgggcccgugagcggagguggc

SEQ ID NO: 29717 - RNA, 24 nt, Artificial Sequence
  derived and/or modified sequence opt3 from anti-influenza_CDR
caacagagcuucuccgugcccgcc

SEQ ID NO: 29718 - RNA, 24 nt, Artificial Sequence
  derived and/or modified sequence opt3 from anti-influenza_CDR
cagcaaaccuacagcaucccccug

SEQ ID NO: 29719 - RNA, 24 nt, Artificial Sequence
  derived and/or modified sequence opt3 from anti-influenza_CDR
cagcaaagcuacuccgugcccgcc

SEQ ID NO: 29720 - RNA, 24 nt, Artificial Sequence
  derived and/or modified sequence opt3 from anti-influenza_CDR
cagcaaaccuucagcaucccccug

SEQ ID NO: 29721 - RNA, 24 nt, Artificial Sequence
  derived and/or modified sequence opt3 from anti-influenza_CDR
ggcgacagcaucaccuccggggcc

SEQ ID NO: 29722 - RNA, 24 nt, Artificial Sequence
  derived and/or modified sequence opt3 from anti-influenza_CDR
caggccugggacagcuccaccgcu

SEQ ID NO: 29723 - RNA, 24 nt, Artificial Sequence
  derived and/or modified sequence opt3 from anti-influenza_CDR
cagcaauacggcagcucccugugg

SEQ ID NO: 29724 - RNA, 24 nt, Artificial Sequence
  derived and/or modified sequence opt3 from anti-influenza_CDR
gccuacggcuauaccuucgacccc

SEQ ID NO: 29725 - RNA, 24 nt, Artificial Sequence
  derived and/or modified sequence opt3 from anti-influenza_CDR
augcaggcccugcaaaccccccuc

SEQ ID NO: 29726 - RNA, 24 nt, Artificial Sequence
  derived and/or modified sequence opt3 from anti-influenza_CDR
cagcaauacggcagcucccugacc

SEQ ID NO: 29727 - RNA, 24 nt, Artificial Sequence
  derived and/or modified sequence opt3 from anti-influenza_CDR
cagaaguacaacagcgcccccucc

SEQ ID NO: 29728 - RNA, 24 nt, Artificial Sequence
  derived and/or modified sequence opt3 from anti-influenza_CDR
cagcaaagaagcaacuggcugaag

SEQ ID NO: 29729 - RNA, 24 nt, Artificial Sequence
  derived and/or modified sequence opt3 from anti-influenza_CDR
agcucccagucuagaucaaguacc

SEQ ID NO: 29730 - RNA, 24 nt, Artificial Sequence
  derived and/or modified sequence opt3 from anti-influenza_CDR
cccuacgacgugccugauuaugag

SEQ ID NO: 29731 - RNA, 24 nt, Artificial Sequence
  derived and/or modified sequence opt3 from anti-influenza_CDR
cccuacgacgugccugauuaugcc

SEQ ID NO: 29732 - RNA, 24 nt, Artificial Sequence
  derived and/or modified sequence opt3 from anti-influenza_CDR
cccggcgacuucaacgauuacgag

SEQ ID NO: 29733 - RNA, 24 nt, Artificial Sequence
  derived and/or modified sequence opt3 from anti-influenza_CDR
cccaaggugagagaccaggagagc

SEQ ID NO: 29734 - RNA, 24 nt, Artificial Sequence
  derived and/or modified sequence opt3 from anti-influenza_CDR
accagcuacacauccucuaacacu

SEQ ID NO: 29735 - RNA, 24 nt, Artificial Sequence
  derived and/or modified sequence opt3 from anti-influenza_CDR
ggcgggaacuucaauaacuacgcc

SEQ ID NO: 29736 - RNA, 24 nt, Artificial Sequence
  derived and/or modified sequence opt3 from anti-influenza_CDR
aucagccccauuuucggcuccacc

SEQ ID NO: 29737 - RNA, 24 nt, Artificial Sequence
  derived and/or modified sequence opt3 from anti-influenza_CDR
agcuccuacaccucuucaaacaca

SEQ ID NO: 29738 - RNA, 24 nt, Artificial Sequence
  derived and/or modified sequence opt3 from anti-influenza_CDR
ggcgggaccuucaacaauuacgcc

SEQ ID NO: 29739 - RNA, 24 nt, Artificial Sequence
  derived and/or modified sequence opt3 from anti-influenza_CDR
aucagccccauuuucggcuccgug

SEQ ID NO: 29740 - RNA, 24 nt, Artificial Sequence
  derived and/or modified sequence opt3 from anti-influenza_CDR
agcuccaacaucggccacaauuuc

SEQ ID NO: 29741 - RNA, 24 nt, Artificial Sequence
  derived and/or modified sequence opt3 from anti-influenza_CDR
ggcaccugggacagcucccugucu

SEQ ID NO: 29742 - RNA, 24 nt, Artificial Sequence
  derived and/or modified sequence opt3 from anti-influenza_CDR
ggcgggaucauuagaaaguacgcc

SEQ ID NO: 29743 - RNA, 24 nt, Artificial Sequence
  derived and/or modified sequence opt3 from anti-influenza_CDR
aucauugccauauucaacaccgcu

SEQ ID NO: 29744 - RNA, 24 nt, Artificial Sequence
  derived and/or modified sequence opt3 from anti-influenza_CDR
ggcuacaccuucacagccuauacu

SEQ ID NO: 29745 - RNA, 24 nt, Artificial Sequence
  derived and/or modified sequence opt3 from anti-influenza_CDR
aucaacgccggcaaugggcacacc

SEQ ID NO: 29746 - RNA, 24 nt, Artificial Sequence
  derived and/or modified sequence opt3 from anti-influenza_CDR
ggcgggaccuucaucaacuacgcc

SEQ ID NO: 29747 - RNA, 24 nt, Artificial Sequence
  derived and/or modified sequence opt3 from anti-influenza_CDR
aucauucccguguacggcaccagc

SEQ ID NO: 29748 - RNA, 24 nt, Artificial Sequence
  derived and/or modified sequence opt3 from anti-influenza_CDR
ggcuucaccuuuagaagccacgcc

SEQ ID NO: 29749 - RNA, 24 nt, Artificial Sequence
  derived and/or modified sequence opt3 from anti-influenza_CDR
aucagcuacgacgaggugaacaag

SEQ ID NO: 29750 - RNA, 24 nt, Artificial Sequence
  derived and/or modified sequence opt3 from anti-influenza_CDR
ggcuacaacuucgccgcuuauuac

SEQ ID NO: 29751 - RNA, 24 nt, Artificial Sequence
  derived and/or modified sequence opt3 from anti-influenza_CDR
agcaaccccaauaccggcggggcc

SEQ ID NO: 29752 - RNA, 24 nt, Artificial Sequence
  derived and/or modified sequence opt3 from anti-influenza_CDR
ggcuacacccugaucgacuauuac

SEQ ID NO: 29753 - RNA, 24 nt, Artificial Sequence
  derived and/or modified sequence opt3 from anti-influenza_CDR
aucaaccccauuaauggcgggacc

SEQ ID NO: 29754 - RNA, 24 nt, Artificial Sequence
  derived and/or modified sequence opt3 from anti-influenza_CDR
ggcuucaccuuuagcgccuacgcu

SEQ ID NO: 29755 - RNA, 24 nt, Artificial Sequence
  derived and/or modified sequence opt3 from anti-influenza_CDR
accagcuacgacggcagagauucc

SEQ ID NO: 29756 - RNA, 24 nt, Artificial Sequence
  derived and/or modified sequence opt3 from anti-influenza_CDR
ggcuucaccuuuacaaacuacgcc

SEQ ID NO: 29757 - RNA, 24 nt, Artificial Sequence
  derived and/or modified sequence opt3 from anti-influenza_CDR
aucagcuucgacgaggauaacaag

SEQ ID NO: 29758 - RNA, 24 nt, Artificial Sequence
  derived and/or modified sequence opt3 from anti-influenza_CDR
ggcuucaacuuuagcuccuacggg

SEQ ID NO: 29759 - RNA, 24 nt, Artificial Sequence
  derived and/or modified sequence opt3 from anti-influenza_CDR
aucuggagcggcggguccaacaag

SEQ ID NO: 29760 - RNA, 24 nt, Artificial Sequence
  derived and/or modified sequence opt3 from anti-influenza_CDR
ggcuucaucuuuggggacuucgcc

SEQ ID NO: 29761 - RNA, 24 nt, Artificial Sequence
  derived and/or modified sequence opt3 from anti-influenza_CDR
ggcuucaacuuugacgaguacgug

SEQ ID NO: 29762 - RNA, 24 nt, Artificial Sequence
  derived and/or modified sequence opt3 from anti-influenza_CDR
aucggcgccgacgggagaggaacc

SEQ ID NO: 29763 - RNA, 24 nt, Artificial Sequence
  derived and/or modified sequence opt3 from anti-influenza_CDR
ggcgggagcguguccaacuacuau

SEQ ID NO: 29764 - RNA, 24 nt, Artificial Sequence
  derived and/or modified sequence opt3 from anti-influenza_CDR
ggcgggaccuucagcuacuaugcc

SEQ ID NO: 29765 - RNA, 24 nt, Artificial Sequence
  derived and/or modified sequence opt3 from anti-influenza_CDR
aucauucccauagugggcaccgcc

SEQ ID NO: 29766 - RNA, 24 nt, Artificial Sequence
  derived and/or modified sequence opt3 from anti-influenza_CDR
accagcaacaucggcuccaauaca

SEQ ID NO: 29767 - RNA, 24 nt, Artificial Sequence
  derived and/or modified sequence opt3 from anti-influenza_CDR
ggcuacaacuuccccaaguauugg

SEQ ID NO: 29768 - RNA, 24 nt, Artificial Sequence
  derived and/or modified sequence opt3 from anti-influenza_CDR
aucuaccccggcgacagcgaugug

SEQ ID NO: 29769 - RNA, 24 nt, Artificial Sequence
  derived and/or modified sequence opt3 from anti-influenza_CDR
ggccacaccuucaucagcuacgcc

SEQ ID NO: 29770 - RNA, 24 nt, Artificial Sequence
  derived and/or modified sequence opt3 from anti-influenza_CDR
aucgugcccauuuucggcaccguc

SEQ ID NO: 29771 - RNA, 24 nt, Artificial Sequence
  derived and/or modified sequence opt3 from anti-influenza_CDR
ggcuucaccuuuagaacauacggg

SEQ ID NO: 29772 - RNA, 24 nt, Artificial Sequence
  derived and/or modified sequence opt3 from anti-influenza_CDR
aucagcuacgacggcaccaacaag

SEQ ID NO: 29773 - RNA, 24 nt, Artificial Sequence
  derived and/or modified sequence opt3 from anti-influenza_CDR
ggcuucaccuuuagcuccuacggg

SEQ ID NO: 29774 - RNA, 24 nt, Artificial Sequence
  derived and/or modified sequence opt3 from anti-influenza_CDR
aucagcuacgacgagauuaacaag

SEQ ID NO: 29775 - RNA, 24 nt, Artificial Sequence
  derived and/or modified sequence opt3 from anti-influenza_CDR
ggcuucagccuguggaccuccggg

SEQ ID NO: 29776 - RNA, 24 nt, Artificial Sequence
  derived and/or modified sequence opt3 from anti-influenza_CDR
augagcuacgacgagaccaagaaa

SEQ ID NO: 29777 - RNA, 24 nt, Artificial Sequence
  derived and/or modified sequence opt3 from anti-influenza_CDR
ggcuucaccuuuagcagauacucc

SEQ ID NO: 29778 - RNA, 24 nt, Artificial Sequence
  derived and/or modified sequence opt3 from anti-influenza_CDR
aucagcgacaccuccagaacaauu

SEQ ID NO: 29779 - RNA, 24 nt, Artificial Sequence
  derived and/or modified sequence opt3 from anti-influenza_CDR
ggcuucaccuuuaacagcuacgcc

SEQ ID NO: 29780 - RNA, 24 nt, Artificial Sequence
  derived and/or modified sequence opt3 from anti-influenza_CDR
aucagaggcagcggggagaacacc

SEQ ID NO: 29781 - RNA, 24 nt, Artificial Sequence
  derived and/or modified sequence opt3 from anti-influenza_CDR
ggcuucaccuuuagcagauucucc

SEQ ID NO: 29782 - RNA, 24 nt, Artificial Sequence
  derived and/or modified sequence opt3 from anti-influenza_CDR
aucagcgacaccggcagaacaauu

SEQ ID NO: 29783 - RNA, 24 nt, Artificial Sequence
  derived and/or modified sequence opt3 from anti-influenza_CDR
ggcgacagcuucaccuccuacugg

SEQ ID NO: 29784 - RNA, 24 nt, Artificial Sequence
  derived and/or modified sequence opt3 from anti-influenza_CDR
aucuaccccagagacagcgagacc

SEQ ID NO: 29785 - RNA, 24 nt, Artificial Sequence
  derived and/or modified sequence opt3 from anti-influenza_CDR
ggcuacaccuucacagccuaucac

SEQ ID NO: 29786 - RNA, 24 nt, Artificial Sequence
  derived and/or modified sequence opt3 from anti-influenza_CDR
aucaaccccaauagcggcgccacc

SEQ ID NO: 29787 - RNA, 24 nt, Artificial Sequence
  derived and/or modified sequence opt3 from anti-influenza_CDR
ggcuucaccuuuagcgacuacugg

SEQ ID NO: 29788 - RNA, 24 nt, Artificial Sequence
  derived and/or modified sequence opt3 from anti-influenza_CDR
aucagcuccgacggcucuaccaca

SEQ ID NO: 29789 - RNA, 24 nt, Artificial Sequence
  derived and/or modified sequence opt3 from anti-influenza_CDR
ggcuucagcuuuuccaacgccugg

SEQ ID NO: 29790 - RNA, 24 nt, Artificial Sequence
  derived and/or modified sequence opt3 from anti-influenza_CDR
ggccugaccuucagcaacgccugg

SEQ ID NO: 29791 - RNA, 24 nt, Artificial Sequence
  derived and/or modified sequence opt3 from anti-influenza_CDR
ggcuucaccuuuagcaacgccugg

SEQ ID NO: 29792 - RNA, 24 nt, Artificial Sequence
  derived and/or modified sequence opt3 from anti-influenza_CDR
ggccugagcuuccucaacgccugg

SEQ ID NO: 29793 - RNA, 24 nt, Artificial Sequence
  derived and/or modified sequence opt3 from anti-influenza_CDR
ggcuucagcuuucugaacgccugg

SEQ ID NO: 29794 - RNA, 24 nt, Artificial Sequence
  derived and/or modified sequence opt3 from anti-influenza_CDR
ggccugaccuuccucaacgccugg

SEQ ID NO: 29795 - RNA, 24 nt, Artificial Sequence
  derived and/or modified sequence opt3 from anti-influenza_CDR
ggcuucaccuuucugaacgccugg

SEQ ID NO: 29796 - RNA, 24 nt, Artificial Sequence
  derived and/or modified sequence opt3 from anti-influenza_CDR
ggcuacaccuucacagacuauuac

SEQ ID NO: 29797 - RNA, 24 nt, Artificial Sequence
  derived and/or modified sequence opt3 from anti-influenza_CDR
gugaaccccuacagcggcgggacc

SEQ ID NO: 29798 - RNA, 24 nt, Artificial Sequence
  derived and/or modified sequence opt3 from anti-influenza_CDR
ggcuacaccuucacagacuauaac

SEQ ID NO: 29799 - RNA, 24 nt, Artificial Sequence
  derived and/or modified sequence opt3 from anti-influenza_CDR
aucuaccccaacaauggcgggacc

SEQ ID NO: 29800 - RNA, 24 nt, Artificial Sequence
  derived and/or modified sequence opt3 from anti-influenza_CDR
ggcuacaccuucacaggguauaac

SEQ ID NO: 29801 - RNA, 24 nt, Artificial Sequence
  derived and/or modified sequence opt3 from anti-influenza_CDR
aucuaccccaacaauggcgugacc

SEQ ID NO: 29802 - RNA, 24 nt, Artificial Sequence
  derived and/or modified sequence opt3 from anti-influenza_CDR
auggagaccgacacacugcuccuu

SEQ ID NO: 29803 - RNA, 27 nt, Artificial Sequence
  derived and/or modified sequence opt3 from anti-influenza_CDR
gacggcgugaccaacaaggucaauagc

SEQ ID NO: 29804 - RNA, 27 nt, Artificial Sequence
  derived and/or modified sequence opt3 from anti-influenza_CDR
ggcagcgacgugggguccucuaaccug

SEQ ID NO: 29805 - RNA, 27 nt, Artificial Sequence
  derived and/or modified sequence opt3 from anti-influenza_CDR
augcagaacauccugcucccccuuacc

SEQ ID NO: 29806 - RNA, 27 nt, Artificial Sequence
  derived and/or modified sequence opt3 from anti-influenza_CDR
augcagagccugcaacucccccuuacc

SEQ ID NO: 29807 - RNA, 27 nt, Artificial Sequence
  derived and/or modified sequence opt3 from anti-influenza_CDR
cagcaacacuacagaacacccccuacc

SEQ ID NO: 29808 - RNA, 27 nt, Artificial Sequence
  derived and/or modified sequence opt3 from anti-influenza_CDR
cagcaauacggcaacagccccuauacc

SEQ ID NO: 29809 - RNA, 27 nt, Artificial Sequence
  derived and/or modified sequence opt3 from anti-influenza_CDR
cagcaauacggcagcucccccuauacc

SEQ ID NO: 29810 - RNA, 27 nt, Artificial Sequence
  derived and/or modified sequence opt3 from anti-influenza_CDR
cagcaauacggcaccagcccccagaca

SEQ ID NO: 29811 - RNA, 27 nt, Artificial Sequence
  derived and/or modified sequence opt3 from anti-influenza_CDR
cagcaauacggcuaucugccccucacc

SEQ ID NO: 29812 - RNA, 27 nt, Artificial Sequence
  derived and/or modified sequence opt3 from anti-influenza_CDR
caggccugggacagcuccaccgcugug

SEQ ID NO: 29813 - RNA, 27 nt, Artificial Sequence
  derived and/or modified sequence opt3 from anti-influenza_CDR
cagcacuacaacgccuauuggggcacc

SEQ ID NO: 29814 - RNA, 27 nt, Artificial Sequence
  derived and/or modified sequence opt3 from anti-influenza_CDR
cagcaaaccuacagcuccccucccaca

SEQ ID NO: 29815 - RNA, 27 nt, Artificial Sequence
  derived and/or modified sequence opt3 from anti-influenza_CDR
cagcaauacuauagcuuccccuacacc

SEQ ID NO: 29816 - RNA, 27 nt, Artificial Sequence
  derived and/or modified sequence opt3 from anti-influenza_CDR
augcaggcccugcaacucccccuugcu

SEQ ID NO: 29817 - RNA, 27 nt, Artificial Sequence
  derived and/or modified sequence opt3 from anti-influenza_CDR
cagcaagccaacagcuuccccuuuacc

SEQ ID NO: 29818 - RNA, 27 nt, Artificial Sequence
  derived and/or modified sequence opt3 from anti-influenza_CDR
cagcaacugaacggcuacccccucacc

SEQ ID NO: 29819 - RNA, 27 nt, Artificial Sequence
  derived and/or modified sequence opt3 from anti-influenza_CDR
augcaggcccugcaaacaccccucacc

SEQ ID NO: 29820 - RNA, 27 nt, Artificial Sequence
  derived and/or modified sequence opt3 from anti-influenza_CDR
cagcaaaacuacaauuggccccugacc

SEQ ID NO: 29821 - RNA, 27 nt, Artificial Sequence
  derived and/or modified sequence opt3 from anti-influenza_CDR
cagcaauacgacaccagcuccggccug

SEQ ID NO: 29822 - RNA, 27 nt, Artificial Sequence
  derived and/or modified sequence opt3 from anti-influenza_CDR
cagcaauacaacagcuggcccagaacc

SEQ ID NO: 29823 - RNA, 27 nt, Artificial Sequence
  derived and/or modified sequence opt3 from anti-influenza_CDR
gugaucuacagccacggcagagccuau

SEQ ID NO: 29824 - RNA, 27 nt, Artificial Sequence
  derived and/or modified sequence opt3 from anti-influenza_CDR
cagcaauacggcgacagcagauauacc

SEQ ID NO: 29825 - RNA, 27 nt, Artificial Sequence
  derived and/or modified sequence opt3 from anti-influenza_CDR
cugcagcacaacagcuaccccuauacc

SEQ ID NO: 29826 - RNA, 27 nt, Artificial Sequence
  derived and/or modified sequence opt3 from anti-influenza_CDR
agaaagaugaccacagccuucgacagc

SEQ ID NO: 29827 - RNA, 27 nt, Artificial Sequence
  derived and/or modified sequence opt3 from anti-influenza_CDR
cagagaaaccacagccccuccuggacc

SEQ ID NO: 29828 - RNA, 27 nt, Artificial Sequence
  derived and/or modified sequence opt3 from anti-influenza_CDR
cagcaaagcuacgacaacccccagacc

SEQ ID NO: 29829 - RNA, 27 nt, Artificial Sequence
  derived and/or modified sequence opt3 from anti-influenza_CDR
cagcaaagcagaaggcugcccuacacc

SEQ ID NO: 29830 - RNA, 27 nt, Artificial Sequence
  derived and/or modified sequence opt3 from anti-influenza_CDR
agaaagaugaccacagccaucgacuac

SEQ ID NO: 29831 - RNA, 27 nt, Artificial Sequence
  derived and/or modified sequence opt3 from anti-influenza_CDR
aucagauacaccggccagcaacugcuc

SEQ ID NO: 29832 - RNA, 27 nt, Artificial Sequence
  derived and/or modified sequence opt3 from anti-influenza_CDR
cagcacuacggcaccaucagccaaaca

SEQ ID NO: 29833 - RNA, 27 nt, Artificial Sequence
  derived and/or modified sequence opt3 from anti-influenza_CDR
cagcaauacagcaccuccccucccaca

SEQ ID NO: 29834 - RNA, 27 nt, Artificial Sequence
  derived and/or modified sequence opt3 from anti-influenza_CDR
cagcaauacggcaacagccccaucacc

SEQ ID NO: 29835 - RNA, 27 nt, Artificial Sequence
  derived and/or modified sequence opt3 from anti-influenza_CDR
cagcaauacuauagcagacccuacacc

SEQ ID NO: 29836 - RNA, 27 nt, Artificial Sequence
  derived and/or modified sequence opt3 from anti-influenza_CDR
caggugugggacaacuucggcgggguc

SEQ ID NO: 29837 - RNA, 27 nt, Artificial Sequence
  derived and/or modified sequence opt3 from anti-influenza_CDR
cagcaaagcuacuccucuccccugacc

SEQ ID NO: 29838 - RNA, 27 nt, Artificial Sequence
  derived and/or modified sequence opt3 from anti-influenza_CDR
cagcaauacuucgccacccccagaaca

SEQ ID NO: 29839 - RNA, 27 nt, Artificial Sequence
  derived and/or modified sequence opt3 from anti-influenza_CDR
cagcaauacuauuucagcccccugacc

SEQ ID NO: 29840 - RNA, 27 nt, Artificial Sequence
  derived and/or modified sequence opt3 from anti-influenza_CDR
cagcacuucggcaccagcguguuuaca

SEQ ID NO: 29841 - RNA, 27 nt, Artificial Sequence
  derived and/or modified sequence opt3 from anti-influenza_CDR
cagcaauacuauaacgccccccugacc

SEQ ID NO: 29842 - RNA, 27 nt, Artificial Sequence
  derived and/or modified sequence opt3 from anti-influenza_CDR
gugcuguucaccagccccuuugacuuc

SEQ ID NO: 29843 - RNA, 27 nt, Artificial Sequence
  derived and/or modified sequence opt3 from anti-influenza_CDR
cugcucagcuacuccggcguguggguc

SEQ ID NO: 29844 - RNA, 27 nt, Artificial Sequence
  derived and/or modified sequence opt3 from anti-influenza_CDR
uuccugagcuacuccggcgccugggug

SEQ ID NO: 29845 - RNA, 27 nt, Artificial Sequence
  derived and/or modified sequence opt3 from anti-influenza_CDR
caacagagcuucuccaagucuuggacc

SEQ ID NO: 29846 - RNA, 27 nt, Artificial Sequence
  derived and/or modified sequence opt3 from anti-influenza_CDR
gugcaguacguccaauuccccuggacc

SEQ ID NO: 29847 - RNA, 27 nt, Artificial Sequence
  derived and/or modified sequence opt3 from anti-influenza_CDR
cagcaaagcuacuccccuccccugacc

SEQ ID NO: 29848 - RNA, 27 nt, Artificial Sequence
  derived and/or modified sequence opt3 from anti-influenza_CDR
uucaucuacuauggcgggaacaccaag

SEQ ID NO: 29849 - RNA, 27 nt, Artificial Sequence
  derived and/or modified sequence opt3 from anti-influenza_CDR
gugaucuacagcggcggguccaccuau

SEQ ID NO: 29850 - RNA, 27 nt, Artificial Sequence
  derived and/or modified sequence opt3 from anti-influenza_CDR
uucauguuucacagcggcucccccaga

SEQ ID NO: 29851 - RNA, 27 nt, Artificial Sequence
  derived and/or modified sequence opt3 from anti-influenza_CDR
cagcaaaccuacagcacacccaucacu

SEQ ID NO: 29852 - RNA, 27 nt, Artificial Sequence
  derived and/or modified sequence opt3 from anti-influenza_CDR
uucuuuuacaacggcgggagcaccaag

SEQ ID NO: 29853 - RNA, 27 nt, Artificial Sequence
  derived and/or modified sequence opt3 from anti-influenza_CDR
cagcaaagcuacaacaccccccugauc

SEQ ID NO: 29854 - RNA, 27 nt, Artificial Sequence
  derived and/or modified sequence opt3 from anti-influenza_CDR
cacaucuacgacuauggcagaaccuuc

SEQ ID NO: 29855 - RNA, 27 nt, Artificial Sequence
  derived and/or modified sequence opt3 from anti-influenza_CDR
guguucuacagcgagaccagaacauau

SEQ ID NO: 29856 - RNA, 27 nt, Artificial Sequence
  derived and/or modified sequence opt3 from anti-influenza_CDR
cagguguggggcagcuccucugaccac

SEQ ID NO: 29857 - RNA, 27 nt, Artificial Sequence
  derived and/or modified sequence opt3 from anti-influenza_CDR
uacguguauaacagaggcagcaccaag

SEQ ID NO: 29858 - RNA, 27 nt, Artificial Sequence
  derived and/or modified sequence opt3 from anti-influenza_CDR
uacaucuauaacagaggcagcaccaag

SEQ ID NO: 29859 - RNA, 27 nt, Artificial Sequence
  derived and/or modified sequence opt3 from anti-influenza_CDR
cagcaaagcuacaacacccccaucaca

SEQ ID NO: 29860 - RNA, 27 nt, Artificial Sequence
  derived and/or modified sequence opt3 from anti-influenza_CDR
cagcaauacuauagcuccccucccacc

SEQ ID NO: 29861 - RNA, 27 nt, Artificial Sequence
  derived and/or modified sequence opt3 from anti-influenza_CDR
uaccuguauuacagcggcuccaccaag

SEQ ID NO: 29862 - RNA, 27 nt, Artificial Sequence
  derived and/or modified sequence opt3 from anti-influenza_CDR
cagcaaagcuacuccccucccaucacc

SEQ ID NO: 29863 - RNA, 27 nt, Artificial Sequence
  derived and/or modified sequence opt3 from anti-influenza_CDR
uacguguauaacagcggcaauaccaag

SEQ ID NO: 29864 - RNA, 27 nt, Artificial Sequence
  derived and/or modified sequence opt3 from anti-influenza_CDR
cagcaaagcuacaacacaccccugacc

SEQ ID NO: 29865 - RNA, 27 nt, Artificial Sequence
  derived and/or modified sequence opt3 from anti-influenza_CDR
cacaucuucgacagcggcuccaccuac

SEQ ID NO: 29866 - RNA, 27 nt, Artificial Sequence
  derived and/or modified sequence opt3 from anti-influenza_CDR
guguucuacagcgccgacagaaccucc

SEQ ID NO: 29867 - RNA, 27 nt, Artificial Sequence
  derived and/or modified sequence opt3 from anti-influenza_CDR
cagcaauacuauagcacaccccugacc

SEQ ID NO: 29868 - RNA, 27 nt, Artificial Sequence
  derived and/or modified sequence opt3 from anti-influenza_CDR
uacaucuauuacagcggcaacaccuau

SEQ ID NO: 29869 - RNA, 27 nt, Artificial Sequence
  derived and/or modified sequence opt3 from anti-influenza_CDR
cagcaaagcuacuccacaccccugacc

SEQ ID NO: 29870 - RNA, 27 nt, Artificial Sequence
  derived and/or modified sequence opt3 from anti-influenza_CDR
cagcaauacggcagcuccucucugacc

SEQ ID NO: 29871 - RNA, 27 nt, Artificial Sequence
  derived and/or modified sequence opt3 from anti-influenza_CDR
agcuccuacaccucuucaaguacauau

SEQ ID NO: 29872 - RNA, 27 nt, Artificial Sequence
  derived and/or modified sequence opt3 from anti-influenza_CDR
cagagauacaacagcgccccucccauc

SEQ ID NO: 29873 - RNA, 27 nt, Artificial Sequence
  derived and/or modified sequence opt3 from anti-influenza_CDR
cagcaauacggcagaacaccccugacc

SEQ ID NO: 29874 - RNA, 27 nt, Artificial Sequence
  derived and/or modified sequence opt3 from anti-influenza_CDR
cagcaauacggcagcucccccagaacc

SEQ ID NO: 29875 - RNA, 27 nt, Artificial Sequence
  derived and/or modified sequence opt3 from anti-influenza_CDR
cagcaauacggcuccagcccccugacc

SEQ ID NO: 29876 - RNA, 27 nt, Artificial Sequence
  derived and/or modified sequence opt3 from anti-influenza_CDR
caggugugggacagcuccucugaucac

SEQ ID NO: 29877 - RNA, 27 nt, Artificial Sequence
  derived and/or modified sequence opt3 from anti-influenza_CDR
aaggaguucagcgaaguggagggcaga

SEQ ID NO: 29878 - RNA, 27 nt, Artificial Sequence
  derived and/or modified sequence opt3 from anti-influenza_CDR
aaagaguucaacaaucuggaaaagaga

SEQ ID NO: 29879 - RNA, 27 nt, Artificial Sequence
  derived and/or modified sequence opt3 from anti-influenza_CDR
cagcaacacuacagaaccccucccagc

SEQ ID NO: 29880 - RNA, 27 nt, Artificial Sequence
  derived and/or modified sequence opt3 from anti-influenza_CDR
augcaggccacccacuggccccugaca

SEQ ID NO: 29881 - RNA, 27 nt, Artificial Sequence
  derived and/or modified sequence opt3 from anti-influenza_CDR
cagcaauacuauagcuaccccuauacc

SEQ ID NO: 29882 - RNA, 27 nt, Artificial Sequence
  derived and/or modified sequence opt3 from anti-influenza_CDR
agcuccgacgugggcggguacaacuau

SEQ ID NO: 29883 - RNA, 27 nt, Artificial Sequence
  derived and/or modified sequence opt3 from anti-influenza_CDR
agcuccgacgugggcgauuacaacuau

SEQ ID NO: 29884 - RNA, 27 nt, Artificial Sequence
  derived and/or modified sequence opt3 from anti-influenza_CDR
cagcaauacaacaauuggccccugagc

SEQ ID NO: 29885 - RNA, 27 nt, Artificial Sequence
  derived and/or modified sequence opt3 from anti-influenza_CDR
cagcaaagcuacaacuaucccagaacc

SEQ ID NO: 29886 - RNA, 27 nt, Artificial Sequence
  derived and/or modified sequence opt3 from anti-influenza_CDR
augcagggccugcaaacccccuacaca

SEQ ID NO: 29887 - RNA, 27 nt, Artificial Sequence
  derived and/or modified sequence opt3 from anti-influenza_CDR
cagcaacacuacagcaucccccugacc

SEQ ID NO: 29888 - RNA, 27 nt, Artificial Sequence
  derived and/or modified sequence opt3 from anti-influenza_CDR
cugcagcacaacagcuaccccuggacc

SEQ ID NO: 29889 - RNA, 27 nt, Artificial Sequence
  derived and/or modified sequence opt3 from anti-influenza_CDR
cagcaauacaacaccuggccccugaca

SEQ ID NO: 29890 - RNA, 27 nt, Artificial Sequence
  derived and/or modified sequence opt3 from anti-influenza_CDR
cagcaauacaacagcuuccccuauaga

SEQ ID NO: 29891 - RNA, 27 nt, Artificial Sequence
  derived and/or modified sequence opt3 from anti-influenza_CDR
cagcaaagcuacuccgcccccuucacc

SEQ ID NO: 29892 - RNA, 27 nt, Artificial Sequence
  derived and/or modified sequence opt3 from anti-influenza_CDR
caggccugggacagcuccaccgugguc

SEQ ID NO: 29893 - RNA, 27 nt, Artificial Sequence
  derived and/or modified sequence opt3 from anti-influenza_CDR
caggccugggacagcaccacagugguc

SEQ ID NO: 29894 - RNA, 27 nt, Artificial Sequence
  derived and/or modified sequence opt3 from anti-influenza_CDR
cugcaguacggcagcucccccagaacc

SEQ ID NO: 29895 - RNA, 27 nt, Artificial Sequence
  derived and/or modified sequence opt3 from anti-influenza_CDR
agcuccgacgugggcggguacgauuau

SEQ ID NO: 29896 - RNA, 27 nt, Artificial Sequence
  derived and/or modified sequence opt3 from anti-influenza_CDR
cagcaauacaccuauuggccccugaca

SEQ ID NO: 29897 - RNA, 27 nt, Artificial Sequence
  derived and/or modified sequence opt3 from anti-influenza_CDR
cagcaauacgacaaguggcccccuggc

SEQ ID NO: 29898 - RNA, 27 nt, Artificial Sequence
  derived and/or modified sequence opt3 from anti-influenza_CDR
augcagagccugcaaaccuccaucaca

SEQ ID NO: 29899 - RNA, 27 nt, Artificial Sequence
  derived and/or modified sequence opt3 from anti-influenza_CDR
agccagaucgagcuggccgugcuccuu

SEQ ID NO: 29900 - RNA, 27 nt, Artificial Sequence
  derived and/or modified sequence opt3 from anti-influenza_CDR
augcaggcccugcaaacccccuacaca

SEQ ID NO: 29901 - RNA, 27 nt, Artificial Sequence
  derived and/or modified sequence opt3 from anti-influenza_CDR
cagcaaagaagccacuggcccccuauc

SEQ ID NO: 29902 - RNA, 27 nt, Artificial Sequence
  derived and/or modified sequence opt3 from anti-influenza_CDR
cagcacuucuggggcacaccccugacc

SEQ ID NO: 29903 - RNA, 27 nt, Artificial Sequence
  derived and/or modified sequence opt3 from anti-influenza_CDR
cagcaaaacuacgaggaccccuggacc

SEQ ID NO: 29904 - RNA, 27 nt, Artificial Sequence
  derived and/or modified sequence opt3 from anti-influenza_CDR
cagcaagccaacagcuucccucccacc

SEQ ID NO: 29905 - RNA, 27 nt, Artificial Sequence
  derived and/or modified sequence opt3 from anti-influenza_CDR
cagcaaagagaccacuggcccccuauc

SEQ ID NO: 29906 - RNA, 27 nt, Artificial Sequence
  derived and/or modified sequence opt3 from anti-influenza_CDR
auggacagcagacugaaccucguguuc

SEQ ID NO: 29907 - RNA, 27 nt, Artificial Sequence
  derived and/or modified sequence opt3 from anti-influenza_CDR
augaagcugcccgugagacuccuuguc

SEQ ID NO: 29908 - RNA, 30 nt, Artificial Sequence
  derived and/or modified sequence opt3 from anti-influenza_CDR
ggcgacagcgugaccagagggggauucuac

SEQ ID NO: 29909 - RNA, 30 nt, Artificial Sequence
  derived and/or modified sequence opt3 from anti-influenza_CDR
cagagcgugaccuucaacaauaagaacuac

SEQ ID NO: 29910 - RNA, 30 nt, Artificial Sequence
  derived and/or modified sequence opt3 from anti-influenza_CDR
cagagcgugaccuucaacuacaagaauuau

SEQ ID NO: 29911 - RNA, 30 nt, Artificial Sequence
  derived and/or modified sequence opt3 from anti-influenza_CDR
agagcccagagccuguccucuuaccuccac

SEQ ID NO: 29912 - RNA, 30 nt, Artificial Sequence
  derived and/or modified sequence opt3 from anti-influenza_CDR
agcuccuacaccucuucaaguacauaugug

SEQ ID NO: 29913 - RNA, 30 nt, Artificial Sequence
  derived and/or modified sequence opt3 from anti-influenza_CDR
cagagauacaacagcgccccucccaucacc

SEQ ID NO: 29914 - RNA, 30 nt, Artificial Sequence
  derived and/or modified sequence opt3 from anti-influenza_CDR
ggcgggagcaucuccucuggaaccuacuau

SEQ ID NO: 29915 - RNA, 30 nt, Artificial Sequence
  derived and/or modified sequence opt3 from anti-influenza_CDR
cagcaaagcuacuccucucugauguucacc

SEQ ID NO: 29916 - RNA, 30 nt, Artificial Sequence
  derived and/or modified sequence opt3 from anti-influenza_CDR
cugcucaucuacggcgccagcaccagagcu

SEQ ID NO: 29917 - RNA, 30 nt, Artificial Sequence
  derived and/or modified sequence opt3 from anti-influenza_CDR
ugcgccuacggcgggaaguaucuggugguc

SEQ ID NO: 29918 - RNA, 30 nt, Artificial Sequence
  derived and/or modified sequence opt3 from anti-influenza_CDR
agacccgacuucuacggcgauuuugaguau

SEQ ID NO: 29919 - RNA, 30 nt, Artificial Sequence
  derived and/or modified sequence opt3 from anti-influenza_CDR
cagcacuacggcuauagccccagauacgcc

SEQ ID NO: 29920 - RNA, 30 nt, Artificial Sequence
  derived and/or modified sequence opt3 from anti-influenza_CDR
cagcaaagaagccacuggcccccuaucacc

SEQ ID NO: 29921 - RNA, 30 nt, Artificial Sequence
  derived and/or modified sequence opt3 from anti-influenza_CDR
agcuccuacgccggcucaucuaccugggug

SEQ ID NO: 29922 - RNA, 30 nt, Artificial Sequence; identical to SEQ ID NO: 14638
  derived and/or modified sequence opt3 from anti-influenza_CDR

SEQ ID NO: 29923 - RNA, 30 nt, Artificial Sequence
  derived and/or modified sequence opt3 from anti-influenza_CDR
cagcaauacggcgggagccccagauauacc

SEQ ID NO: 29924 - RNA, 30 nt, Artificial Sequence
  derived and/or modified sequence opt3 from anti-influenza_CDR
agauacggcagcggguauggauucgacucc

SEQ ID NO: 29925 - RNA, 30 nt, Artificial Sequence
  derived and/or modified sequence opt3 from anti-influenza_CDR
agcuccuacgccggcaacuauaaucacgug

SEQ ID NO: 29926 - RNA, 30 nt, Artificial Sequence
  derived and/or modified sequence opt3 from anti-influenza_CDR
cagcaauacaucaacuggagaccccugagc

SEQ ID NO: 29927 - RNA, 30 nt, Artificial Sequence
  derived and/or modified sequence opt3 from anti-influenza_CDR
aucggcgccggguacgacgugcacugguau

SEQ ID NO: 29928 - RNA, 30 nt, Artificial Sequence
  derived and/or modified sequence opt3 from anti-influenza_CDR
cugcucaucuacgacaacaauaacagaccc

SEQ ID NO: 29929 - RNA, 30 nt, Artificial Sequence
  derived and/or modified sequence opt3 from anti-influenza_CDR
cagagcuacgacaacucccugucuggcuca

SEQ ID NO: 29930 - RNA, 30 nt, Artificial Sequence
  derived and/or modified sequence opt3 from anti-influenza_CDR
cugcucaucuacgacgccagcaaccuucag

SEQ ID NO: 29931 - RNA, 30 nt, Artificial Sequence
  derived and/or modified sequence opt3 from anti-influenza_CDR
cugcucauccacgacgccagcaaccuugag

SEQ ID NO: 29932 - RNA, 30 nt, Artificial Sequence
  derived and/or modified sequence opt3 from anti-influenza_CDR
gugcagagacugagcuacggcauggacguc

SEQ ID NO: 29933 - RNA, 30 nt, Artificial Sequence
  derived and/or modified sequence opt3 from anti-influenza_CDR
gugcagaagagcuacuauggcauggacguc

SEQ ID NO: 29934 - RNA, 30 nt, Artificial Sequence
  derived and/or modified sequence opt3 from anti-influenza_CDR
agcuccuacaccucuucaaguacacacgug

SEQ ID NO: 29935 - RNA, 30 nt, Artificial Sequence
  derived and/or modified sequence opt3 from anti-influenza_CDR
agcuccuacaccucuucaaguacacuggug

SEQ ID NO: 29936 - RNA, 30 nt, Artificial Sequence
  derived and/or modified sequence opt3 from anti-influenza_CDR
accaagagaagccagcaaacagugaucccc

SEQ ID NO: 29937 - RNA, 30 nt, Artificial Sequence
  derived and/or modified sequence opt3 from anti-influenza_CDR
accagcagaucccagcaaacagugaucccc

SEQ ID NO: 29938 - RNA, 30 nt, Artificial Sequence
  derived and/or modified sequence opt3 from anti-influenza_CDR
agcuccaacuacaauagaagguucaccccc

SEQ ID NO: 29939 - RNA, 30 nt, Artificial Sequence
  derived and/or modified sequence opt3 from anti-influenza_CDR
agacccaaggugagggaccaggagagccgg

SEQ ID NO: 29940 - RNA, 30 nt, Artificial Sequence
  derived and/or modified sequence opt3 from anti-influenza_CDR
agacccugggugaggggcgucagcucccgg

SEQ ID NO: 29941 - RNA, 30 nt, Artificial Sequence
  derived and/or modified sequence opt3 from anti-influenza_CDR
agacccugggugaggggccugagcucccgg

SEQ ID NO: 29942 - RNA, 30 nt, Artificial Sequence
  derived and/or modified sequence opt3 from anti-influenza_CDR
agacccaaggugaggggccaggccgggcgg

SEQ ID NO: 29943 - RNA, 30 nt, Artificial Sequence
  derived and/or modified sequence opt3 from anti-influenza_CDR
gcccccgcuguggcagcccaggcgagcgcu

SEQ ID NO: 29944 - RNA, 30 nt, Artificial Sequence
  derived and/or modified sequence opt3 from anti-influenza_CDR
gugcaccaucccggcaccgacaacgaucag

SEQ ID NO: 29945 - RNA, 30 nt, Artificial Sequence
  derived and/or modified sequence opt3 from anti-influenza_CDR
uucggccaggggaccaagguggagaucaaa

SEQ ID NO: 29946 - RNA, 30 nt, Artificial Sequence
  derived and/or modified sequence opt3 from anti-influenza_CDR
ggcuucgccuuucacaacagagcuaugcau

SEQ ID NO: 29947 - RNA, 30 nt, Artificial Sequence; identical to SEQ ID NO: 14663
  derived and/or modified sequence opt3 from anti-influenza_CDR

SEQ ID NO: 29948 - RNA, 30 nt, Artificial Sequence; identical to SEQ ID NO: 14664
  derived and/or modified sequence opt3 from anti-influenza_CDR

SEQ ID NO: 29949 - RNA, 30 nt, Artificial Sequence
  derived and/or modified sequence opt3 from anti-influenza_CDR
ggcagcaucuucuccaacuacgggauuucu

SEQ ID NO: 29950 - RNA, 30 nt, Artificial Sequence
  derived and/or modified sequence opt3 from anti-influenza_CDR
ggcuacagcuucaacaauuaugggaucaac

SEQ ID NO: 29951 - RNA, 30 nt, Artificial Sequence
  derived and/or modified sequence opt3 from anti-influenza_CDR
ggcuacaccuucaacgccuauuacauccac

SEQ ID NO: 29952 - RNA, 30 nt, Artificial Sequence
  derived and/or modified sequence opt3 from anti-influenza_CDR
ggcuacacauucaccagcuuuaucauguau

SEQ ID NO: 29953 - RNA, 30 nt, Artificial Sequence
  derived and/or modified sequence opt3 from anti-influenza_CDR
agaggcaacuacgggaauggauucgccuau

SEQ ID NO: 29954 - RNA, 30 nt, Artificial Sequence
  derived and/or modified sequence opt3 from anti-influenza_CDR
cagcaauacggcagcucccccgcccugacc

SEQ ID NO: 29955 - RNA, 30 nt, Artificial Sequence
  derived and/or modified sequence opt3 from anti-influenza_CDR
caggaguacaacaaugacagcccccugacc

SEQ ID NO: 29956 - RNA, 30 nt, Artificial Sequence
  derived and/or modified sequence opt3 from anti-influenza_CDR
aucagaagcggccugaacagguucgagacc

SEQ ID NO: 29957 - RNA, 30 nt, Artificial Sequence
  derived and/or modified sequence opt3 from anti-influenza_CDR
guguucuacagcggcuccucuaacuauaau

SEQ ID NO: 29958 - RNA, 30 nt, Artificial Sequence
  derived and/or modified sequence opt3 from anti-influenza_CDR
ggcgccagcaucuccaccgggggaaacuac

SEQ ID NO: 29959 - RNA, 30 nt, Artificial Sequence
  derived and/or modified sequence opt3 from anti-influenza_CDR
aucuucuacagcggcaccacaaaguauaac

SEQ ID NO: 29960 - RNA, 30 nt, Artificial Sequence
  derived and/or modified sequence opt3 from anti-influenza_CDR
gccagcuacgcuggcaccuauauccaccug

SEQ ID NO: 29961 - RNA, 30 nt, Artificial Sequence
  derived and/or modified sequence opt3 from anti-influenza_CDR
cagcaacugaacagcuacccucccaucacc

SEQ ID NO: 29962 - RNA, 30 nt, Artificial Sequence
  derived and/or modified sequence opt3 from anti-influenza_CDR
cagcaauucaacgacuggcccuuucugacc

SEQ ID NO: 29963 - RNA, 30 nt, Artificial Sequence
  derived and/or modified sequence opt3 from anti-influenza_CDR
cagcaacugaccacauacccucccaucacu

SEQ ID NO: 29964 - RNA, 30 nt, Artificial Sequence
  derived and/or modified sequence opt3 from anti-influenza_CDR
ggcgggagcaucuccaacggagguuaccac

SEQ ID NO: 29965 - RNA, 30 nt, Artificial Sequence
  derived and/or modified sequence opt3 from anti-influenza_CDR
ggcgacagcgugaucaacuccgccuacuau

SEQ ID NO: 29966 - RNA, 30 nt, Artificial Sequence
  derived and/or modified sequence opt3 from anti-influenza_CDR
cagcaauacgacaacuggcugcccaucacc

SEQ ID NO: 29967 - RNA, 30 nt, Artificial Sequence
  derived and/or modified sequence opt3 from anti-influenza_CDR
gccggcgacuacagcgggggaaucuaugcu

SEQ ID NO: 29968 - RNA, 30 nt, Artificial Sequence
  derived and/or modified sequence opt3 from anti-influenza_CDR
gccggcgacuacagcggguccaacuaugcu

SEQ ID NO: 29969 - RNA, 30 nt, Artificial Sequence
  derived and/or modified sequence opt3 from anti-influenza_CDR
gccggcgacuacagcggggcuaacuaugca

SEQ ID NO: 29970 - RNA, 30 nt, Artificial Sequence
  derived and/or modified sequence opt3 from anti-influenza_CDR
ggccugagccucuacuccaacgagaucaau

SEQ ID NO: 29971 - RNA, 30 nt, Artificial Sequence
  derived and/or modified sequence opt3 from anti-influenza_CDR
gccagcuacgcuggcaacaauaucuaugug

SEQ ID NO: 29972 - RNA, 30 nt, Artificial Sequence
  derived and/or modified sequence opt3 from anti-influenza_CDR
gccagccaguccgugucuaccuuccuggcu

SEQ ID NO: 29973 - RNA, 30 nt, Artificial Sequence
  derived and/or modified sequence opt3 from anti-influenza_CDR
aucaagagcaacaccgacggcgggacaacu

SEQ ID NO: 29974 - RNA, 30 nt, Artificial Sequence; identical to SEQ ID NO: 14690
  derived and/or modified sequence opt3 from anti-influenza_CDR

SEQ ID NO: 29975 - RNA, 30 nt, Artificial Sequence
  derived and/or modified sequence opt3 from anti-influenza_CDR
gagagcaucgacauuuacggcaacuccuuc

SEQ ID NO: 29976 - RNA, 30 nt, Artificial Sequence
  derived and/or modified sequence opt3 from anti-influenza_CDR
gccggcgacuacagcggggugaacuaugcu

SEQ ID NO: 29977 - RNA, 33 nt, Artificial Sequence
  derived and/or modified sequence opt3 from anti-influenza_CDR
gccgcuugggacgauagccugaacggccagcuc

SEQ ID NO: 29978 - RNA, 33 nt, Artificial Sequence
  derived and/or modified sequence opt3 from anti-influenza_CDR
ugcagcuacgccggcuccucuucaaguagagug

SEQ ID NO: 29979 - RNA, 33 nt, Artificial Sequence
  derived and/or modified sequence opt3 from anti-influenza_CDR
cuggugcucgccaccggccuuagaaacagcccc

SEQ ID NO: 29980 - RNA, 33 nt, Artificial Sequence; identical to SEQ ID NO: 14696
  derived and/or modified sequence opt3 from anti-influenza_CDR

SEQ ID NO: 29981 - RNA, 33 nt, Artificial Sequence
  derived and/or modified sequence opt3 from anti-influenza_CDR
agaaccagccagucccugucuucauaccuccac

SEQ ID NO: 29982 - RNA, 33 nt, Artificial Sequence
  derived and/or modified sequence opt3 from anti-influenza_CDR
agagccagccagaggcugaacuccuaccuccac

SEQ ID NO: 29983 - RNA, 33 nt, Artificial Sequence
  derived and/or modified sequence opt3 from anti-influenza_CDR
agaaccagccagucccugaggucuuaccuccac

SEQ ID NO: 29984 - RNA, 33 nt, Artificial Sequence
  derived and/or modified sequence opt3 from anti-influenza_CDR
agaaccagccagucccugucuucauacacacac

SEQ ID NO: 29985 - RNA, 33 nt, Artificial Sequence
  derived and/or modified sequence opt3 from anti-influenza_CDR
agaaccagccagucccugucuucauacgaccac

SEQ ID NO: 29986 - RNA, 33 nt, Artificial Sequence
  derived and/or modified sequence opt3 from anti-influenza_CDR
caggugugggacagcuccucugaucacuacguc

SEQ ID NO: 29987 - RNA, 33 nt, Artificial Sequence
  derived and/or modified sequence opt3 from anti-influenza_CDR
cagguguggggcagcuccucugaccacuacguc

SEQ ID NO: 29988 - RNA, 33 nt, Artificial Sequence
  derived and/or modified sequence opt3 from anti-influenza_CDR
ggcaccugggacagcucccugucuguggggaug

SEQ ID NO: 29989 - RNA, 33 nt, Artificial Sequence
  derived and/or modified sequence opt3 from anti-influenza_CDR
cagagccugcuccacggcaacggguacaauuau

SEQ ID NO: 29990 - RNA, 33 nt, Artificial Sequence
  derived and/or modified sequence opt3 from anti-influenza_CDR
agagccagccagggcaucaggaacgaccugggg

SEQ ID NO: 29991 - RNA, 33 nt, Artificial Sequence
  derived and/or modified sequence opt3 from anti-influenza_CDR
agagccagccagaacaucagguccuaccugaau

SEQ ID NO: 29992 - RNA, 33 nt, Artificial Sequence
  derived and/or modified sequence opt3 from anti-influenza_CDR
agagccaaccaggacaucggcauuuaccugaau

SEQ ID NO: 29993 - RNA, 33 nt, Artificial Sequence
  derived and/or modified sequence opt3 from anti-influenza_CDR
agagccagccaguccgugucuaacaaucuggcu

SEQ ID NO: 29994 - RNA, 33 nt, Artificial Sequence
  derived and/or modified sequence opt3 from anti-influenza_CDR
cagcaauaccacaacuggcccccuagcuauucc

SEQ ID NO: 29995 - RNA, 33 nt, Artificial Sequence
  derived and/or modified sequence opt3 from anti-influenza_CDR
agagccagccagggcauccugaacugccucgcu

SEQ ID NO: 29996 - RNA, 33 nt, Artificial Sequence
  derived and/or modified sequence opt3 from anti-influenza_CDR
agagccagccaguccaucgcuucuuggcuggca

SEQ ID NO: 29997 - RNA, 33 nt, Artificial Sequence
  derived and/or modified sequence opt3 from anti-influenza_CDR
gcccccagaguguacgaguauuacuucgaccag

SEQ ID NO: 29998 - RNA, 33 nt, Artificial Sequence
  derived and/or modified sequence opt3 from anti-influenza_CDR
agagccagccaguccgugucuucauaccuggcu

SEQ ID NO: 29999 - RNA, 33 nt, Artificial Sequence
  derived and/or modified sequence opt3 from anti-influenza_CDR
agcggcgacgcccugcccaagcagaacgcuuac

SEQ ID NO: 30000 - RNA, 33 nt, Artificial Sequence
  derived and/or modified sequence opt3 from anti-influenza_CDR
cagagcgccgacuccucuggcaccucaugggug

SEQ ID NO: 30001 - RNA, 33 nt, Artificial Sequence
  derived and/or modified sequence opt3 from anti-influenza_CDR
ggcgggagcaacaucggagguaaguccgugcac

SEQ ID NO: 30002 - RNA, 33 nt, Artificial Sequence
  derived and/or modified sequence opt3 from anti-influenza_CDR
cagcacuacggcagcucccccagauaugccuuc

SEQ ID NO: 30003 - RNA, 33 nt, Artificial Sequence
  derived and/or modified sequence opt3 from anti-influenza_CDR
agagccagccaguccaucucuucauaccugaac

SEQ ID NO: 30004 - RNA, 33 nt, Artificial Sequence
  derived and/or modified sequence opt3 from anti-influenza_CDR
ggcgggaacgccaucggaagcaagaaagugcac

SEQ ID NO: 30005 - RNA, 33 nt, Artificial Sequence
  derived and/or modified sequence opt3 from anti-influenza_CDR
caggugugggacuucaccaucgaucacgucguu

SEQ ID NO: 30006 - RNA, 33 nt, Artificial Sequence
  derived and/or modified sequence opt3 from anti-influenza_CDR
gccaccugggacggcagccuguccgcuugggug

SEQ ID NO: 30007 - RNA, 33 nt, Artificial Sequence
  derived and/or modified sequence opt3 from anti-influenza_CDR
agagccagccaguccgugggcaacuaccuggcu

SEQ ID NO: 30008 - RNA, 33 nt, Artificial Sequence
  derived and/or modified sequence opt3 from anti-influenza_CDR
cagcaaagaagcaaguggcccccuauguacucc

SEQ ID NO: 30009 - RNA, 33 nt, Artificial Sequence
  derived and/or modified sequence opt3 from anti-influenza_CDR
gacgugagcaccacaugguccugguucgccccc

SEQ ID NO: 30010 - RNA, 33 nt, Artificial Sequence
  derived and/or modified sequence opt3 from anti-influenza_CDR
agagccagccagaacaucaagagguacuucaau

SEQ ID NO: 30011 - RNA, 33 nt, Artificial Sequence
  derived and/or modified sequence opt3 from anti-influenza_CDR
agagccagccaguccgugggcaacucucuggcu

SEQ ID NO: 30012 - RNA, 33 nt, Artificial Sequence
  derived and/or modified sequence opt3 from anti-influenza_CDR
ggcgagagcacccuguccuacuaugccgugucu

SEQ ID NO: 30013 - RNA, 33 nt, Artificial Sequence
  derived and/or modified sequence opt3 from anti-influenza_CDR
agagccagccagaacaucuacaaguaucugaau

SEQ ID NO: 30014 - RNA, 33 nt, Artificial Sequence
  derived and/or modified sequence opt3 from anti-influenza_CDR
gccagcugcuccggcggguacuguauccuggac

SEQ ID NO: 30015 - RNA, 33 nt, Artificial Sequence
  derived and/or modified sequence opt3 from anti-influenza_CDR
agaaccagccaguccaucucuucauaccugaac

SEQ ID NO: 30016 - RNA, 33 nt, Artificial Sequence
  derived and/or modified sequence opt3 from anti-influenza_CDR
agagccagccaguccaucggcgcuuacgugaac

SEQ ID NO: 30017 - RNA, 33 nt, Artificial Sequence
  derived and/or modified sequence opt3 from anti-influenza_CDR
agagccagccaguccaucucuaccuaccugaac

SEQ ID NO: 30018 - RNA, 33 nt, Artificial Sequence
  derived and/or modified sequence opt3 from anti-influenza_CDR
agagccagccaguccaucgacaaguuccugaac

SEQ ID NO: 30019 - RNA, 33 nt, Artificial Sequence
  derived and/or modified sequence opt3 from anti-influenza_CDR
ggcgggcacaacaucggaagcaauuccgugcau

SEQ ID NO: 30020 - RNA, 33 nt, Artificial Sequence
  derived and/or modified sequence opt3 from anti-influenza_CDR
agagccagccaguccaucucuaccuaccugcac

SEQ ID NO: 30021 - RNA, 33 nt, Artificial Sequence
  derived and/or modified sequence opt3 from anti-influenza_CDR
cacgugggcgggcauaccuacggaaucgacuau

SEQ ID NO: 30022 - RNA, 33 nt, Artificial Sequence
  derived and/or modified sequence opt3 from anti-influenza_CDR
agagccagccaguccaucucuaacuaccugaau

SEQ ID NO: 30023 - RNA, 33 nt, Artificial Sequence
  derived and/or modified sequence opt3 from anti-influenza_CDR
cacgacgaugccagccauggcuacuccaucucu

SEQ ID NO: 30024 - RNA, 33 nt, Artificial Sequence
  derived and/or modified sequence opt3 from anti-influenza_CDR
agagccagccagaccaucuccacauaccugaac

SEQ ID NO: 30025 - RNA, 33 nt, Artificial Sequence
  derived and/or modified sequence opt3 from anti-influenza_CDR
agagccagccaguccaucucuagguaccugaac

SEQ ID NO: 30026 - RNA, 33 nt, Artificial Sequence
  derived and/or modified sequence opt3 from anti-influenza_CDR
ggcaccugggacagcucccugucugccuacgug

SEQ ID NO: 30027 - RNA, 33 nt, Artificial Sequence
  derived and/or modified sequence opt3 from anti-influenza_CDR
agcuccaacuacuaugacucuguguacgauuau

SEQ ID NO: 30028 - RNA, 33 nt, Artificial Sequence
  derived and/or modified sequence opt3 from anti-influenza_CDR
gccgcuugggacgauauccugaacgugcccguc

SEQ ID NO: 30029 - RNA, 33 nt, Artificial Sequence
  derived and/or modified sequence opt3 from anti-influenza_CDR
guggccugggacgauagcgucgacggcuacguu

SEQ ID NO: 30030 - RNA, 33 nt, Artificial Sequence
  derived and/or modified sequence opt3 from anti-influenza_CDR
ggccccaaguacuauagcgaguacauggacgug

SEQ ID NO: 30031 - RNA, 33 nt, Artificial Sequence
  derived and/or modified sequence opt3 from anti-influenza_CDR
agagccagccagggcaucuccucuuaccuggcu

SEQ ID NO: 30032 - RNA, 33 nt, Artificial Sequence
  derived and/or modified sequence opt3 from anti-influenza_CDR
agcuccggcuacuaucccgaguacuuccaggac

SEQ ID NO: 30033 - RNA, 33 nt, Artificial Sequence
  derived and/or modified sequence opt3 from anti-influenza_CDR
agcggccacaagcugggggacaaauacgugucc

SEQ ID NO: 30034 - RNA, 33 nt, Artificial Sequence
  derived and/or modified sequence opt3 from anti-influenza_CDR
agcaccggcuacuaucccgccuaccugcaccau

SEQ ID NO: 30035 - RNA, 33 nt, Artificial Sequence
  derived and/or modified sequence opt3 from anti-influenza_CDR
agagccagccagaggguguccucuuaccuggcu

SEQ ID NO: 30036 - RNA, 33 nt, Artificial Sequence; identical to SEQ ID NO: 28929
  derived and/or modified sequence opt3 from anti-influenza_CDR

SEQ ID NO: 30037 - RNA, 33 nt, Artificial Sequence
  derived and/or modified sequence opt3 from anti-influenza_CDR
caggugugggacagcuccucugaucacgccguc

SEQ ID NO: 30038 - RNA, 33 nt, Artificial Sequence
  derived and/or modified sequence opt3 from anti-influenza_CDR
gccaccugggacgauaaccugagcggccccgug

SEQ ID NO: 30039 - RNA, 33 nt, Artificial Sequence
  derived and/or modified sequence opt3 from anti-influenza_CDR
agcuccggcuacuaucccgccuaccugccucac

SEQ ID NO: 30040 - RNA, 33 nt, Artificial Sequence
  derived and/or modified sequence opt3 from anti-influenza_CDR
ggcgggaacaauaucggaagcaagggugugcac

SEQ ID NO: 30041 - RNA, 33 nt, Artificial Sequence
  derived and/or modified sequence opt3 from anti-influenza_CDR
caggugugggacagcuccucugaucacgucguu

SEQ ID NO: 30042 - RNA, 33 nt, Artificial Sequence
  derived and/or modified sequence opt3 from anti-influenza_CDR
ggcaacuacuauuacgagagcucccuggacuau

SEQ ID NO: 30043 - RNA, 33 nt, Artificial Sequence
  derived and/or modified sequence opt3 from anti-influenza_CDR
ggcccccacuacuauagcuccuacauggacgug

SEQ ID NO: 30044 - RNA, 33 nt, Artificial Sequence
  derived and/or modified sequence opt3 from anti-influenza_CDR
agagccagccagggcaucuccaccuaccuggcu

SEQ ID NO: 30045 - RNA, 33 nt, Artificial Sequence
  derived and/or modified sequence opt3 from anti-influenza_CDR
ggccccaccuacuauuacagcuauauggacgug

SEQ ID NO: 30046 - RNA, 33 nt, Artificial Sequence
  derived and/or modified sequence opt3 from anti-influenza_CDR
ggcgggaacaauaucggaagaaacagcgugcac

SEQ ID NO: 30047 - RNA, 33 nt, Artificial Sequence
  derived and/or modified sequence opt3 from anti-influenza_CDR
cagguguggcacagcuccucugaccauuacguc

SEQ ID NO: 30048 - RNA, 33 nt, Artificial Sequence
  derived and/or modified sequence opt3 from anti-influenza_CDR
agcuccggcuacuauccccaguacuuccaagac

SEQ ID NO: 30049 - RNA, 33 nt, Artificial Sequence
  derived and/or modified sequence opt3 from anti-influenza_CDR
agagccagccaguccgugucuagguaccuggcu

SEQ ID NO: 30050 - RNA, 33 nt, Artificial Sequence
  derived and/or modified sequence opt3 from anti-influenza_CDR
uggggccaggggaccacacugacugugagcucc

SEQ ID NO: 30051 - RNA, 33 nt, Artificial Sequence
  derived and/or modified sequence opt3 from anti-influenza_CDR
agagccagccaguccguggacucuaaccuggcu

SEQ ID NO: 30052 - RNA, 33 nt, Artificial Sequence
  derived and/or modified sequence opt3 from anti-influenza_CDR
agagccagccaguccgugucucacaaccuggcu

SEQ ID NO: 30053 - RNA, 33 nt, Artificial Sequence
  derived and/or modified sequence opt3 from anti-influenza_CDR
agagccagccaguccgugucuucaaaccuggcu

SEQ ID NO: 30054 - RNA, 33 nt, Artificial Sequence
  derived and/or modified sequence opt3 from anti-influenza_CDR
agagccagccaguccguggaccacaaccuggcu

SEQ ID NO: 30055 - RNA, 33 nt, Artificial Sequence
  derived and/or modified sequence opt3 from anti-influenza_CDR
cagcacuacaccaacuggcccccuagacugaca

SEQ ID NO: 30056 - RNA, 33 nt, Artificial Sequence
  derived and/or modified sequence opt3 from anti-influenza_CDR
cagcacuacaccaacuaucccccuagacugaca

SEQ ID NO: 30057 - RNA, 33 nt, Artificial Sequence
  derived and/or modified sequence opt3 from anti-influenza_CDR
cagcacuacaccaacuucccucccagacugaca

SEQ ID NO: 30058 - RNA, 33 nt, Artificial Sequence
  derived and/or modified sequence opt3 from anti-influenza_CDR
agagccagccaggugaucucccacaaccuggcu

SEQ ID NO: 30059 - RNA, 33 nt, Artificial Sequence
  derived and/or modified sequence opt3 from anti-influenza_CDR
cagcacuacagcaacuggcccccuagacugacc

SEQ ID NO: 30060 - RNA, 33 nt, Artificial Sequence
  derived and/or modified sequence opt3 from anti-influenza_CDR
cagcacuacagcaacuucccucccagacugacc

SEQ ID NO: 30061 - RNA, 33 nt, Artificial Sequence
  derived and/or modified sequence opt3 from anti-influenza_CDR
cagcacuacagcaacuaucccccuagacugacc

SEQ ID NO: 30062 - RNA, 33 nt, Artificial Sequence
  derived and/or modified sequence opt3 from anti-influenza_CDR
agagccagccaguccguggcuaacaaucuggca

SEQ ID NO: 30063 - RNA, 33 nt, Artificial Sequence
  derived and/or modified sequence opt3 from anti-influenza_CDR
cagcaauacaacaauuggcccccuauguauacc

SEQ ID NO: 30064 - RNA, 33 nt, Artificial Sequence
  derived and/or modified sequence opt3 from anti-influenza_CDR
agagccagccaguccaucggcaacuggcuggcu

SEQ ID NO: 30065 - RNA, 33 nt, Artificial Sequence
  derived and/or modified sequence opt3 from anti-influenza_CDR
cagagauacaccagcaacucccaaggcuucaca

SEQ ID NO: 30066 - RNA, 33 nt, Artificial Sequence
  derived and/or modified sequence opt3 from anti-influenza_CDR
gccgcuugggacgauacccugaacggccccgug

SEQ ID NO: 30067 - RNA, 33 nt, Artificial Sequence
  derived and/or modified sequence opt3 from anti-influenza_CDR
aaggccagccagaacgugggcuccaaugucgcu

SEQ ID NO: 30068 - RNA, 33 nt, Artificial Sequence
  derived and/or modified sequence opt3 from anti-influenza_CDR
caggugugggacaugagcuccgauagaaggguc

SEQ ID NO: 30069 - RNA, 33 nt, Artificial Sequence
  derived and/or modified sequence opt3 from anti-influenza_CDR
cagagccugcuccacuccaacggcuacaauuau

SEQ ID NO: 30070 - RNA, 33 nt, Artificial Sequence; identical to SEQ ID NO: 14786
  derived and/or modified sequence opt3 from anti-influenza_CDR

SEQ ID NO: 30071 - RNA, 33 nt, Artificial Sequence; identical to SEQ ID NO: 28982
  derived and/or modified sequence opt3 from anti-influenza_CDR

SEQ ID NO: 30072 - RNA, 33 nt, Artificial Sequence
  derived and/or modified sequence opt3 from anti-influenza_CDR
cagagccugcucgacuccaacggcuacaauuau

SEQ ID NO: 30073 - RNA, 33 nt, Artificial Sequence
  derived and/or modified sequence opt3 from anti-influenza_CDR
augcaggcccugcaaacacccccuauguacacc

SEQ ID NO: 30074 - RNA, 33 nt, Artificial Sequence
  derived and/or modified sequence opt3 from anti-influenza_CDR
cagagccugcuccacuccaacggcuacaaucau

SEQ ID NO: 30075 - RNA, 33 nt, Artificial Sequence
  derived and/or modified sequence opt3 from anti-influenza_CDR
caggugugggacaucaccagcgaucuggucguu

SEQ ID NO: 30076 - RNA, 33 nt, Artificial Sequence
  derived and/or modified sequence opt3 from anti-influenza_CDR
agagccagccaggacaucuccaccuggcuggcu

SEQ ID NO: 30077 - RNA, 33 nt, Artificial Sequence
  derived and/or modified sequence opt3 from anti-influenza_CDR
agagccagcagguccaucaccacauuccuggcu

SEQ ID NO: 30078 - RNA, 33 nt, Artificial Sequence
  derived and/or modified sequence opt3 from anti-influenza_CDR
ggguggggcgccgugaccagccccuucgacuuu

SEQ ID NO: 30079 - RNA, 33 nt, Artificial Sequence
  derived and/or modified sequence opt3 from anti-influenza_CDR
agagccagccaguccgugucuucaaguuaccug

SEQ ID NO: 30080 - RNA, 36 nt, Artificial Sequence
  derived and/or modified sequence opt3 from anti-influenza_CDR
cagagcgugcuguacuccucuaacaauaagaacuau

SEQ ID NO: 30081 - RNA, 36 nt, Artificial Sequence
  derived and/or modified sequence opt3 from anti-influenza_CDR
gccgcuugggacgauagccuguccggcucuugggug

SEQ ID NO: 30082 - RNA, 36 nt, Artificial Sequence
  derived and/or modified sequence opt3 from anti-influenza_CDR
guguucuacagcgccgacagaaccuccuaugcugau

SEQ ID NO: 30083 - RNA, 36 nt, Artificial Sequence
  derived and/or modified sequence opt3 from anti-influenza_CDR
agagugggccagagcgucuccgggucucaccuggcc

SEQ ID NO: 30084 - RNA, 36 nt, Artificial Sequence
  derived and/or modified sequence opt3 from anti-influenza_CDR
acccugagcuccgccuacucuaacuauaagguggac

SEQ ID NO: 30085 - RNA, 36 nt, Artificial Sequence
  derived and/or modified sequence opt3 from anti-influenza_CDR
gugggcaccgggggaaucgucgguagcaagggcgac

SEQ ID NO: 30086 - RNA, 36 nt, Artificial Sequence
  derived and/or modified sequence opt3 from anti-influenza_CDR
agauacagcagguccucucccggcaccuucgaguca

SEQ ID NO: 30087 - RNA, 36 nt, Artificial Sequence
  derived and/or modified sequence opt3 from anti-influenza_CDR
cagagcuacgacuccucucugucaggcuuccacgug

SEQ ID NO: 30088 - RNA, 36 nt, Artificial Sequence
  derived and/or modified sequence opt3 from anti-influenza_CDR
agagccagccaguccgugucuucaagucaacuggcu

SEQ ID NO: 30089 - RNA, 36 nt, Artificial Sequence
  derived and/or modified sequence opt3 from anti-influenza_CDR
agagccagccaguucguguccaccaggucucuggcu

SEQ ID NO: 30090 - RNA, 36 nt, Artificial Sequence
  derived and/or modified sequence opt3 from anti-influenza_CDR
gccaccugggacgauagccugaacggcuucuacgug

SEQ ID NO: 30091 - RNA, 36 nt, Artificial Sequence
  derived and/or modified sequence opt3 from anti-influenza_CDR
agagccagccacuucgugaacuacaggucccuggcu

SEQ ID NO: 30092 - RNA, 36 nt, Artificial Sequence
  derived and/or modified sequence opt3 from anti-influenza_CDR
agagccagccacuucgugaucggcagggcugucgca

SEQ ID NO: 30093 - RNA, 36 nt, Artificial Sequence
  derived and/or modified sequence opt3 from anti-influenza_CDR
agaaucuaccacggcgggaacagcggauucgacuuu

SEQ ID NO: 30094 - RNA, 36 nt, Artificial Sequence; identical to SEQ ID NO: 14810
  derived and/or modified sequence opt3 from anti-influenza_CDR

SEQ ID NO: 30095 - RNA, 36 nt, Artificial Sequence
  derived and/or modified sequence opt3 from anti-influenza_CDR
gugggcaacgggggaaaugucgccagcaagggugac

SEQ ID NO: 30096 - RNA, 36 nt, Artificial Sequence
  derived and/or modified sequence opt3 from anti-influenza_CDR
gugagaggcgggagcaccgucgccuacuucggaguu

SEQ ID NO: 30097 - RNA, 36 nt, Artificial Sequence
  derived and/or modified sequence opt3 from anti-influenza_CDR
ugccugagcagaaugaggggcuacgggcucgacgug

SEQ ID NO: 30098 - RNA, 36 nt, Artificial Sequence
  derived and/or modified sequence opt3 from anti-influenza_CDR
gugggccagauggacaaguacuaugccauggauguc

SEQ ID NO: 30099 - RNA, 36 nt, Artificial Sequence
  derived and/or modified sequence opt3 from anti-influenza_CDR
ggcgugaccaacaaggucaauagcaucauugacaaa

SEQ ID NO: 30100 - RNA, 36 nt, Artificial Sequence
  derived and/or modified sequence opt3 from anti-influenza_CDR
ggcgugaccaacaaggucaauagaaucauugacaaa

SEQ ID NO: 30101 - RNA, 36 nt, Artificial Sequence
  derived and/or modified sequence opt3 from anti-influenza_CDR
ggcgugaccaacaaggagaauagcaucauugacaaa

SEQ ID NO: 30102 - RNA, 36 nt, Artificial Sequence
  derived and/or modified sequence opt3 from anti-influenza_CDR
ccccugggcauccuccacuacuaugccauggaccuu

SEQ ID NO: 30103 - RNA, 36 nt, Artificial Sequence
  derived and/or modified sequence opt3 from anti-influenza_CDR
aagaucaccagcaaagugaacaauauugucgacaag

SEQ ID NO: 30104 - RNA, 36 nt, Artificial Sequence
  derived and/or modified sequence opt3 from anti-influenza_CDR
ggcaucaccaacaaggugaauagcauuauagacaaa

SEQ ID NO: 30105 - RNA, 36 nt, Artificial Sequence
  derived and/or modified sequence opt3 from anti-influenza_CDR
aacggcagaagcuccaccucuugggggaucgacgug

SEQ ID NO: 30106 - RNA, 36 nt, Artificial Sequence
  derived and/or modified sequence opt3 from anti-influenza_CDR
ggcaucaccaacaaggagaauagcgugauugaaaaa

SEQ ID NO: 30107 - RNA, 36 nt, Artificial Sequence
  derived and/or modified sequence opt3 from anti-influenza_CDR
ccccugggcagcagauacuauuacgggauggacgug

SEQ ID NO: 30108 - RNA, 36 nt, Artificial Sequence
  derived and/or modified sequence opt3 from anti-influenza_CDR
ggcaucaccaacaaggugaauagcgucauugagaaa

SEQ ID NO: 30109 - RNA, 36 nt, Artificial Sequence
  derived and/or modified sequence opt3 from anti-influenza_CDR
ggcgugaccaacaaggucaauagcaucauuaacaaa

SEQ ID NO: 30110 - RNA, 36 nt, Artificial Sequence
  derived and/or modified sequence opt3 from anti-influenza_CDR
cacaugggcuaccaggugagagagaccauggacguc

SEQ ID NO: 30111 - RNA, 36 nt, Artificial Sequence
  derived and/or modified sequence opt3 from anti-influenza_CDR
gccaccugggacagaaggcccacagcuuacgugguc

SEQ ID NO: 30112 - RNA, 36 nt, Artificial Sequence
  derived and/or modified sequence opt3 from anti-influenza_CDR
gagggcaagugggggccccaggccgcuuucgacauc

SEQ ID NO: 30113 - RNA, 36 nt, Artificial Sequence
  derived and/or modified sequence opt3 from anti-influenza_CDR
ggcgacaaggggaucuacuauuacuauauggaugug

SEQ ID NO: 30114 - RNA, 36 nt, Artificial Sequence; identical to SEQ ID NO: 14830
  derived and/or modified sequence opt3 from anti-influenza_CDR

SEQ ID NO: 30115 - RNA, 36 nt, Artificial Sequence
  derived and/or modified sequence opt3 from anti-influenza_CDR
agagccagccaguccgugucuucaaguuaccuggcu

SEQ ID NO: 30116 - RNA, 36 nt, Artificial Sequence
  derived and/or modified sequence opt3 from anti-influenza_CDR
ggcagcggguacaccacaagaaacuauuucgacuac

SEQ ID NO: 30117 - RNA, 36 nt, Artificial Sequence
  derived and/or modified sequence opt3 from anti-influenza_CDR
agagccagccaguccgugucuucaaacuaccugggc

SEQ ID NO: 30118 - RNA, 36 nt, Artificial Sequence
  derived and/or modified sequence opt3 from anti-influenza_CDR
ggcagcaccuacgacuucuccucugggcuggauuau

SEQ ID NO: 30119 - RNA, 36 nt, Artificial Sequence
  derived and/or modified sequence opt3 from anti-influenza_CDR
ggcgugcaccaucccgggaccgacaacgaucagauc

SEQ ID NO: 30120 - RNA, 36 nt, Artificial Sequence
  derived and/or modified sequence opt3 from anti-influenza_CDR
ggcgugcaccaucccagcaccgacuccgaucagaca

SEQ ID NO: 30121 - RNA, 36 nt, Artificial Sequence
  derived and/or modified sequence opt3 from anti-influenza_CDR
ggcgugcaccaucccagcaacgagaccgaacagaga

SEQ ID NO: 30122 - RNA, 36 nt, Artificial Sequence
  derived and/or modified sequence opt3 from anti-influenza_CDR
cagagcaucaccuucgacuacaagaacuaucuggcc

SEQ ID NO: 30123 - RNA, 36 nt, Artificial Sequence
  derived and/or modified sequence opt3 from anti-influenza_CDR
ggcgggcugaucggaaccgguagcuacuauuggggc

SEQ ID NO: 30124 - RNA, 36 nt, Artificial Sequence
  derived and/or modified sequence opt3 from anti-influenza_CDR
gccagauacaacuggggcaucagguauuucgacuuu

SEQ ID NO: 30125 - RNA, 36 nt, Artificial Sequence
  derived and/or modified sequence opt3 from anti-influenza_CDR
cagagcgugcuguccaacucuaagaaucucaacuac

SEQ ID NO: 30126 - RNA, 36 nt, Artificial Sequence
  derived and/or modified sequence opt3 from anti-influenza_CDR
ugccaggugugggagaccagcgaagaccuguggguc

SEQ ID NO: 30127 - RNA, 39 nt, Artificial Sequence
  derived and/or modified sequence opt3 from anti-influenza_CDR
gccagaggcgggagguacuauguggacuacuucgauuau

SEQ ID NO: 30128 - RNA, 39 nt, Artificial Sequence
  derived and/or modified sequence opt3 from anti-influenza_CDR
gccagaagcggcgacggguacaacuauuacuucccccug

SEQ ID NO: 30129 - RNA, 39 nt, Artificial Sequence
  derived and/or modified sequence opt3 from anti-influenza_CDR
gccagaggcugcggguacaacuguuauuacuucgacgga

SEQ ID NO: 30130 - RNA, 39 nt, Artificial Sequence
  derived and/or modified sequence opt3 from anti-influenza_CDR
agcggcuccucuucaaacaucgggaguaauaccgugaac

SEQ ID NO: 30131 - RNA, 39 nt, Artificial Sequence
  derived and/or modified sequence opt3 from anti-influenza_CDR
gacagccccuacuccucuucauggaguuucuuugauuau

SEQ ID NO: 30132 - RNA, 39 nt, Artificial Sequence
  derived and/or modified sequence opt3 from anti-influenza_CDR
agcggcuccgacucuaacaucggggauuacuucgugugc

SEQ ID NO: 30133 - RNA, 39 nt, Artificial Sequence
  derived and/or modified sequence opt3 from anti-influenza_CDR
gccagaaugguggucguuaccggcgacggguucgaugug

SEQ ID NO: 30134 - RNA, 39 nt, Artificial Sequence
  derived and/or modified sequence opt3 from anti-influenza_CDR
uggcugagcaucauuaacgccggcgggggagacauagau

SEQ ID NO: 30135 - RNA, 39 nt, Artificial Sequence
  derived and/or modified sequence opt3 from anti-influenza_CDR
gccgcuagcucccugcagucuggcgugcccucaagauuc

SEQ ID NO: 30136 - RNA, 39 nt, Artificial Sequence
  derived and/or modified sequence opt3 from anti-influenza_CDR
cacgacgccaaguucagcggcuccuacuauguggcuucu

SEQ ID NO: 30137 - RNA, 39 nt, Artificial Sequence
  derived and/or modified sequence opt3 from anti-influenza_CDR
cacgacgugaaguucagcggcuccuacuaugucgccucu

SEQ ID NO: 30138 - RNA, 39 nt, Artificial Sequence
  derived and/or modified sequence opt3 from anti-influenza_CDR
accggcagcgaguccacaacuggguacggaauggacgug

SEQ ID NO: 30139 - RNA, 39 nt, Artificial Sequence
  derived and/or modified sequence opt3 from anti-influenza_CDR
gccgcuagcaccuccgugcugggcuacgggauggacguc

SEQ ID NO: 30140 - RNA, 39 nt, Artificial Sequence
  derived and/or modified sequence opt3 from anti-influenza_CDR
agcggcuccaccuucaacaucgggucuaaugccguggac

SEQ ID NO: 30141 - RNA, 39 nt, Artificial Sequence
  derived and/or modified sequence opt3 from anti-influenza_CDR
agcggcuccagaucuaacgugggggacaauucagucuac

SEQ ID NO: 30142 - RNA, 39 nt, Artificial Sequence
  derived and/or modified sequence opt3 from anti-influenza_CDR
agcggcuccucuucaaacaucgggaaugacuacgugagu

SEQ ID NO: 30143 - RNA, 39 nt, Artificial Sequence
  derived and/or modified sequence opt3 from anti-influenza_CDR
ggcgggggaagcuacggugccuaugagggcuucgacuac

SEQ ID NO: 30144 - RNA, 39 nt, Artificial Sequence
  derived and/or modified sequence opt3 from anti-influenza_CDR
agcggcuccucuucaaacaucgggaguaauuacguguau

SEQ ID NO: 30145 - RNA, 39 nt, Artificial Sequence
  derived and/or modified sequence opt3 from anti-influenza_CDR
gccagaaggcagcaacuguacaagggcuauuaccaccau

SEQ ID NO: 30146 - RNA, 39 nt, Artificial Sequence
  derived and/or modified sequence opt3 from anti-influenza_CDR
agcggcuccaccucuaacaucggguacaaucccguguca

SEQ ID NO: 30147 - RNA, 39 nt, Artificial Sequence
  derived and/or modified sequence opt3 from anti-influenza_CDR
gccagaggcaugaacuacuauagcgacuacuucgauuau

SEQ ID NO: 30148 - RNA, 39 nt, Artificial Sequence
  derived and/or modified sequence opt3 from anti-influenza_CDR
gccagaggccacagcggguccuacaggcuguucgacuuu

SEQ ID NO: 30149 - RNA, 39 nt, Artificial Sequence
  derived and/or modified sequence opt3 from anti-influenza_CDR
gccaagccccugagaggcagcuacagguauuucgaccuc

SEQ ID NO: 30150 - RNA, 39 nt, Artificial Sequence
  derived and/or modified sequence opt3 from anti-influenza_CDR
cccaucugggugaagaccccucugaaacucgccaacggc

SEQ ID NO: 30151 - RNA, 39 nt, Artificial Sequence
  derived and/or modified sequence opt3 from anti-influenza_CDR
caggccagccaauccguguacaacaagaauaaccuggcu

SEQ ID NO: 30152 - RNA, 39 nt, Artificial Sequence
  derived and/or modified sequence opt3 from anti-influenza_CDR
cagagcuccgagucuguguacaagaacaauaaccuggcc

SEQ ID NO: 30153 - RNA, 39 nt, Artificial Sequence
  derived and/or modified sequence opt3 from anti-influenza_CDR
cagagcucccaaucuguggacucaaacaaucagcugagu

SEQ ID NO: 30154 - RNA, 39 nt, Artificial Sequence
  derived and/or modified sequence opt3 from anti-influenza_CDR
cagagcucccaaucuguggacaacaauaaggaucuggcc

SEQ ID NO: 30155 - RNA, 39 nt, Artificial Sequence
  derived and/or modified sequence opt3 from anti-influenza_CDR
cagagcucccaaucuguguacaacaauaacagacuguca

SEQ ID NO: 30156 - RNA, 39 nt, Artificial Sequence
  derived and/or modified sequence opt3 from anti-influenza_CDR
cagagcucccaaucuguguacaagaacaauaaccuggcc

SEQ ID NO: 30157 - RNA, 39 nt, Artificial Sequence
  derived and/or modified sequence opt3 from anti-influenza_CDR
ggcgggggauucgguuggagccagaccuacuuuggcuau

SEQ ID NO: 30158 - RNA, 42 nt, Artificial Sequence
  derived and/or modified sequence opt3 from anti-influenza_CDR
uggcugggcagaaccuacuauaggagcaagugguacaacgac

SEQ ID NO: 30159 - RNA, 42 nt, Artificial Sequence
  derived and/or modified sequence opt3 from anti-influenza_CDR
ggcgggcuggugggagguuacgacgaguauuucuuugauuac

SEQ ID NO: 30160 - RNA, 42 nt, Artificial Sequence
  derived and/or modified sequence opt3 from anti-influenza_CDR
caccccaaguacuucuauggcagcggguccuacccugacuuu

SEQ ID NO: 30161 - RNA, 42 nt, Artificial Sequence
  derived and/or modified sequence opt3 from anti-influenza_CDR
accggcagcuccucugacgugggggccucaaacagugucagc

SEQ ID NO: 30162 - RNA, 42 nt, Artificial Sequence
  derived and/or modified sequence opt3 from anti-influenza_CDR
ggcgccuacuaugacagcuccggguaccccgcuuucuauauc

SEQ ID NO: 30163 - RNA, 42 nt, Artificial Sequence
  derived and/or modified sequence opt3 from anti-influenza_CDR
accggcagcuccucuaacaucgggucagacuacgaugugcac

SEQ ID NO: 30164 - RNA, 42 nt, Artificial Sequence
  derived and/or modified sequence opt3 from anti-influenza_CDR
gaguucgaaaccagcggcuacuuucacggguccuucgacuau

SEQ ID NO: 30165 - RNA, 42 nt, Artificial Sequence
  derived and/or modified sequence opt3 from anti-influenza_CDR
gccagcuccaccggcgcugugacaucuucauacuuccccaac

SEQ ID NO: 30166 - RNA, 42 nt, Artificial Sequence
  derived and/or modified sequence opt3 from anti-influenza_CDR
accggcgggagcuccgacaucggagccucuaacucagugagu

SEQ ID NO: 30167 - RNA, 42 nt, Artificial Sequence
  derived and/or modified sequence opt3 from anti-influenza_CDR
accggcagcuccucugacgucgggggauacgauuauguguca

SEQ ID NO: 30168 - RNA, 42 nt, Artificial Sequence
  derived and/or modified sequence opt3 from anti-influenza_CDR
ggcagcuccaccggggccgugacaagaggacacuaccccuau

SEQ ID NO: 30169 - RNA, 42 nt, Artificial Sequence
  derived and/or modified sequence opt3 from anti-influenza_CDR
ggcagcuccaccgggcccgugacaucuggacacuacccuuau

SEQ ID NO: 30170 - RNA, 42 nt, Artificial Sequence
  derived and/or modified sequence opt3 from anti-influenza_CDR
cacuacggcgacagcgaggccaucaacgaugcuuucgacauu

SEQ ID NO: 30171 - RNA, 42 nt, Artificial Sequence
  derived and/or modified sequence opt3 from anti-influenza_CDR
accggcagcuccucuaacaucggggccggauacgacgugcac

SEQ ID NO: 30172 - RNA, 42 nt, Artificial Sequence
  derived and/or modified sequence opt3 from anti-influenza_CDR
aucccccacuacaacuucggcagcggguccuauuuugacuac

SEQ ID NO: 30173 - RNA, 42 nt, Artificial Sequence
  derived and/or modified sequence opt3 from anti-influenza_CDR
accggcacaagcuccgacgucgggggauacaacuaugugucu

SEQ ID NO: 30174 - RNA, 42 nt, Artificial Sequence
  derived and/or modified sequence opt3 from anti-influenza_CDR
accggcacaagcuccgacgugggggccuacaacuaugucucu

SEQ ID NO: 30175 - RNA, 42 nt, Artificial Sequence
  derived and/or modified sequence opt3 from anti-influenza_CDR
gccgagagacccaaggugaggggccaggcugggcggaugaac

SEQ ID NO: 30176 - RNA, 42 nt, Artificial Sequence
  derived and/or modified sequence opt3 from anti-influenza_CDR
gggagcagacccugggugaggggcgucuccucucggaucuca

SEQ ID NO: 30177 - RNA, 42 nt, Artificial Sequence
  derived and/or modified sequence opt3 from anti-influenza_CDR
aucuggggcguggccgcucccgggaccgcagccgcgcagauu

SEQ ID NO: 30178 - RNA, 42 nt, Artificial Sequence
  derived and/or modified sequence opt3 from anti-influenza_CDR
ugggugagacagcccccuggcaaggggcuggagugggucgcc

SEQ ID NO: 30179 - RNA, 42 nt, Artificial Sequence
  derived and/or modified sequence opt3 from anti-influenza_CDR
gccagaggccccgaggggguguggggaaggagcaucgacucc

SEQ ID NO: 30180 - RNA, 42 nt, Artificial Sequence
  derived and/or modified sequence opt3 from anti-influenza_CDR
gccagagaccccgauaccccuuucgugagggcuuuugacagc

SEQ ID NO: 30181 - RNA, 42 nt, Artificial Sequence
  derived and/or modified sequence opt3 from anti-influenza_CDR
accggcagcacauccgacaucgggucuuacaacuauguguca

SEQ ID NO: 30182 - RNA, 42 nt, Artificial Sequence
  derived and/or modified sequence opt3 from anti-influenza_CDR
ugggacuggaacuucgaucuguaccucggcugguuugacccc

SEQ ID NO: 30183 - RNA, 42 nt, Artificial Sequence
  derived and/or modified sequence opt3 from anti-influenza_CDR
ugggccuggaacuucgacuuuuuccugggcugguuugauccc

SEQ ID NO: 30184 - RNA, 42 nt, Artificial Sequence
  derived and/or modified sequence opt3 from anti-influenza_CDR
ggccccggguacagcggauaucacuacgguugguucgacacc

SEQ ID NO: 30185 - RNA, 42 nt, Artificial Sequence
  derived and/or modified sequence opt3 from anti-influenza_CDR
gccagaugggacuacggcguguaugagggguacaucgauuau

SEQ ID NO: 30186 - RNA, 45 nt, Artificial Sequence
  derived and/or modified sequence opt3 from anti-influenza_CDR
gccagagcuggcaccacacugacuagguucaacugguuugacccc

SEQ ID NO: 30187 - RNA, 45 nt, Artificial Sequence
  derived and/or modified sequence opt3 from anti-influenza_CDR
gccagagcuggcaccacagugacuagguucaacugguuugacccc

SEQ ID NO: 30188 - RNA, 45 nt, Artificial Sequence
  derived and/or modified sequence opt3 from anti-influenza_CDR
gccagaggccagagguacuauuacgaccgggaugggauggacgug

SEQ ID NO: 30189 - RNA, 45 nt, Artificial Sequence
  derived and/or modified sequence opt3 from anti-influenza_CDR
gccagaagcggcggguaccugccccagaacaauuggaucgacccu

SEQ ID NO: 30190 - RNA, 45 nt, Artificial Sequence
  derived and/or modified sequence opt3 from anti-influenza_CDR
auggagaacgaaagaacccuggacuuccacgauagcaaugugaag

SEQ ID NO: 30191 - RNA, 45 nt, Artificial Sequence
  derived and/or modified sequence opt3 from anti-influenza_CDR
ggcgccgaccacgggagcggauccaacuucgugucucccuacguc

SEQ ID NO: 30192 - RNA, 45 nt, Artificial Sequence
  derived and/or modified sequence opt3 from anti-influenza_CDR
gacaccagaagcucccuggauaacuaccaguauggcauggacgug

SEQ ID NO: 30193 - RNA, 45 nt, Artificial Sequence
  derived and/or modified sequence opt3 from anti-influenza_CDR
gaggacuacgauauccugaccggcgccgggcccggaauggaagug

SEQ ID NO: 30194 - RNA, 45 nt, Artificial Sequence
  derived and/or modified sequence opt3 from anti-influenza_CDR
caccccuacgacgugcugaccggcagcggggauugguucgacccu

SEQ ID NO: 30195 - RNA, 45 nt, Artificial Sequence
  derived and/or modified sequence opt3 from anti-influenza_CDR
ggcgccgaccacgggagcggaaacaauuucgugucccccuacguc

SEQ ID NO: 30196 - RNA, 45 nt, Artificial Sequence
  derived and/or modified sequence opt3 from anti-influenza_CDR
gugaucuacagcggcggguccaccuauuacgccgacucugucaag

SEQ ID NO: 30197 - RNA, 45 nt, Artificial Sequence
  derived and/or modified sequence opt3 from anti-influenza_CDR
ugguaccagcaaaagcccggcaaagccccuaagcugcucaucuau

SEQ ID NO: 30198 - RNA, 45 nt, Artificial Sequence
  derived and/or modified sequence opt3 from anti-influenza_CDR
gaccccuacaacgauggcaccaaguauaaugagaaauucgaaggg

SEQ ID NO: 30199 - RNA, 45 nt, Artificial Sequence
  derived and/or modified sequence opt3 from anti-influenza_CDR
gccagagcucacaccgcacugacaagguuccgguggcucgacccc

SEQ ID NO: 30200 - RNA, 45 nt, Artificial Sequence
  derived and/or modified sequence opt3 from anti-influenza_CDR
gccagccuggacuacgauuucuccuauuacuaucacagagacgug

SEQ ID NO: 30201 - RNA, 45 nt, Artificial Sequence
  derived and/or modified sequence opt3 from anti-influenza_CDR
gccagaguggcuacccccuacuauuacgagagcggcuucgacuau

SEQ ID NO: 30202 - RNA, 45 nt, Artificial Sequence
  derived and/or modified sequence opt3 from anti-influenza_CDR
gccagaaggggcgggggauggcaguacuauuacgguauggacgug

SEQ ID NO: 30203 - RNA, 48 nt, Artificial Sequence
  derived and/or modified sequence opt3 from anti-influenza_CDR
agcggccacaucaccguguucggggucaacguugacgccuuugauaug

SEQ ID NO: 30204 - RNA, 48 nt, Artificial Sequence
  derived and/or modified sequence opt3 from anti-influenza_CDR
ggcgggcacaucaccguguucggacugaacauugacgccuacgauaua

SEQ ID NO: 30205 - RNA, 48 nt, Artificial Sequence
  derived and/or modified sequence opt3 from anti-influenza_CDR
ggcgggcacaucaccgaguucggacugaacauugacgccuacgauaua

SEQ ID NO: 30206 - RNA, 48 nt, Artificial Sequence
  derived and/or modified sequence opt3 from anti-influenza_CDR
ggcgggcacaucaccguguucggagucaacauugacgccuuugauaua

SEQ ID NO: 30207 - RNA, 48 nt, Artificial Sequence
  derived and/or modified sequence opt3 from anti-influenza_CDR
ggcgggcacaucaccguguucggagucaacauugacgccuuugauguu

SEQ ID NO: 30208 - RNA, 48 nt, Artificial Sequence
  derived and/or modified sequence opt3 from anti-influenza_CDR
gccagagacggcugggggcagcaacuggugcccuacuauuucgauuac

SEQ ID NO: 30209 - RNA, 48 nt, Artificial Sequence
  derived and/or modified sequence opt3 from anti-influenza_CDR
gacuucugggugagcuacuauuacgauuccucugcucccccugccauc

SEQ ID NO: 30210 - RNA, 48 nt, Artificial Sequence
  derived and/or modified sequence opt3 from anti-influenza_CDR
gccagagcuggcgugaagaucuucgggcugauugucggagcacucgac

SEQ ID NO: 30211 - RNA, 48 nt, Artificial Sequence
  derived and/or modified sequence opt3 from anti-influenza_CDR
gccagagacggcgcugggagcuacuauccccugaacugguucgauccu

SEQ ID NO: 30212 - RNA, 48 nt, Artificial Sequence
  derived and/or modified sequence opt3 from anti-influenza_CDR
gugaucuacagccacggcagagccuauuacuccgcuucugucaacggg

SEQ ID NO: 30213 - RNA, 48 nt, Artificial Sequence
  derived and/or modified sequence opt3 from anti-influenza_CDR
gacacccugcacaacggcuacacaaauuauaaccccagccucagaggg

SEQ ID NO: 30214 - RNA, 48 nt, Artificial Sequence
  derived and/or modified sequence opt3 from anti-influenza_CDR
uacaucagcuauaacggcagacccaaguacaauccuucccugaccucu

SEQ ID NO: 30215 - RNA, 48 nt, Artificial Sequence
  derived and/or modified sequence opt3 from anti-influenza_CDR
gagaccagauucggcgaacugcucagccccuacgacgccuuugagauc

SEQ ID NO: 30216 - RNA, 48 nt, Artificial Sequence
  derived and/or modified sequence opt3 from anti-influenza_CDR
cugaucuacugggacgaugacaagagauauagccccucccucaaaagg

SEQ ID NO: 30217 - RNA, 48 nt, Artificial Sequence
  derived and/or modified sequence opt3 from anti-influenza_CDR
uacaucuauuacauuggcaacaccgacuauagacccagccugaagucc

SEQ ID NO: 30218 - RNA, 48 nt, Artificial Sequence
  derived and/or modified sequence opt3 from anti-influenza_CDR
gagaucagccacggcggguccaccaacuacaaucccucucugaaguca

SEQ ID NO: 30219 - RNA, 48 nt, Artificial Sequence
  derived and/or modified sequence opt3 from anti-influenza_CDR
gagaucaaccacagcggcagaaccaauuacaaccccucccugaagucu

SEQ ID NO: 30220 - RNA, 48 nt, Artificial Sequence
  derived and/or modified sequence opt3 from anti-influenza_CDR
cugaucagcugggacgaugagaagcacuacucccccucucuccaguca

SEQ ID NO: 30221 - RNA, 48 nt, Artificial Sequence
  derived and/or modified sequence opt3 from anti-influenza_CDR
gagggcguguacuucgacagcgggaccuauagaggauacuuugauuau

SEQ ID NO: 30222 - RNA, 48 nt, Artificial Sequence
  derived and/or modified sequence opt3 from anti-influenza_CDR
uacaucuaucacagcggcuccaccaacuacaaucccucucugaaguca

SEQ ID NO: 30223 - RNA, 48 nt, Artificial Sequence
  derived and/or modified sequence opt3 from anti-influenza_CDR
uacaucuauuacagaggcagcaccuucuauaaccccucccugaagucu

SEQ ID NO: 30224 - RNA, 48 nt, Artificial Sequence
  derived and/or modified sequence opt3 from anti-influenza_CDR
uacaucagcuauuccggcucuaccaaguacaaccccucacugagaagu

SEQ ID NO: 30225 - RNA, 48 nt, Artificial Sequence
  derived and/or modified sequence opt3 from anti-influenza_CDR
gagaucaagcacagcggcagaaccaacuacaaucccucccuggaaucu

SEQ ID NO: 30226 - RNA, 48 nt, Artificial Sequence
  derived and/or modified sequence opt3 from anti-influenza_CDR
gagaucaaccacagcggcgggaccaauuacaaccccucccugaagaga

SEQ ID NO: 30227 - RNA, 48 nt, Artificial Sequence
  derived and/or modified sequence opt3 from anti-influenza_CDR
uucauguacuauagcgccuccaccuacuauaaccccucucugaaguca

SEQ ID NO: 30228 - RNA, 48 nt, Artificial Sequence
  derived and/or modified sequence opt3 from anti-influenza_CDR
uacguguauuacagcggcuccaccacauauaaccccucucugaaguca

SEQ ID NO: 30229 - RNA, 48 nt, Artificial Sequence
  derived and/or modified sequence opt3 from anti-influenza_CDR
aacaucuacuauaccggcauuacauucuacaaucccagccuguccucu

SEQ ID NO: 30230 - RNA, 48 nt, Artificial Sequence
  derived and/or modified sequence opt3 from anti-influenza_CDR
uucaucuacuauggcgggaacaccaaguacaaucccagccugaaaucc

SEQ ID NO: 30231 - RNA, 48 nt, Artificial Sequence
  derived and/or modified sequence opt3 from anti-influenza_CDR
uucauguuucacagcggcucccccagauacaacccuacccugaagucu

SEQ ID NO: 30232 - RNA, 48 nt, Artificial Sequence
  derived and/or modified sequence opt3 from anti-influenza_CDR
uucuuuuacaacggcgggagcaccaaguauaaucccucccugaaaucu

SEQ ID NO: 30233 - RNA, 48 nt, Artificial Sequence
  derived and/or modified sequence opt3 from anti-influenza_CDR
cacaucuacgacuauggcagaaccuucuacaacagcucccugcagucu

SEQ ID NO: 30234 - RNA, 48 nt, Artificial Sequence
  derived and/or modified sequence opt3 from anti-influenza_CDR
guguucuacagcgagaccagaacauauuacgccgacuccgucaagggc

SEQ ID NO: 30235 - RNA, 48 nt, Artificial Sequence
  derived and/or modified sequence opt3 from anti-influenza_CDR
uacguguauaacagaggcagcaccaaguacucccccucucugaaauca

SEQ ID NO: 30236 - RNA, 48 nt, Artificial Sequence
  derived and/or modified sequence opt3 from anti-influenza_CDR
uacaucuauaacagaggcagcaccaaguacacacccucccugaaaucu

SEQ ID NO: 30237 - RNA, 48 nt, Artificial Sequence
  derived and/or modified sequence opt3 from anti-influenza_CDR
uaccuguauuacagcggcuccaccaaguauaaccccucucucaaauca

SEQ ID NO: 30238 - RNA, 48 nt, Artificial Sequence
  derived and/or modified sequence opt3 from anti-influenza_CDR
uacguguauaacagcggcaauaccaaguacaaccccucccugaaaucu

SEQ ID NO: 30239 - RNA, 48 nt, Artificial Sequence
  derived and/or modified sequence opt3 from anti-influenza_CDR
cacaucuucgacagcggcuccaccuacuauaaccccucucugaaguca

SEQ ID NO: 30240 - RNA, 48 nt, Artificial Sequence
  derived and/or modified sequence opt3 from anti-influenza_CDR
guguucuacagcgccgacagaaccuccuaugcugauucugucaagggc

SEQ ID NO: 30241 - RNA, 48 nt, Artificial Sequence
  derived and/or modified sequence opt3 from anti-influenza_CDR
uacaucuauuacagcggcaacaccuauuacaaucccucccugaagucu

SEQ ID NO: 30242 - RNA, 48 nt, Artificial Sequence
  derived and/or modified sequence opt3 from anti-influenza_CDR
agaagcucccagucucugcuccacucaaacggcuacaauuaucuugac

SEQ ID NO: 30243 - RNA, 48 nt, Artificial Sequence
  derived and/or modified sequence opt3 from anti-influenza_CDR
accaucuaccacagcggcuccacauauuacaaccccucucugaaguca

SEQ ID NO: 30244 - RNA, 48 nt, Artificial Sequence
  derived and/or modified sequence opt3 from anti-influenza_CDR
agaagcucccagucucugcuccacucaaacggccauaucuacuucgac

SEQ ID NO: 30245 - RNA, 48 nt, Artificial Sequence
  derived and/or modified sequence opt3 from anti-influenza_CDR
aucuggggcguggccgcucccagcaccgcauccgcccagacaucucug

SEQ ID NO: 30246 - RNA, 48 nt, Artificial Sequence
  derived and/or modified sequence opt3 from anti-influenza_CDR
agaagcucccagucucugcucuacaccgacggcuucacauaucuuuca

SEQ ID NO: 30247 - RNA, 48 nt, Artificial Sequence
  derived and/or modified sequence opt3 from anti-influenza_CDR
gccaagcccagacuggacuaccucgauuauuuccacgcugcagacagc

SEQ ID NO: 30248 - RNA, 48 nt, Artificial Sequence
  derived and/or modified sequence opt3 from anti-influenza_CDR
gccagaagccccggcuacuccggguaucuguacggaugguucgacccu

SEQ ID NO: 30249 - RNA, 48 nt, Artificial Sequence
  derived and/or modified sequence opt3 from anti-influenza_CDR
gccaucgcuggcagcggguccgcagacuacgccucuugggcgaaggga

SEQ ID NO: 30250 - RNA, 48 nt, Artificial Sequence
  derived and/or modified sequence opt3 from anti-influenza_CDR
gccaucgcuggcagcggguccgcagacuacgccucuugggcgaaguca

SEQ ID NO: 30251 - RNA, 48 nt, Artificial Sequence
  derived and/or modified sequence opt3 from anti-influenza_CDR
gccaucggcgggggagguagcgcugacuacgcauccugggccaagucu

SEQ ID NO: 30252 - RNA, 48 nt, Artificial Sequence
  derived and/or modified sequence opt3 from anti-influenza_CDR
agaagcucccagucucugcucaggucaaacggcuacaauuaucuugac

SEQ ID NO: 30253 - RNA, 48 nt, Artificial Sequence
  derived and/or modified sequence opt3 from anti-influenza_CDR
cagggcgaccacaucgccuggcugcucagagggauuaacuucgauuac

SEQ ID NO: 30254 - RNA, 51 nt, Artificial Sequence
  derived and/or modified sequence opt3 from anti-influenza_CDR
gccagacugggcagcggguccuaccacaacggacccaauugguucgacccu

SEQ ID NO: 30255 - RNA, 51 nt, Artificial Sequence
  derived and/or modified sequence opt3 from anti-influenza_CDR
gccagagcugagaaccugcucagccccuaccuugcagaaggcuucgacccu

SEQ ID NO: 30256 - RNA, 51 nt, Artificial Sequence
  derived and/or modified sequence opt3 from anti-influenza_CDR
gugaucagcuacgacggcuccaacaaguauuacgccgauucugucaaaggg

SEQ ID NO: 30257 - RNA, 51 nt, Artificial Sequence
  derived and/or modified sequence opt3 from anti-influenza_CDR
ggcaccaucccccugcucgggacaacuaacuacgcccagaaguuccaagga

SEQ ID NO: 30258 - RNA, 51 nt, Artificial Sequence
  derived and/or modified sequence opt3 from anti-influenza_CDR
ggcaucauugccguguucaacaccgcuaauuacgcacagaaguuucaaggg

SEQ ID NO: 30259 - RNA, 51 nt, Artificial Sequence
  derived and/or modified sequence opt3 from anti-influenza_CDR
aacaucgaggacgauggcggggacaaguacuauguggauagcgucaaagga

SEQ ID NO: 30260 - RNA, 51 nt, Artificial Sequence
  derived and/or modified sequence opt3 from anti-influenza_CDR
uggaucaaccccaauagcggcaccacaggguccgcccagagauuccaagga

SEQ ID NO: 30261 - RNA, 51 nt, Artificial Sequence
  derived and/or modified sequence opt3 from anti-influenza_CDR
ggcaucaaccccguguucgggagaccucacuacgcccagaaguuucaagga

SEQ ID NO: 30262 - RNA, 51 nt, Artificial Sequence
  derived and/or modified sequence opt3 from anti-influenza_CDR
ggcaucauuccccugauaaacgccccuaauuacgcuccaaaguuccagggg

SEQ ID NO: 30263 - RNA, 51 nt, Artificial Sequence
  derived and/or modified sequence opt3 from anti-influenza_CDR
ggcaucauucccaugauggggaccgugaacuacgcccagaagcugcaagga

SEQ ID NO: 30264 - RNA, 51 nt, Artificial Sequence
  derived and/or modified sequence opt3 from anti-influenza_CDR
ggcaucauuccccuguucggggccgcuaaguacgcacagaaauuucaagga

SEQ ID NO: 30265 - RNA, 51 nt, Artificial Sequence
  derived and/or modified sequence opt3 from anti-influenza_CDR
aagagcucccagagagugcuguacucuucaaacaauaaaaacuaucucgcc

SEQ ID NO: 30266 - RNA, 51 nt, Artificial Sequence
  derived and/or modified sequence opt3 from anti-influenza_CDR
cugaucagcgacgauggcuccaacaaguucuacgccgacucugugaaaggg

SEQ ID NO: 30267 - RNA, 51 nt, Artificial Sequence
  derived and/or modified sequence opt3 from anti-influenza_CDR
aucauuagcuacgacggcaacgaucaguauuacaccgacuccgugaagggg

SEQ ID NO: 30268 - RNA, 51 nt, Artificial Sequence
  derived and/or modified sequence opt3 from anti-influenza_CDR
uggaucagcaccuacaacggcaauacaaacuucgcccagaauuuucaaggg

SEQ ID NO: 30269 - RNA, 51 nt, Artificial Sequence
  derived and/or modified sequence opt3 from anti-influenza_CDR
guggagggcagcuacagagacuucuggaacaaucagaacagguuugauccc

SEQ ID NO: 30270 - RNA, 51 nt, Artificial Sequence
  derived and/or modified sequence opt3 from anti-influenza_CDR
uggaucaaccccaauagcggcgacaccaacuacgcccagaaguuccaaggg

SEQ ID NO: 30271 - RNA, 51 nt, Artificial Sequence
  derived and/or modified sequence opt3 from anti-influenza_CDR
aagagcucccagucugugcuguacucaaguaacaauaaaagccaccucgcc

SEQ ID NO: 30272 - RNA, 51 nt, Artificial Sequence
  derived and/or modified sequence opt3 from anti-influenza_CDR
aucauuuaccccggcgacagcgauaccagauauuccccuucuuuccagggg

SEQ ID NO: 30273 - RNA, 51 nt, Artificial Sequence
  derived and/or modified sequence opt3 from anti-influenza_CDR
ggcaucauucccguguucccuaccccaaacuacgcccagauguuucaaggg

SEQ ID NO: 30274 - RNA, 51 nt, Artificial Sequence
  derived and/or modified sequence opt3 from anti-influenza_CDR
ggcaucgugcccgucuucgggaccgccaacuacgcucagaaguuucaagga

SEQ ID NO: 30275 - RNA, 51 nt, Artificial Sequence
  derived and/or modified sequence opt3 from anti-influenza_CDR
uggaucaaccccgagagcggcgacaccaaguacgcccagaaauuccaaggg

SEQ ID NO: 30276 - RNA, 51 nt, Artificial Sequence
  derived and/or modified sequence opt3 from anti-influenza_CDR
agaagcucccagucuaucuuccacaacucaaauaacgagaauuaccuggcc

SEQ ID NO: 30277 - RNA, 51 nt, Artificial Sequence
  derived and/or modified sequence opt3 from anti-influenza_CDR
uggaucaacgccaagagaggcgggaccaauuacgcucagaaauuccaagga

SEQ ID NO: 30278 - RNA, 51 nt, Artificial Sequence
  derived and/or modified sequence opt3 from anti-influenza_CDR
uggaucaaccccgacagcggcgccaccuccucugcucagaauuuccaaggg

SEQ ID NO: 30279 - RNA, 51 nt, Artificial Sequence
  derived and/or modified sequence opt3 from anti-influenza_CDR
uggaucagccccgacuccgaugccaccaaguacgcucagaaauuccaaggc

SEQ ID NO: 30280 - RNA, 51 nt, Artificial Sequence
  derived and/or modified sequence opt3 from anti-influenza_CDR
aacaucaagcaggacggcagagagaaauacuauguggauagccugaggggg

SEQ ID NO: 30281 - RNA, 51 nt, Artificial Sequence
  derived and/or modified sequence opt3 from anti-influenza_CDR
ggcaucauugccauauucgggacccccaaguacgcucagaaauuucaagga

SEQ ID NO: 30282 - RNA, 51 nt, Artificial Sequence
  derived and/or modified sequence opt3 from anti-influenza_CDR
aagagcucccagucuauccugaacucaaguaauaacaaaaauuaccucgcc

SEQ ID NO: 30283 - RNA, 51 nt, Artificial Sequence
  derived and/or modified sequence opt3 from anti-influenza_CDR
uggaucagcgccuacaacggcaauaccaacuaugcucagaaguuccaaggg

SEQ ID NO: 30284 - RNA, 51 nt, Artificial Sequence
  derived and/or modified sequence opt3 from anti-influenza_CDR
ggcgugauccccauuuucagaaccgccaacuacgcucagaauuuucaaggg

SEQ ID NO: 30285 - RNA, 51 nt, Artificial Sequence
  derived and/or modified sequence opt3 from anti-influenza_CDR
ggcaucauugccauauuccacacccccaaguacgcucagaaauuucaaggg

SEQ ID NO: 30286 - RNA, 51 nt, Artificial Sequence
  derived and/or modified sequence opt3 from anti-influenza_CDR
ggcaucagccccauguucgggaccacaacuuacgcccagaaguuucaagga

SEQ ID NO: 30287 - RNA, 51 nt, Artificial Sequence
  derived and/or modified sequence opt3 from anti-influenza_CDR
aagagcucccagucugugcuguacucaaguaacaauaaaaacuaucucgcc

SEQ ID NO: 30288 - RNA, 51 nt, Artificial Sequence
  derived and/or modified sequence opt3 from anti-influenza_CDR
ggcaucauucccauauucgggaccacaaaguacgccccuaaauuucaggga

SEQ ID NO: 30289 - RNA, 51 nt, Artificial Sequence
  derived and/or modified sequence opt3 from anti-influenza_CDR
ggcaucagcccccuguucgggaccacaaacuacgcccagaaguuucaagga

SEQ ID NO: 30290 - RNA, 51 nt, Artificial Sequence
  derived and/or modified sequence opt3 from anti-influenza_CDR
ggcaucauggggauguucggaaccacaaacuacgcccagaaguuucaaggu

SEQ ID NO: 30291 - RNA, 51 nt, Artificial Sequence
  derived and/or modified sequence opt3 from anti-influenza_CDR
ggcaucauugggauguucggaagcaccaacuacgcccagaauuuucaaggu

SEQ ID NO: 30292 - RNA, 51 nt, Artificial Sequence
  derived and/or modified sequence opt3 from anti-influenza_CDR
uggaucaaccccaauagcggcgggaccaacuacgcccagaaguuccaagga

SEQ ID NO: 30293 - RNA, 51 nt, Artificial Sequence
  derived and/or modified sequence opt3 from anti-influenza_CDR
gccaucagcuccucuggcgacucaaccuacuaugcugauagugugaagggg

SEQ ID NO: 30294 - RNA, 51 nt, Artificial Sequence
  derived and/or modified sequence opt3 from anti-influenza_CDR
agcaucuccucuucaaguagcuacauuuauuacguggacuccgucaagggc

SEQ ID NO: 30295 - RNA, 51 nt, Artificial Sequence
  derived and/or modified sequence opt3 from anti-influenza_CDR
gacaucauuggcauguucgggagcaccaacuacgcccagaauuuucaagga

SEQ ID NO: 30296 - RNA, 51 nt, Artificial Sequence
  derived and/or modified sequence opt3 from anti-influenza_CDR
ggcaucauucccauguucgggaccacaaacuacgcccagaaguuucaagga

SEQ ID NO: 30297 - RNA, 51 nt, Artificial Sequence
  derived and/or modified sequence opt3 from anti-influenza_CDR
ggcaucauugccauauucgggaccgcuaacuacgcacagaaguuucaagga

SEQ ID NO: 30298 - RNA, 51 nt, Artificial Sequence
  derived and/or modified sequence opt3 from anti-influenza_CDR
ggcaucauucccauauucgggaccacaaacuacgcccagaaguuucaagga

SEQ ID NO: 30299 - RNA, 51 nt, Artificial Sequence
  derived and/or modified sequence opt3 from anti-influenza_CDR
ggcaucuucgcccuguuugggaccacagacuacgcucagaaguuccaagga

SEQ ID NO: 30300 - RNA, 51 nt, Artificial Sequence
  derived and/or modified sequence opt3 from anti-influenza_CDR
ggcaucauugggauguucggaaccgccaacuacgcucagaaguuucaaggu

SEQ ID NO: 30301 - RNA, 51 nt, Artificial Sequence
  derived and/or modified sequence opt3 from anti-influenza_CDR
ggcaucauugccguguucgggaccacaaaguacgcucacaaauuucaggga

SEQ ID NO: 30302 - RNA, 51 nt, Artificial Sequence
  derived and/or modified sequence opt3 from anti-influenza_CDR
ggcauccuggggguguucggaagccccuccuacgcccagaaguuucaaggu

SEQ ID NO: 30303 - RNA, 51 nt, Artificial Sequence
  derived and/or modified sequence opt3 from anti-influenza_CDR
ggcaucuucgggauguuuggaaccgccaacuacgcucagaaguuccaaggu

SEQ ID NO: 30304 - RNA, 51 nt, Artificial Sequence
  derived and/or modified sequence opt3 from anti-influenza_CDR
uggaucagcgccuacaccggcgacacagauuaugcucagaaguuccaaggg

SEQ ID NO: 30305 - RNA, 51 nt, Artificial Sequence
  derived and/or modified sequence opt3 from anti-influenza_CDR
agcuucgaccccgaggauggcgaaaccaucuacgcccagaaguuucaaggg

SEQ ID NO: 30306 - RNA, 51 nt, Artificial Sequence
  derived and/or modified sequence opt3 from anti-influenza_CDR
ggcaucagcggguccggagagucuaccuacuaugccgacucagugaagggu

SEQ ID NO: 30307 - RNA, 51 nt, Artificial Sequence
  derived and/or modified sequence opt3 from anti-influenza_CDR
guggucagcuacgacggcaacuauaaguacuaugccgauuccguucagggg

SEQ ID NO: 30308 - RNA, 51 nt, Artificial Sequence
  derived and/or modified sequence opt3 from anti-influenza_CDR
ggcagcaucagcuacucugggucaaccuauuaccaccccagucugaagucc

SEQ ID NO: 30309 - RNA, 51 nt, Artificial Sequence
  derived and/or modified sequence opt3 from anti-influenza_CDR
accagaggcaggcccaucgggcggaacugggagccucgcgacaaggauuac

SEQ ID NO: 30310 - RNA, 51 nt, Artificial Sequence
  derived and/or modified sequence opt3 from anti-influenza_CDR
gccagagaggcuggcuaccacagcuccuucucugggguguauuuugacuac

SEQ ID NO: 30311 - RNA, 51 nt, Artificial Sequence
  derived and/or modified sequence opt3 from anti-influenza_CDR
agaaucgaccccaacggcagcgggaccacauacgcccagaaguuccaagga

SEQ ID NO: 30312 - RNA, 51 nt, Artificial Sequence
  derived and/or modified sequence opt3 from anti-influenza_CDR
agaaucgaccccaacggcgccgggaccacauacgcucagaaguuccaagga

SEQ ID NO: 30313 - RNA, 51 nt, Artificial Sequence
  derived and/or modified sequence opt3 from anti-influenza_CDR
uggaucgaccccaacaaugauggcaccauuuacgcccagaaguuccaaggg

SEQ ID NO: 30314 - RNA, 51 nt, Artificial Sequence
  derived and/or modified sequence opt3 from anti-influenza_CDR
augauguaccccggcgacagcgauaccaucuauuccccuucuuuccagggg

SEQ ID NO: 30315 - RNA, 51 nt, Artificial Sequence
  derived and/or modified sequence opt3 from anti-influenza_CDR
augauguaccccggcgacgccgaugcuaucuauagcccuuccuuccagggg

SEQ ID NO: 30316 - RNA, 51 nt, Artificial Sequence
  derived and/or modified sequence opt3 from anti-influenza_CDR
augauguaccccggcgagagcgaaaccaucuauuccccuucuuuccagggg

SEQ ID NO: 30317 - RNA, 51 nt, Artificial Sequence
  derived and/or modified sequence opt3 from anti-influenza_CDR
augauguaccccggcgacgccgauaccaucuauagcccuuccuuccagggg

SEQ ID NO: 30318 - RNA, 51 nt, Artificial Sequence
  derived and/or modified sequence opt3 from anti-influenza_CDR
augauguaccccggcagcuccgacaccaucuauucuccuucauuccagggg

SEQ ID NO: 30319 - RNA, 51 nt, Artificial Sequence
  derived and/or modified sequence opt3 from anti-influenza_CDR
augauguaccccggcgacagcgaugccaucuauuccccuucuuuccagggg

SEQ ID NO: 30320 - RNA, 51 nt, Artificial Sequence
  derived and/or modified sequence opt3 from anti-influenza_CDR
augauguaccccggcgacaccgauacaaucuauagcccuuccuuccagggg

SEQ ID NO: 30321 - RNA, 51 nt, Artificial Sequence
  derived and/or modified sequence opt3 from anti-influenza_CDR
augauguaccccggcgagagcgacaccaucuauuccccuucuuuccagggg

SEQ ID NO: 30322 - RNA, 51 nt, Artificial Sequence
  derived and/or modified sequence opt3 from anti-influenza_CDR
gugaucagcugggacuccggcagaauuggguacgccgauucugucaaggga

SEQ ID NO: 30323 - RNA, 51 nt, Artificial Sequence
  derived and/or modified sequence opt3 from anti-influenza_CDR
gugagaagcggcgccuacuauuucaacuaccugguccccuauuuugacuac

SEQ ID NO: 30324 - RNA, 51 nt, Artificial Sequence
  derived and/or modified sequence opt3 from anti-influenza_CDR
gugagaagcggcgccuacuaugucaacuaccugguucccuauuucgacuac

SEQ ID NO: 30325 - RNA, 51 nt, Artificial Sequence
  derived and/or modified sequence opt3 from anti-influenza_CDR
aucauuagcugggacuccggcagaauaggguacgccgauucugugagggga

SEQ ID NO: 30326 - RNA, 51 nt, Artificial Sequence
  derived and/or modified sequence opt3 from anti-influenza_CDR
cacggcgggguguacuauuacggaagcgccuccucugguugguucgacccc

SEQ ID NO: 30327 - RNA, 54 nt, Artificial Sequence
  derived and/or modified sequence opt3 from anti-influenza_CDR
agaaccuacuauaggagcaagugguacaacgacuaugccgaguccgugaaaucu

SEQ ID NO: 30328 - RNA, 54 nt, Artificial Sequence
  derived and/or modified sequence opt3 from anti-influenza_CDR
agaaccuacuauaggagcaagugguacuaugacuacgccgaguccgugaaaucu

SEQ ID NO: 30329 - RNA, 54 nt, Artificial Sequence
  derived and/or modified sequence opt3 from anti-influenza_CDR
agaaccuacuauaggagcaagugguacaacgacuaugccguguccgucaaaucu

SEQ ID NO: 30330 - RNA, 54 nt, Artificial Sequence
  derived and/or modified sequence opt3 from anti-influenza_CDR
agaaccuacuauaggagcaagugguacaacgacuaugccgauuuccugaaacgg

SEQ ID NO: 30331 - RNA, 54 nt, Artificial Sequence
  derived and/or modified sequence opt3 from anti-influenza_CDR
agaaccuacuauaggagcggcugguacaacgacuaugccgaguccgugaagucu

SEQ ID NO: 30332 - RNA, 54 nt, Artificial Sequence
  derived and/or modified sequence opt3 from anti-influenza_CDR
gccagacugggcgggaacaaggacuacggagauuaucucugguacuucgaccuu

SEQ ID NO: 30333 - RNA, 54 nt, Artificial Sequence
  derived and/or modified sequence opt3 from anti-influenza_CDR
gccaaggacaccgcugaucacggcgacuacguggaucugggguucuuugacgca

SEQ ID NO: 30334 - RNA, 54 nt, Artificial Sequence
  derived and/or modified sequence opt3 from anti-influenza_CDR
gccagaagcggcaucuucgacugguccgcuccccugguggaggcauuugauauu

SEQ ID NO: 30335 - RNA, 54 nt, Artificial Sequence
  derived and/or modified sequence opt3 from anti-influenza_CDR
gccagacacgcuagcugcuccgcaaggucuuguuacuggggccccguggacuau

SEQ ID NO: 30336 - RNA, 54 nt, Artificial Sequence
  derived and/or modified sequence opt3 from anti-influenza_CDR
gacgcucccccuaacguggaggucgccagcaugaccaauugguacuucgaucug

SEQ ID NO: 30337 - RNA, 54 nt, Artificial Sequence
  derived and/or modified sequence opt3 from anti-influenza_CDR
cugagaaccgacuacggcgaucccgacagcguguauuacuaugggauggauguc

SEQ ID NO: 30338 - RNA, 54 nt, Artificial Sequence
  derived and/or modified sequence opt3 from anti-influenza_CDR
gggaccugcgccggcgacuguagccugcacuacuauuacuauggacucgaugug

SEQ ID NO: 30339 - RNA, 54 nt, Artificial Sequence
  derived and/or modified sequence opt3 from anti-influenza_CDR
cacgugagcgucucccauggcgggagaaccaagucuaaccccucaguuaugagu

SEQ ID NO: 30340 - RNA, 54 nt, Artificial Sequence
  derived and/or modified sequence opt3 from anti-influenza_CDR
gcccugaucuacuucgacggcagcaagcaguauuacgcugauuccgugaaaggg

SEQ ID NO: 30341 - RNA, 54 nt, Artificial Sequence
  derived and/or modified sequence opt3 from anti-influenza_CDR
acccugaucagcuacgacggcgccaaccaguauuacgcugauuccgugaagggg

SEQ ID NO: 30342 - RNA, 54 nt, Artificial Sequence
  derived and/or modified sequence opt3 from anti-influenza_CDR
gccgugcccggcccugucuucgggaucuuuccaccguggagcuacuucgacaac

SEQ ID NO: 30343 - RNA, 54 nt, Artificial Sequence
  derived and/or modified sequence opt3 from anti-influenza_CDR
ggcgggaucauucccauauucggagccgcuaacuacgcacagaaguuucaaggu

SEQ ID NO: 30344 - RNA, 54 nt, Artificial Sequence
  derived and/or modified sequence opt3 from anti-influenza_CDR
ggcuggaucagcgccuacaccgggaacacacacuaugcuaagaauuucgaggga

SEQ ID NO: 30345 - RNA, 54 nt, Artificial Sequence
  derived and/or modified sequence opt3 from anti-influenza_CDR
ggcuggaucaaccccaauuucgggggaacccacuacgccagaaaguuucagggu

SEQ ID NO: 30346 - RNA, 54 nt, Artificial Sequence
  derived and/or modified sequence opt3 from anti-influenza_CDR
gugagauggagggccgcugcagucaucauggaccaguucuacaagauggauguu

SEQ ID NO: 30347 - RNA, 54 nt, Artificial Sequence
  derived and/or modified sequence opt3 from anti-influenza_CDR
gccgugcccggcccuaucuucgggauuuuuccaccguggagcuacuucgaccac

SEQ ID NO: 30348 - RNA, 54 nt, Artificial Sequence
  derived and/or modified sequence opt3 from anti-influenza_CDR
gccgcuagcaccgcaacauccggcacuuacuaugccaugagacccuucgacuuu

SEQ ID NO: 30349 - RNA, 57 nt, Artificial Sequence
  derived and/or modified sequence opt3 from anti-influenza_CDR
gccagaggcaagaggcccggguacugcagcggagguguguguuccucugacuauugg

SEQ ID NO: 30350 - RNA, 57 nt, Artificial Sequence
  derived and/or modified sequence opt3 from anti-influenza_CDR
gccagacacuaccccuauuacgaccugccuaccggcuucuauagccaguuugauuuc

SEQ ID NO: 30351 - RNA, 57 nt, Artificial Sequence
  derived and/or modified sequence opt3 from anti-influenza_CDR
ggcagcgggggauacgguggcuucgacuauuuugggaagcugagaaccugggauuuc

SEQ ID NO: 30352 - RNA, 57 nt, Artificial Sequence
  derived and/or modified sequence opt3 from anti-influenza_CDR
uucaucagaaccaggcccuggggcgggacagccgacacugcugcaagcgugaaggga

SEQ ID NO: 30353 - RNA, 57 nt, Artificial Sequence
  derived and/or modified sequence opt3 from anti-influenza_CDR
cugaacuaccacgacagcggcaccuauuacaaugcccccagagggugguucgauccu

SEQ ID NO: 30354 - RNA, 57 nt, Artificial Sequence
  derived and/or modified sequence opt3 from anti-influenza_CDR
gugaaggacggcuacugcacccugacaagcugucccgucgggugguauuucgaucuc

SEQ ID NO: 30355 - RNA, 57 nt, Artificial Sequence
  derived and/or modified sequence opt3 from anti-influenza_CDR
gccgugcccggcccuaucuucgggauuuuuccaccguggagcuacuucgaccacugg

SEQ ID NO: 30356 - RNA, 57 nt, Artificial Sequence
  derived and/or modified sequence opt3 from anti-influenza_CDR
gccagagcuaugauccagggcguggucacccuguaccucaggcccggggacuauugg

SEQ ID NO: 30357 - RNA, 57 nt, Artificial Sequence
  derived and/or modified sequence opt3 from anti-influenza_CDR
gccaaggugggccccuacaccggguaugacgauuacaacuauuacggaauggacguc

SEQ ID NO: 30358 - RNA, 57 nt, Artificial Sequence
  derived and/or modified sequence opt3 from anti-influenza_CDR
gccaagguggagagauccuucuacgacggcagcggguauggagaugcucuggaaauc

SEQ ID NO: 30359 - RNA, 57 nt, Artificial Sequence
  derived and/or modified sequence opt3 from anti-influenza_CDR
uacugcgccagaggcagggugaacagcggguaugacuggggacccaauuucgauucc

SEQ ID NO: 30360 - RNA, 57 nt, Artificial Sequence
  derived and/or modified sequence opt3 from anti-influenza_CDR
uucugcgccagaggcagccccaacuccggguacgacuggggaccucacuuugauuau

SEQ ID NO: 30361 - RNA, 57 nt, Artificial Sequence
  derived and/or modified sequence opt3 from anti-influenza_CDR
agaaucaagagcaacaccgacggcgggacaacugauuacgccgcucccgugaaagga

SEQ ID NO: 30362 - RNA, 57 nt, Artificial Sequence
  derived and/or modified sequence opt3 from anti-influenza_CDR
cugagacuccagggcgagguggucguucccccuagccaauccaacugguucgaccca

SEQ ID NO: 30363 - RNA, 60 nt, Artificial Sequence
  derived and/or modified sequence opt3 from anti-influenza_CDR
gccaaggagggcgggaacaccaucuucggacuggugacaauggcuuacuauuuugacagc

SEQ ID NO: 30364 - RNA, 60 nt, Artificial Sequence
  derived and/or modified sequence opt3 from anti-influenza_CDR
gccagagcuggcggggacagcuccggauacuauggugcacugggcagguucuuucagcac

SEQ ID NO: 30365 - RNA, 60 nt, Artificial Sequence
  derived and/or modified sequence opt3 from anti-influenza_CDR
gccaaggacagcagaggcuacugcuccucuaucauuuguuucgagggagggcuggauaac

SEQ ID NO: 30366 - RNA, 60 nt, Artificial Sequence
  derived and/or modified sequence opt3 from anti-influenza_CDR
ggcagcggguccucugacagaucagauuacgacccccacuauuacuauuaccuggaugug

SEQ ID NO: 30367 - RNA, 60 nt, Artificial Sequence
  derived and/or modified sequence opt3 from anti-influenza_CDR
ggcaccgaccccgauacagagguguacugcagagucgggaacugugccgcuuucgacuau

SEQ ID NO: 30368 - RNA, 60 nt, Artificial Sequence
  derived and/or modified sequence opt3 from anti-influenza_CDR
ggcaccagccacguguccagauacuucgacuggcugcccccuacaaacugguuugaucca

SEQ ID NO: 30369 - RNA, 60 nt, Artificial Sequence
  derived and/or modified sequence opt3 from anti-influenza_CDR
ggcaccgaccccgauacagagggguacugcagaagcggauccuguucugccuucgacuuu

SEQ ID NO: 30370 - RNA, 60 nt, Artificial Sequence
  derived and/or modified sequence opt3 from anti-influenza_CDR
ggcaccgaccccgauacagagguguacugcagagccgggaacugugcugcauucgacuuu

SEQ ID NO: 30371 - RNA, 60 nt, Artificial Sequence
  derived and/or modified sequence opt3 from anti-influenza_CDR
agaggcgggcacagcuucggauacgguuccggcggggacacccauucugaguuugauuca

SEQ ID NO: 30372 - RNA, 60 nt, Artificial Sequence
  derived and/or modified sequence opt3 from anti-influenza_CDR
cacaugagcaugcagcaaguggucuccgccggcugggagagagcugaccugguuggggau

SEQ ID NO: 30373 - RNA, 60 nt, Artificial Sequence
  derived and/or modified sequence opt3 from anti-influenza_CDR
gacagcagacugaggucccuccuuuacuucgaguggcugucucagggcuauuuuaacccc

SEQ ID NO: 30374 - RNA, 60 nt, Artificial Sequence
  derived and/or modified sequence opt3 from anti-influenza_CDR
gccagacaccugggccagcaacucgugagcaacaccuacuauuacuaugggauggacguc

SEQ ID NO: 30375 - RNA, 63 nt, Artificial Sequence
  derived and/or modified sequence opt3 from anti-influenza_CDR
accacaggcgggacuacgaccugcacagccgcuggaugugguggcgggugcuguacuugcugu

SEQ ID NO: 30376 - RNA, 63 nt, Artificial Sequence
  derived and/or modified sequence opt3 from anti-influenza_CDR
gccagagcugcagacgagagcguggaaucccugaccaucaaggccuucaggacaaacuaccac

SEQ ID NO: 30377 - RNA, 63 nt, Artificial Sequence
  derived and/or modified sequence opt3 from anti-influenza_CDR
gccagaaugccccuggcuaacuacgaccuccuuaccggccuguauaucggggcauucgauuug

SEQ ID NO: 30378 - RNA, 63 nt, Artificial Sequence
  derived and/or modified sequence opt3 from anti-influenza_CDR
gacaugcuggccuacuauagcgauaacuccggcaagaaauacaauguguaugggauggacguc

SEQ ID NO: 30379 - RNA, 63 nt, Artificial Sequence
  derived and/or modified sequence opt3 from anti-influenza_CDR
gacaugcuggccuacuauuacgauggcagcgggaucagauauaaccucuacggaauggacgug

SEQ ID NO: 30380 - RNA, 66 nt, Artificial Sequence
  derived and/or modified sequence opt3 from anti-influenza_CDR
gccaaggaccccagacugaggcaccuccuuuacuucccuuuuaccagcaugaucuauuucgauuac

SEQ ID NO: 30381 - RNA, 66 nt, Artificial Sequence
  derived and/or modified sequence opt3 from anti-influenza_CDR
gccaaggacagccagcugagaucccuccuuuacuucgaguggcugucucaaggcuauuuugauccc

SEQ ID NO: 30382 - RNA, 66 nt, Artificial Sequence
  derived and/or modified sequence opt3 from anti-influenza_CDR
gccaaggacagccagcugagaucccuccuuuacuucgaguggcugucucaaggcuauuuugauuac

SEQ ID NO: 30383 - RNA, 66 nt, Artificial Sequence
  derived and/or modified sequence opt3 from anti-influenza_CDR
gccaaggacagccagcugagaucccuccuuuacuucgaguggcugucucaaggcuauuuugaaccc

SEQ ID NO: 30384 - RNA, 66 nt, Artificial Sequence
  derived and/or modified sequence opt3 from anti-influenza_CDR
gccaaggagagaccccugaggcuccuucgguacuucgacuggcugagcggcggggcuaacgauuau

SEQ ID NO: 30385 - RNA, 66 nt, Artificial Sequence
  derived and/or modified sequence opt3 from anti-influenza_CDR
gccagagacgugcacaacuacgauuuccugaccggcuauccccuccaucuuuacgggauggacguc

SEQ ID NO: 30386 - RNA, 66 nt, Artificial Sequence
  derived and/or modified sequence opt3 from anti-influenza_CDR
gccagagacggcagggagggguacuucuauggaagcgguuccuuuuacaaccugaagggccucaau

SEQ ID NO: 30387 - RNA, 66 nt, Artificial Sequence
  derived and/or modified sequence opt3 from anti-influenza_CDR
agcaccgacagaggccacgugcugagguacuucggguggaugcuccccggagaugccuuugacguc

SEQ ID NO: 30388 - RNA, 66 nt, Artificial Sequence
  derived and/or modified sequence opt3 from anti-influenza_CDR
cugaacuacuaugacagaagcggcuaccacucccccgaugggccuucuaauaacugguucgaccca

SEQ ID NO: 30389 - RNA, 66 nt, Artificial Sequence
  derived and/or modified sequence opt3 from anti-influenza_CDR
gccagagugcccagggaccggcugcucacccuuuacuaugagagcuccacauacggcuucgauuau

SEQ ID NO: 30390 - RNA, 66 nt, Artificial Sequence
  derived and/or modified sequence opt3 from anti-influenza_CDR
gccagaaaguggggcaggaugaccguguucggggucgcuacagaccagcuguacuauuuugauuac

SEQ ID NO: 30391 - RNA, 66 nt, Artificial Sequence
  derived and/or modified sequence opt3 from anti-influenza_CDR
gccaccgacaucguggucgagagagaugcuagccugggcggguucaacuccuacggaauggacguu

SEQ ID NO: 30392 - RNA, 69 nt, Artificial Sequence
  derived and/or modified sequence opt3 from anti-influenza_CDR
gccagaaaccugcccgacaucgcuguggucaccgcaguucaggaugccacaccugugugguucgaccca

SEQ ID NO: 30393 - RNA, 69 nt, Artificial Sequence
  derived and/or modified sequence opt3 from anti-influenza_CDR
gacggccccuacagcgaugacuucagauccggguaugccgcuagguaccgguauuuuggaauggaugug

SEQ ID NO: 30394 - RNA, 72 nt, Artificial Sequence
  derived and/or modified sequence opt3 from anti-influenza_CDR
ggcagagagcugcucaggcuucagcacuuccugaccgacagccaauccgaacggcgcgauugcuuugacccc

SEQ ID NO: 30395 - RNA, 72 nt, Artificial Sequence
  derived and/or modified sequence opt3 from anti-influenza_CDR
augagccugcucaccgagguggaaacacccacuagaaacgaguggggcuguaggugcaaugacuccucugau

SEQ ID NO: 30396 - RNA, 72 nt, Artificial Sequence
  derived and/or modified sequence opt3 from anti-influenza_CDR
augagccugcucaccgagguggaaacacccacuaagaacgagugggaaugcagauguaaugacuccucugau

SEQ ID NO: 30397 - RNA, 72 nt, Artificial Sequence
  derived and/or modified sequence opt3 from anti-influenza_CDR
augagccugcucaccgagguggaaacacccaucagaaacgagugggaauguaggugcaaugacuccucugau

SEQ ID NO: 30398 - RNA, 72 nt, Artificial Sequence
  derived and/or modified sequence opt3 from anti-influenza_CDR
augagccugcucaccgagguggaaacacccaucagaaacggcugggagugcaaguguaaugacuccucugau

SEQ ID NO: 30399 - RNA, 72 nt, Artificial Sequence
  derived and/or modified sequence opt3 from anti-influenza_CDR
augagccugcucaccgagguggaaacacccaucagauccgaguggggcuguaggugcaacgacucuucagau

SEQ ID NO: 30400 - RNA, 72 nt, Artificial Sequence
  derived and/or modified sequence opt3 from anti-influenza_CDR
augagcuuccugcccgagguggaaaccccuaucagaaacgaguggggcuguaggugcaaugacuccucugau

SEQ ID NO: 30401 - RNA, 72 nt, Artificial Sequence
  derived and/or modified sequence opt3 from anti-influenza_CDR
augagccugcucaccgagguggaaacacccaucagaaacgaguggggcuguaggugcaaugacuccucuaac

SEQ ID NO: 30402 - RNA, 72 nt, Artificial Sequence
  derived and/or modified sequence opt3 from anti-influenza_CDR
augagccugcucaccgagguggaaacacccaucagaaaggaguggggcuguaggugcaacgacuccucugau

SEQ ID NO: 30403 - RNA, 72 nt, Artificial Sequence
  derived and/or modified sequence opt3 from anti-influenza_CDR
augagcuuccugaccgagguggaaacacccaucagaaacgaguggggcuguaggugcaaugacuccucugau

SEQ ID NO: 30404 - RNA, 72 nt, Artificial Sequence
  derived and/or modified sequence opt3 from anti-influenza_CDR
augagccugcccaccgagguggaaacaccuaucagauccgaguggggcuguaggugcaacgacucuucagau

SEQ ID NO: 30405 - RNA, 72 nt, Artificial Sequence
  derived and/or modified sequence opt3 from anti-influenza_CDR
augagccugcuccccgagguggaaaccccuaucagaaacgaguggggcuguaggugcaaugacuccucugau

SEQ ID NO: 30406 - RNA, 72 nt, Artificial Sequence
  derived and/or modified sequence opt3 from anti-influenza_CDR
augagccugcuccccgagguggaaaccccuaucagaaacggcuggggguguaggugcaaugacuccucugau

SEQ ID NO: 30407 - RNA, 72 nt, Artificial Sequence
  derived and/or modified sequence opt3 from anti-influenza_CDR
augagccugcucaccgagguggaaacacccacuagaaacggcugggaguguaggugcuccgggucuucagac

SEQ ID NO: 30408 - RNA, 72 nt, Artificial Sequence
  derived and/or modified sequence opt3 from anti-influenza_CDR
augagccugcucaccgagguggaaacacccaucagaaacgagugggaauacaggugcaaugacuccucugau

SEQ ID NO: 30409 - RNA, 72 nt, Artificial Sequence
  derived and/or modified sequence opt3 from anti-influenza_CDR
augagccugcucaccgagguggaaacacccaucagaaacgagugggaauacaggugcuccgacucuucagau

SEQ ID NO: 30410 - RNA, 72 nt, Artificial Sequence
  derived and/or modified sequence opt3 from anti-influenza_CDR
augagccugcucaccgagguggaaacacccacuagaaacggcugggagugcagguacuccgacucuucagau

SEQ ID NO: 30411 - RNA, 72 nt, Artificial Sequence
  derived and/or modified sequence opt3 from anti-influenza_CDR
augagcuuccugaccgagguggaaacacucacuagaaacggcugggaguguaggugcuccgacucuucagau

SEQ ID NO: 30412 - RNA, 72 nt, Artificial Sequence
  derived and/or modified sequence opt3 from anti-influenza_CDR
augagccugcucaccgagguggaaacacuuacuagaaacggcugggagugcaaguguagggacuccucugau

SEQ ID NO: 30413 - RNA, 72 nt, Artificial Sequence
  derived and/or modified sequence opt3 from anti-influenza_CDR
augagccugcucaccgagguggaaacacccaucagaaacgaguggggcuguaggugcaaugacuccucugau

SEQ ID NO: 30414 - RNA, 72 nt, Artificial Sequence
  derived and/or modified sequence opt3 from anti-influenza_CDR
augagccugcucaccgagguggaaacacccaucagauccgaguggggcuguaggugcaacgacucuggggau

SEQ ID NO: 30415 - RNA, 72 nt, Artificial Sequence
  derived and/or modified sequence opt3 from anti-influenza_CDR
augagccugcucaccgagguggaaacacccaucagaaacgagugggaauguaggugcaauggcuccucugac

SEQ ID NO: 30416 - RNA, 72 nt, Artificial Sequence
  derived and/or modified sequence opt3 from anti-influenza_CDR
augagccugcccaccgagguggaaacaccuaucagaaacgaguggggcuguaggugcaaugacuccucugau

SEQ ID NO: 30417 - RNA, 72 nt, Artificial Sequence
  derived and/or modified sequence opt3 from anti-influenza_CDR
augagccugcucaccgagguggaaacacccaucagaaacgaguggggcuguaggugcaauggguccucugac

SEQ ID NO: 30418 - RNA, 72 nt, Artificial Sequence
  derived and/or modified sequence opt3 from anti-influenza_CDR
augagccugcucaccgagguggacacacuuacuagaaacggcuggggguguaggugcuccgauucuucagac

SEQ ID NO: 30419 - RNA, 72 nt, Artificial Sequence
  derived and/or modified sequence opt3 from anti-influenza_CDR
augagccugcucaccgagguggaaacacuuacuaagaacggcugggggugcagauguuccgacucuucagau

SEQ ID NO: 30420 - RNA, 72 nt, Artificial Sequence
  derived and/or modified sequence opt3 from anti-influenza_CDR
augagccugcucaccgagguggaaacacccacuagaaacggcugggagugcaaguguuccgacucuucagau

SEQ ID NO: 30421 - RNA, 72 nt, Artificial Sequence
  derived and/or modified sequence opt3 from anti-influenza_CDR
augagccugcucaccgagguggaaacacacacuagaaacggcugggagugcaaguguuccgacucuucagau

SEQ ID NO: 30422 - RNA, 72 nt, Artificial Sequence
  derived and/or modified sequence opt3 from anti-influenza_CDR
augagccugcucaccgaggugaagacacccacuagaaacggcugggaaugcaaauguuccgacucuucagau

SEQ ID NO: 30423 - RNA, 72 nt, Artificial Sequence
  derived and/or modified sequence opt3 from anti-influenza_CDR
augagccugcucaccgagguggaaacacuuacuagaaacggcuggggguguaggugcuccgacucuucagau

SEQ ID NO: 30424 - RNA, 72 nt, Artificial Sequence
  derived and/or modified sequence opt3 from anti-influenza_CDR
augagccugcucaccgagguggaaacacccacuagagacggcugggagugcaaguguuccgauucuucagac

SEQ ID NO: 30425 - RNA, 72 nt, Artificial Sequence
  derived and/or modified sequence opt3 from anti-influenza_CDR
augagccugcucaccgagguggaaacacccacuagaaacggcuggggguguaggugcuccgacucuucagau

SEQ ID NO: 30426 - RNA, 72 nt, Artificial Sequence
  derived and/or modified sequence opt3 from anti-influenza_CDR
augagccugcucaccgagguggaaacacccacuagaaacggcugggagugcaaguguaaugacuccucugau

SEQ ID NO: 30427 - RNA, 72 nt, Artificial Sequence
  derived and/or modified sequence opt3 from anti-influenza_CDR
augagccugcucaccgagguggaaacacuuacuagaaacggcugggagugcaaguguuccgacucuucagau

SEQ ID NO: 30428 - RNA, 72 nt, Artificial Sequence
  derived and/or modified sequence opt3 from anti-influenza_CDR
augagccugcucaccgagguggaaacacccaucagaaacgaguggggcugcaaguguaaugacuccucugau

SEQ ID NO: 30429 - RNA, 72 nt, Artificial Sequence
  derived and/or modified sequence opt3 from anti-influenza_CDR
augagcuuccugaccgagguggaaacacccaucagaaacgaguggggcuguaggugcaauggguccucugac

SEQ ID NO: 30430 - RNA, 72 nt, Artificial Sequence
  derived and/or modified sequence opt3 from anti-influenza_CDR
augagccugcucaccgagguggaaacacccacuagaaacggcugggaguguaggugcaaugacuccucugau

SEQ ID NO: 30431 - RNA, 72 nt, Artificial Sequence
  derived and/or modified sequence opt3 from anti-influenza_CDR
augagccugcucaccgagguggaaacacccaucagaaagggcugggagugcaacuguuccgacucuucagau

SEQ ID NO: 30432 - RNA, 72 nt, Artificial Sequence
  derived and/or modified sequence opt3 from anti-influenza_CDR
augagccugcucaccgagguggaaacacccacuagaaacgagugggaauguaggugcuccgacucuucagau

SEQ ID NO: 30433 - RNA, 72 nt, Artificial Sequence
  derived and/or modified sequence opt3 from anti-influenza_CDR
augagccugcucaccggcguggagacacacacuagaaacggguggggaugcaaguguuccgacucuucagau

SEQ ID NO: 30434 - RNA, 72 nt, Artificial Sequence
  derived and/or modified sequence opt3 from anti-influenza_CDR
augagccugcuccccgagguggaaacccacacaagaaacggcuggggguguaggugcuccgacucuucagau

SEQ ID NO: 30435 - RNA, 72 nt, Artificial Sequence
  derived and/or modified sequence opt3 from anti-influenza_CDR
accgacggccccuacagcgaugacuucagauccggguaugccgcuagguaccgguauuuuggaauggaugug

SEQ ID NO: 30436 - RNA, 75 nt, Artificial Sequence
  derived and/or modified sequence opt3 from anti-influenza_CDR
gccaagcacaugagccugcagcaaguggucuccgcuggcugggagagagcagaccucguuggggaugccuucgac

SEQ ID NO: 30437 - RNA, 75 nt, Artificial Sequence
  derived and/or modified sequence opt3 from anti-influenza_CDR
gccaagcaccugagcaugcagcaaguggucuccgcuggcugggagagagcagaccucguuggggaugccuucgac

SEQ ID NO: 30438 - RNA, 75 nt, Artificial Sequence
  derived and/or modified sequence opt3 from anti-influenza_CDR
gccaagcacgcuagccugcagcaaguggucuccgcaggcugggagagagccgaccucguuggggaugcguucgac

SEQ ID NO: 30439 - RNA, 75 nt, Artificial Sequence
  derived and/or modified sequence opt3 from anti-influenza_CDR
gccaagcacagcucccugcagcaaguggucucugcuggcugggagagagcagaccucguuggggaugccuucgac

SEQ ID NO: 30440 - RNA, 75 nt, Artificial Sequence
  derived and/or modified sequence opt3 from anti-influenza_CDR
gccaagcaccugagccuccagcaaguggucuccgcuggcugggagagagcagaccuuguuggggaugccuucgac

SEQ ID NO: 30441 - RNA, 75 nt, Artificial Sequence
  derived and/or modified sequence opt3 from anti-influenza_CDR
gccaagcacaugagcaugcagcaaguggucuccgcuggcugggagagagcagaccugguuggggaugccuucgac

SEQ ID NO: 30442 - RNA, 75 nt, Artificial Sequence
  derived and/or modified sequence opt3 from anti-influenza_CDR
gccagaggccccgagaccuacuauuacgacaagacaaacuggcugaauagccacccugaugaauauuuccagcau

SEQ ID NO: 30443 - RNA, 75 nt, Artificial Sequence
  derived and/or modified sequence opt3 from anti-influenza_CDR
accacagacggccccuacagcgaugacuucagauccggguaugccgcuagguaccgguauuuuggaauggaugug

SEQ ID NO: 30444 - RNA, 75 nt, Artificial Sequence
  derived and/or modified sequence opt3 from anti-influenza_CDR
accgacggccccuacagcgaugacuucagauccggguaugccgcuagguaccgguauuuuggaauggaugugugg

SEQ ID NO: 30445 - RNA, 78 nt, Artificial Sequence
  derived and/or modified sequence opt3 from anti-influenza_CDR
gacauccagaugacccaaagccccuccucucugucagccagugugggcgauagagucacaauuacuugcaggagcucc

SEQ ID NO: 30446 - RNA, 78 nt, Artificial Sequence
  derived and/or modified sequence opt3 from anti-influenza_CDR
gccaccggcagagcugcaacagggagcgccuccugcacuggagguggcacguacuggaccuauuguacaugcacuacc

SEQ ID NO: 30447 - RNA, 81 nt, Artificial Sequence
  derived and/or modified sequence opt3 from anti-influenza_CDR
ggcuacauccccgaggccccuagagacgggcaggcuuaugugaggaaggauggagaauggguccugcucagcaccuuccuu

SEQ ID NO: 30448 - RNA, 90 nt, Artificial Sequence
  derived and/or modified sequence opt3 from anti-influenza_CDR
caggugcaacugcucgagaccggcgggggacuugucaagcccggucagagccugaaauuguccugcgccgcuucuggcuucacauuuacu

SEQ ID NO: 30449 - RNA, 96 nt, Artificial Sequence
  derived and/or modified sequence opt3 from anti-influenza_CDR
agauucaccaucagcagggacaacuccaagaauacacuguaccuccagaugaacucucuucgggccgaggauacugcuguguauuacugcgcaaaa

SEQ ID NO: 30450 - RNA, 96 nt, Artificial Sequence
  derived and/or modified sequence opt3 from anti-influenza_CDR
ggcgugcccagcagauucuccgggucuggaucagguaccgacuuuacacugacuaucaguagccuccagccugaggauuucgccacguacuauugc

SEQ ID NO: 30451 - RNA, 15 nt, Artificial Sequence
  derived and/or modified sequence opt3 from anti-OX40_HeavyChain_CDR1
agcuacuccaugaac

SEQ ID NO: 30452 - RNA, 15 nt, Artificial Sequence
  derived and/or modified sequence opt3 from anti-OX40_HeavyChain_CDR1
gacuacgccaugcac

SEQ ID NO: 30453 - RNA, 15 nt, Artificial Sequence
  derived and/or modified sequence opt3 from anti-OX40_HeavyChain_CDR1
gacagcuacaugucc

SEQ ID NO: 30454 - RNA, 15 nt, Artificial Sequence
  derived and/or modified sequence opt3 from anti-OX40_HeavyChain_CDR1
gacgccuacaugagc

SEQ ID NO: 30455 - RNA, 15 nt, Artificial Sequence
  derived and/or modified sequence opt3 from anti-OX40_HeavyChain_CDR1
gagagcuacaugucc

SEQ ID NO: 30456 - RNA, 15 nt, Artificial Sequence
  derived and/or modified sequence opt3 from anti-OX40_HeavyChain_CDR1
agcggcuacuggaac

SEQ ID NO: 30457 - RNA, 21 nt, Artificial Sequence
  derived and/or modified sequence opt3 from anti-OX40_LightChain_CDR2
uacaccagcagacugcacucc

SEQ ID NO: 30458 - RNA, 21 nt, Artificial Sequence
  derived and/or modified sequence opt3 from anti-OX40_LightChain_CDR2
gccgcuagcucccugcagucu

SEQ ID NO: 30459 - RNA, 21 nt, Artificial Sequence
  derived and/or modified sequence opt3 from anti-OX40_LightChain_CDR2
gacgccagcaacagagcuacc

SEQ ID NO: 30460 - RNA, 21 nt, Artificial Sequence
  derived and/or modified sequence opt3 from anti-OX40_LightChain_CDR2
uacaccagcagacugaggucc

SEQ ID NO: 30461 - RNA, 24 nt, Artificial Sequence
  derived and/or modified sequence opt3 from anti-OX40_LightChain_CDR3
cagcaaagaagcaacuggcccacc

SEQ ID NO: 30462 - RNA, 24 nt, Artificial Sequence
  derived and/or modified sequence opt3 from anti-OX40_HeavyChain_CDR3
gcccccagaugguacuucagcgug

SEQ ID NO: 30463 - RNA, 24 nt, Artificial Sequence
  derived and/or modified sequence opt3 from anti-OX40_HeavyChain_CDR3
gcccccagaugguacuucagcgcu

SEQ ID NO: 30464 - RNA, 24 nt, Artificial Sequence
  derived and/or modified sequence opt3 from anti-OX40_HeavyChain_CDR3
gcccccagaugguacuucgcugug

SEQ ID NO: 30465 - RNA, 27 nt, Artificial Sequence
  derived and/or modified sequence opt3 from anti-OX40_LightChain_CDR3
cagcaaggcaacacccugcccuggaca

SEQ ID NO: 30466 - RNA, 27 nt, Artificial Sequence
  derived and/or modified sequence opt3 from anti-OX40_HeavyChain_CDR3
gagagcggcugguaccuguucgacuau

SEQ ID NO: 30467 - RNA, 27 nt, Artificial Sequence
  derived and/or modified sequence opt3 from anti-OX40_LightChain_CDR3
cagcaauacaacagcuaucccccuacc

SEQ ID NO: 30468 - RNA, 27 nt, Artificial Sequence
  derived and/or modified sequence opt3 from anti-OX40_LightChain_CDR3
cagcaaggccacacccugcccccuaca

SEQ ID NO: 30469 - RNA, 27 nt, Artificial Sequence
  derived and/or modified sequence opt3 from anti-OX40_LightChain_CDR3
cagcaaggccacacccugcccgccaca

SEQ ID NO: 30470 - RNA, 27 nt, Artificial Sequence
  derived and/or modified sequence opt3 from anti-OX40_LightChain_CDR3
cagcaaggccacaccgccccucccaca

SEQ ID NO: 30471 - RNA, 27 nt, Artificial Sequence
  derived and/or modified sequence opt3 from anti-OX40_LightChain_CDR3
cagcaaggcgccacccugcccccuaca

SEQ ID NO: 30472 - RNA, 27 nt, Artificial Sequence
  derived and/or modified sequence opt3 from anti-OX40_LightChain_CDR3
cagcaaggccacgcccugcccccuacc

SEQ ID NO: 30473 - RNA, 27 nt, Artificial Sequence
  derived and/or modified sequence opt3 from anti-OX40_LightChain_CDR3
cagcaagcccacacccugcccccuaca

SEQ ID NO: 30474 - RNA, 27 nt, Artificial Sequence
  derived and/or modified sequence opt3 from anti-OX40_LightChain_CDR3
cagcaaggccacacccuggcccccaca

SEQ ID NO: 30475 - RNA, 27 nt, Artificial Sequence
  derived and/or modified sequence opt3 from anti-OX40_LightChain_CDR3
caggccggccacacccugcccccuaca

SEQ ID NO: 30476 - RNA, 30 nt, Artificial Sequence
  derived and/or modified sequence opt3 from anti-OX40_HeavyChain_CDR1
ggcuacaccuucacaagcuaugugaugcac

SEQ ID NO: 30477 - RNA, 30 nt, Artificial Sequence
  derived and/or modified sequence opt3 from anti-OX40_HeavyChain_CDR3
uacuauggcagcucccugucuauggacuac

SEQ ID NO: 30478 - RNA, 33 nt, Artificial Sequence
  derived and/or modified sequence opt3 from anti-OX40_LightChain_CDR1
agagccagccaggacaucuccaacuaccugaau

SEQ ID NO: 30479 - RNA, 33 nt, Artificial Sequence
  derived and/or modified sequence opt3 from anti-OX40_LightChain_CDR1
agagccagccagggcaucuccucuuggcuggcu

SEQ ID NO: 30480 - RNA, 33 nt, Artificial Sequence; identical to SEQ ID NO: 29998
  derived and/or modified sequence opt3 from anti-OX40_LightChain_CDR1

SEQ ID NO: 30481 - RNA, 39 nt, Artificial Sequence
  derived and/or modified sequence opt3 from anti-OX40_HeavyChain_CDR3
uacagauaugacuacgauggcgggcacgccauggacuau

SEQ ID NO: 30482 - RNA, 39 nt, Artificial Sequence
  derived and/or modified sequence opt3 from anti-OX40_HeavyChain_CDR3
uacaaguaugacuacgaugccggccacgcuauggacuau

SEQ ID NO: 30483 - RNA, 39 nt, Artificial Sequence
  derived and/or modified sequence opt3 from anti-OX40_HeavyChain_CDR3
uacaaguaugacuacgauggcgggcacgccauggacuau

SEQ ID NO: 30484 - RNA, 45 nt, Artificial Sequence
  derived and/or modified sequence opt3 from anti-OX40_HeavyChain_CDR3
gaccagagcaccgccgauuacuauuucuacuauggcauggacgug

SEQ ID NO: 30485 - RNA, 48 nt, Artificial Sequence
  derived and/or modified sequence opt3 from anti-OX40_HeavyChain_CDR2
uacaucagcuauaacggcauuaccuaccacaaucccucccugaagucu

SEQ ID NO: 30486 - RNA, 48 nt, Artificial Sequence
  derived and/or modified sequence opt3 from anti-OX40_HeavyChain_CDR2
uacaucagcuauaacgccauuaccuaccacaaucccucccugaagucu

SEQ ID NO: 30487 - RNA, 48 nt, Artificial Sequence
  derived and/or modified sequence opt3 from anti-OX40_HeavyChain_CDR2
uacaucagcuauuccggcauuaccuaccacaaccccucucugaaguca

SEQ ID NO: 30488 - RNA, 51 nt, Artificial Sequence
  derived and/or modified sequence opt3 from anti-OX40_HeavyChain_CDR2
uacaucaaccccuauaaugacggcaccaaguacaacgagaaauucaagggg

SEQ ID NO: 30489 - RNA, 51 nt, Artificial Sequence
  derived and/or modified sequence opt3 from anti-OX40_HeavyChain_CDR2
uacaucagcuccucuucaaguaccauugacuaugccgauagcgugaagggc

SEQ ID NO: 30490 - RNA, 51 nt, Artificial Sequence
  derived and/or modified sequence opt3 from anti-OX40_HeavyChain_CDR2
ggcaucagcuggaacuccgggucuauuggauacgccgacucagugaagggu

SEQ ID NO: 30491 - RNA, 51 nt, Artificial Sequence
  derived and/or modified sequence opt3 from anti-OX40_HeavyChain_CDR2
gacauguaccccgauaacggcgacagcuccuauaaucagaaguucagagag

SEQ ID NO: 30492 - RNA, 51 nt, Artificial Sequence
  derived and/or modified sequence opt3 from anti-OX40_HeavyChain_CDR2
gacauguaccccgauaacgccgacagcuccuauaaucagaaguucagagag

SEQ ID NO: 30493 - RNA, 51 nt, Artificial Sequence
  derived and/or modified sequence opt3 from anti-OX40_HeavyChain_CDR2
gacauguaccccgauaacgccgacgcuagcuauaaucagaaguucagagag

SEQ ID NO: 30494 - RNA, 51 nt, Artificial Sequence
  derived and/or modified sequence opt3 from anti-OX40_HeavyChain_CDR2
gacauguaccccgauaacggcgacgccagcuauaaucagaaguucagagag

SEQ ID NO: 30495 - RNA, 51 nt, Artificial Sequence
  derived and/or modified sequence opt3 from anti-OX40_HeavyChain_CDR2
gacauguaccccgauagcggcgacuccucuuauaaccagaaguucagagag

SEQ ID NO: 30496 - RNA, 51 nt, Artificial Sequence
  derived and/or modified sequence opt3 from anti-OX40_HeavyChain_CDR2
gacauguaccccgauaacggcagcuccucuuauaaucagaaguucagagag

SEQ ID NO: 30497 - RNA, 309 nt, Artificial Sequence
  derived and/or modified sequence opt3 from Ig_LightChain_kappa_constant_domain
accguggccgcucccagcgucuucaucuuuccuccauccgacgagcagcugaagucuggcacagcaucaguugugugccuccuuaacaauuucuacccgagagaagccaaaguacaauggaagguggauaacgcgcugcagagugggaauagccaggaguccgucacugaacaggacucuaaagauucgacguauucauugagcaguaccuuaacacuguccaaggcugacuacgagaaacacaagguguaugccugugaaguuacucaucaaggacuaucuagccccgugaccaaguccuuuaacagg

SEQ ID NO: 30498 - RNA, 309 nt, Artificial Sequence
  derived and/or modified sequence opt3 from Ig_LightChain_kappa_constant_domain
accguggccgcucccagcgucuucaucuuuccuccauccgacgagcagcugaagucuggcacagcaucaguugugugccuccuuaacaauuucuacccgagagaagccaaaguacaauggaagguggauaacgcgcugcagagugggaauagccaggaguccgucacugaacaggacucuaaagauucgacguauucauugagcaacaccuuaacacugaguaaggcugacuacgagaaacacaagguguaugccugugaaguuacucaucaaggacuauccucucccgugaccaagagcuuuaauagg

SEQ ID NO: 30499 - RNA, 312 nt, Artificial Sequence
  derived and/or modified sequence opt3 from Ig_LightChain_lambda_constant_domain
cccaaggccgcuccuagcgugacccuguucccaccguccucugaggaacuccaggcaaacaaagccacacuugucugccugaucucagacuuuuaccccggcgcgguuacuguggcuuggaaggccgauaguagcccuguaaaagcagggguggagacgaccacaccauccaagcaaucuaauaacaaauaugccgcuucgucauacuugagcuuaacucccgaacaguggaagagucacagauccuauucuugucaggucacccaugagggaagcacaguggaaaagaccguugcaccuacugagugcucc

SEQ ID NO: 30500 - RNA, 312 nt, Artificial Sequence
  derived and/or modified sequence opt3 from Ig_LightChain_lambda_constant_domain
cccaaggccgcuccuagcgugacccuguucccaccguccucugaggaacuccaggcaaacaaagccacacuugucugccugaucucagacuuuuaccccggcgcgguuacuguggcuuggaaggccgauaguagcccuguaaaagcagggguggagacgaccacaccauccaagcaaucuaauaacaaauaugccgcuucgucauacuugagcuuaacucccgaacaguggaagagucacagauccuauucuugucaggucacccaugagggaagcacaguggaaaagaccguugccccugcagagugcucc

SEQ ID NO: 30501 - RNA, 312 nt, Artificial Sequence
  derived and/or modified sequence opt3 from Ig_LightChain_lambda_constant_domain
cccaaggccgcuccuagcgugacccuguucccaccguccucugaggaacuccaggcaaacaaagccacacuugucugccugaucucagacuuuuaccccggcgcgguuacuguggcuuggaaggccgauaguagcccuguaaaagcagggguggagacgaccacaccauccaagcaaucuaauaacaaauaugccgcuucgucauacuugagcuuaacucccgaacaguggaagagucacaaguccuauucuugucaggucacccaugagggaagcacaguggagaaaaccguugcaccuacugaaugcucc

SEQ ID NO: 30502 - RNA, 312 nt, Artificial Sequence
  derived and/or modified sequence opt3 from Ig_LightChain_lambda_constant_domain
cccaaggccgcuccuagcgugacccuguucccaccguccucugaggaacuccaggcaaacaaagccacacuugucugccugaucucagacuuuuaccccggcgcgguuacuguggcuuggaaggccgauaguagcccuguaaaagcagggguggagacgaccacaccauccaagcaaucuaauaacaaauaugccgcuucgucauacuugagcuuaacucccgaacaguggaagagucacaaguccuauucuugucaggucacccaugagggaagcacaguggagaaaaccguugccccugcagaaugcucc

SEQ ID NO: 30503 - RNA, 282 nt, Artificial Sequence
  derived and/or modified sequence opt3 from IgG1_HeavyChain_CH1_constant_domain
agcgccuccaccaagggccccucuguguucccucuggcuccaucaaguaaaagcacauccgggggaacugcagcccucgguugccuugucaaggacuacuuuccggagcccguuacggugucuuggaacucgggcguacacaccuucccugcggugcugcagucaagcggguuguauaguuuauccucugucgugacaguuccaagcuccucacugggaacucaaaccuacaucuguaaugugaaccauaaacccaguaauacaaaggucgauaaaaaggug

SEQ ID NO: 30504 - RNA, 270 nt, Artificial Sequence
  derived and/or modified sequence opt3 from IgG1_HeavyChain_CH1_constant_domain
agcggccccuccguguucccucuggccccaucuucaaagaguaccagcgggggaacagcugcacucgguugccuugucaaagacuacuuuccggagcccguuacuguguccuggaacucuggcguacacacguucccugccgugcugcagucgucaggguuguauagcuuaaguuccgucgugaccguuccaucuagcucccugggaacacaaacuuacaucuguaaugugaaccauaagcccucaaauaccaaagucgauaagaaagug

SEQ ID NO: 30505 - RNA, 270 nt, Artificial Sequence
  derived and/or modified sequence opt3 from IgG1_HeavyChain_CH1_constant_domain
agcggccccuccguguucccucuggccccaucuucaaagaguaccagcgggggaacagcugcacucgguugccuugucaaagacuacuuuccggagcccguuacuguguccuggaacucuggcguacacacguucccugccgugcugcagucgucaggguuguauagcuuaaguuccgucgugaccguuccaucuagcucccugggaacacaaacuuacaucuguaaugugaaccauaagcccucaaauaccaaagucgauaagaaagcg

SEQ ID NO: 30506 - RNA, 270 nt, Artificial Sequence
  derived and/or modified sequence opt3 from IgG1_HeavyChain_CH1_constant_domain
agcggccccuccguguucccucuggccccaucuucaaagaguaccagcgggggaacagcugcacucgguugccuugucaaagacuacuuuccggagcccguuacuguguccuggaacucuggcguacacacguucccugccgugcugcagucgucaggguuguauagcuuaaguuccgucgugaccguuccaucuagcucccugggaacacaaacuuacaucuguaaugugaaccauaagcccucaaauaccaaagucgauaagagagug

SEQ ID NO: 30507 - RNA, 270 nt, Artificial Sequence
  derived and/or modified sequence opt3 from IgG1_HeavyChain_CH1_constant_domain
agcggccccuccguguucccucuggccccaucuucaaagaguaccagcgggggaacagcugcacucgguugccuugucaaagacuacuuuccggagcccguuacuguguccuggaacucuggcguacacacguucccugccgugcugcagucgucaggguuguauagcuuaaguuccgucgugaccguuccaucuagcucccugggaacacaaacuuacaucuguaaugugaaccauaagcccucaaauaccaaagucgauaagagagcg

SEQ ID NO: 30508 - RNA, 270 nt, Artificial Sequence
  derived and/or modified sequence opt3 from IgG1_HeavyChain_CH1_constant_domain
agcggccccuccgugcugccucucgccccaucuucaaagaguaccagcgggggaacagcugcacuugguugccuggucaaagacuacuucccggagcccguuacuguguccuggaacucuggcguacacacguuuccugccguguugcagucgucaggguuauauagccugaguuccgucgugaccguuccaucuagcucccuaggaacacaaacuuacaucuguaaugugaaccauaagcccucaaauaccaaagucgauaagaaagug

SEQ ID NO: 30509 - RNA, 270 nt, Artificial Sequence
  derived and/or modified sequence opt3 from IgG1_HeavyChain_CH1_constant_domain
agcggccccuccgugcugccucucgccccaucuucaaagaguaccagcgggggaacagcugcacuugguugccuggucaaagacuacuucccggagcccguuacuguguccuggaacucuggcguacacacguuuccugccguguugcagucgucaggguuauauagccugaguuccgucgugaccguuccaucuagcucccuaggaacacaaacuuacaucuguaaugugaaccauaagcccucaaauaccaaagucgauaagaaagcg

SEQ ID NO: 30510 - RNA, 270 nt, Artificial Sequence
  derived and/or modified sequence opt3 from IgG1_HeavyChain_CH1_constant_domain
agcggccccuccgugcugccucucgccccaucuucaaagaguaccagcgggggaacagcugcacuugguugccuggucaaagacuacuucccggagcccguuacuguguccuggaacucuggcguacacacguuuccugccguguugcagucgucaggguuauauagccugaguuccgucgugaccguuccaucuagcucccuaggaacacaaacuuacaucuguaaugugaaccauaagcccucaaauaccaaagucgauaagagagug

SEQ ID NO: 30511 - RNA, 270 nt, Artificial Sequence
  derived and/or modified sequence opt3 from IgG1_HeavyChain_CH1_constant_domain
agcggccccuccgugcugccucucgccccaucuucaaagaguaccagcgggggaacagcugcacuugguugccuggucaaagacuacuucccggagcccguuacuguguccuggaacucuggcguacacacguuuccugccguguugcagucgucaggguuauauagccugaguuccgucgugaccguuccaucuagcucccuaggaacacaaacuuacaucuguaaugugaaccauaagcccucaaauaccaaagucgauaagagagcg

SEQ ID NO: 30512 - RNA, 282 nt, Artificial Sequence
  derived and/or modified sequence opt3 from IgG1_HeavyChain_CH1_constant_domain
agcgccuccaccaagggccccucuguguucccucuggcuccaucaaguaaaagcacauccgggggaacugcagcccucgguugccuugucaaggacuacuuuccggagcccguuacggugucuuggaacucgggcguacacaccuucccugcggugcugcagucaagcggguuguauaguuuauccucugucgugacaguuccaagcuccucacugggaacucaaaccuacaucuguaaugugaaccauaaacccaguaauacaaaggucgauaaaaaggcu

SEQ ID NO: 30513 - RNA, 282 nt, Artificial Sequence
  derived and/or modified sequence opt3 from IgG1_HeavyChain_CH1_constant_domain
agcgccuccaccaagggccccucuguguucccucuggcuccaucaaguaaaagcacauccgggggaacugcagcccucgguugccuugucaaggacuacuuuccggagcccguuacggugucuuggaacucgggcguacacaccuucccugcggugcugcagucaagcggguuguauaguuuauccucugucgugacaguuccaagcuccucacugggaacucaaaccuacaucuguaaugugaaccauaaacccaguaauacaaaggucgauaaaagagug

SEQ ID NO: 30514 - RNA, 282 nt, Artificial Sequence
  derived and/or modified sequence opt3 from IgG1_HeavyChain_CH1_constant_domain
agcgccuccaccaagggccccucuguguucccucuggcuccaucaaguaaaagcacauccgggggaacugcagcccucgguugccuugucaaggacuacuuuccggagcccguuacggugucuuggaacucgggcguacacaccuucccugcggugcugcagucaagcggguuguauaguuuauccucugucgugacaguuccaagcuccucacugggaacucaaaccuacaucuguaaugugaaccauaaacccaguaauacaaaggucgauaaaagagcu

SEQ ID NO: 30515 - RNA, 282 nt, Artificial Sequence
  derived and/or modified sequence opt3 from IgG1_HeavyChain_CH1_constant_domain
agcgccuccaccaagggccccucugugcugccucucgcuccaucaaguaaaagcacauccgggggaacugcagcccuugguugccuggucaaggacuacuucccggagcccguuacggugucuuggaacucgggcguacacaccuuuccugcgguguugcagucaagcggguuauauagucuguccucugucgugacaguuccaagcuccucacuaggaacucaaaccuacaucuguaaugugaaccauaaacccaguaauacaaaggucgauaaaaaggug

SEQ ID NO: 30516 - RNA, 282 nt, Artificial Sequence
  derived and/or modified sequence opt3 from IgG1_HeavyChain_CH1_constant_domain
agcgccuccaccaagggccccucugugcugccucucgcuccaucaaguaaaagcacauccgggggaacugcagcccuugguugccuggucaaggacuacuucccggagcccguuacggugucuuggaacucgggcguacacaccuuuccugcgguguugcagucaagcggguuauauagucuguccucugucgugacaguuccaagcuccucacuaggaacucaaaccuacaucuguaaugugaaccauaaacccaguaauacaaaggucgauaaaaaggcu

SEQ ID NO: 30517 - RNA, 282 nt, Artificial Sequence
  derived and/or modified sequence opt3 from IgG1_HeavyChain_CH1_constant_domain
agcgccuccaccaagggccccucugugcugccucucgcuccaucaaguaaaagcacauccgggggaacugcagcccuugguugccuggucaaggacuacuucccggagcccguuacggugucuuggaacucgggcguacacaccuuuccugcgguguugcagucaagcggguuauauagucuguccucugucgugacaguuccaagcuccucacuaggaacucaaaccuacaucuguaaugugaaccauaaacccaguaauacaaaggucgauaaaagagug

SEQ ID NO: 30518 - RNA, 282 nt, Artificial Sequence
  derived and/or modified sequence opt3 from IgG1_HeavyChain_CH1_constant_domain
agcgccuccaccaagggccccucugugcugccucucgcuccaucaaguaaaagcacauccgggggaacugcagcccuugguugccuggucaaggacuacuucccggagcccguuacggugucuuggaacucgggcguacacaccuuuccugcgguguugcagucaagcggguuauauagucuguccucugucgugacaguuccaagcuccucacuaggaacucaaaccuacaucuguaaugugaaccauaaacccaguaauacaaaggucgauaaaagagcu

SEQ ID NO: 30519 - RNA, 330 nt, Artificial Sequence
  derived and/or modified sequence opt3 from IgG1_HeavyChain_CH2_constant_domain
gcccccgagcugcucggcgggccuagcguguuccuuuuuccaccgaagcccaaagacacccugaugaucuccagaacaccugaagucacuugcguugugguagaugugucucacgaggacccagaagucaaguucaacugguacguggauggaguugaggugcauaaugcuaaaacgaagcccagggaggaacaguauaacucaaccuaccgggucgugaguguauugacaguuuuacaccaagacuggcugaaugguaaagaguauaaguguaaggugagcaacaaagcacuaccugccccaauugaaaagacuauauccaaagcgaag

SEQ ID NO: 30520 - RNA, 330 nt, Artificial Sequence
  derived and/or modified sequence opt3 from IgG1_HeavyChain_CH2_constant_domain
gcccccgagcugcucggcgggccuagcguguuccuuuuuccaccgaagcccaaagacacccugaugaucuccagaacaccugaagucacuugcguugugguagaugugucucacgaggacccagaagucaaguucaacguguacguugauggaguggagguccauaaugcuaaaacgaagcccagggaggaacaguauaacucaaccuaccgggugguaaguguuuugacaguguuacaccaagacuggcugaaugguaaagaguauaaguguaaggucagcaacaaagcacuaccugccccaauugaaaagacuauauccaaagcgaag

SEQ ID NO: 30521 - RNA, 330 nt, Artificial Sequence
  derived and/or modified sequence opt3 from IgG1_HeavyChain_CH2_constant_domain
gcccccgagcugcucggcgggccuagcguguuccuuuuuccaccgaagcccaaagacacccugaugaucuccagaacaccugaagucacuugcguugugguagaugugucucacgaggacccagaagucaaguucaacguguacguugauggaguggagguccauaaugcuaaaacgaagcccagggaggaacaguaugcaucaaccuaccgggugguaaguguuuugacaguguuacaccaagacuggcugaacgguaaagaguauaaguguaaggucagcaauaaagcccuaccugcgccaauugaaaagacuauauccaaagcuaag

SEQ ID NO: 30522 - RNA, 330 nt, Artificial Sequence
  derived and/or modified sequence opt3 from IgG1_HeavyChain_CH2_constant_domain
gcccccgagcugcucggcgggccuagcguguuccuuuuuccaccgaagcccaaagacacccugaugaucuccagaacaccugaagucacuugcguugugguagaugugucucacgaggacccagaagucaaguucaacugguacguggauggaguugaggugcauaaugcuaaaacgaagcccagggaggaacaguaugcaucaaccuaccgggucgugaguguauugacaguuuuacaccaagacuggcugaacgguaaagaguauaaguguaaggugagcaauaaagcccuaccugcgccaauugaaaagacuauauccaaagcuaag

SEQ ID NO: 30523 - RNA, 330 nt, Artificial Sequence
  derived and/or modified sequence opt3 from IgG1_HeavyChain_CH2_constant_domain
gcccccgagcugcucggcgcuccuagcguguuccuuuuuccaccgaagcccaaagacacccugaugaucuccagaacaccugaagucacuugcguugugguagaugugucucacgaggacccagaagucaaguucaacguguacguugaugggguggagguccauaaugcaaaaacgaagcccagggaggaacaguauaacucaaccuaccgggugguaaguguuuugacaguguuacaccaagacuggcugaauggaaaagaguauaaguguaaggucagcaacaaagcccuaccugcgccaauugaaaagacuauauccaaagcuaag

SEQ ID NO: 30524 - RNA, 330 nt, Artificial Sequence
  derived and/or modified sequence opt3 from IgG1_HeavyChain_CH2_constant_domain
gcccccgagcugcucggcgcuccuagcguguuccuuuuuccaccgaagcccaaagacacccugaugaucuccagaacaccugaagucacuugcguugugguagaugugucucacgaggacccagaagucaaguucaacguguacguugaugggguggagguccauaaugcaaaaacgaagcccagggaggaacaguaugccucaaccuaccgggugguaaguguuuugacaguguuacaccaagacuggcugaacggaaaagaguauaaguguaaggucagcaauaaagcgcuaccugcuccaauugaaaagacuauauccaaagccaag

SEQ ID NO: 30525 - RNA, 330 nt, Artificial Sequence
  derived and/or modified sequence opt3 from IgG1_HeavyChain_CH2_constant_domain
gcccccgagcugcucggcgcuccuagcguguuccuuuuuccaccgaagcccaaagacacccugaugaucuccagaacaccugaagucacuugcguugugguagaugugucucacgaggacccagaagucaaguucaacugguacguggaugggguugaggugcauaaugcaaaaacgaagcccagggaggaacaguauaacucaaccuaccgggucgugaguguauugacaguuuuacaccaagacuggcugaauggaaaagaguauaaguguaaggugagcaacaaagcccuaccugcgccaauugaaaagacuauauccaaagcuaag

SEQ ID NO: 30526 - RNA, 330 nt, Artificial Sequence
  derived and/or modified sequence opt3 from IgG1_HeavyChain_CH2_constant_domain
gcccccgagcugcucggcgcuccuagcguguuccuuuuuccaccgaagcccaaagacacccugaugaucuccagaacaccugaagucacuugcguugugguagaugugucucacgaggacccagaagucaaguucaacugguacguggaugggguugaggugcauaaugcaaaaacgaagcccagggaggaacaguaugccucaaccuaccgggucgugaguguauugacaguuuuacaccaagacuggcugaacggaaaagaguauaaguguaaggugagcaauaaagcgcuaccugcuccaauugaaaagacuauauccaaagccaag

SEQ ID NO: 30527 - RNA, 330 nt, Artificial Sequence
  derived and/or modified sequence opt3 from IgG1_HeavyChain_CH2_constant_domain
gcccccgagcuggcuggcgggccuagcguguuccucuuuccaccgaagcccaaagacacccuuaugaucuccagaacaccugaagucacuugcguugugguagaugugucucacgaggacccagaagucaaguucaacguguacguugauggaguggagguccauaaugcaaaaacgaagcccagggaggaacaguauaacucaaccuaccgggugguaaguguucugacaguguugcaccaagacugguuaaaugguaaagaguauaaguguaaggucagcaacaaagcccugccugcgccaauugaaaagacuauauccaaagcuaag

SEQ ID NO: 30528 - RNA, 330 nt, Artificial Sequence
  derived and/or modified sequence opt3 from IgG1_HeavyChain_CH2_constant_domain
gcccccgagcuggcuggcgggccuagcguguuccucuuuccaccgaagcccaaagacacccuuaugaucuccagaacaccugaagucacuugcguugugguagaugugucucacgaggacccagaagucaaguucaacguguacguugauggaguggagguccauaaugcaaaaacgaagcccagggaggaacaguaugccucaaccuaccgggugguaaguguucugacaguguugcaccaagacugguuaaacgguaaagaguauaaguguaaggucagcaauaaagcgcugccugcuccaauugaaaagacuauauccaaagccaag

SEQ ID NO: 30529 - RNA, 330 nt, Artificial Sequence
  derived and/or modified sequence opt3 from IgG1_HeavyChain_CH2_constant_domain
gcccccgagcuggcuggcgggccuagcguguuccucuuuccaccgaagcccaaagacacccuuaugaucuccagaacaccugaagucacuugcguugugguagaugugucucacgaggacccagaagucaaguucaacugguacguggauggaguugaggugcauaaugcaaaaacgaagcccagggaggaacaguauaacucaaccuaccgggucgugaguguacugacaguuuugcaccaagacugguuaaaugguaaagaguauaaguguaaggugagcaacaaagcccugccugcgccaauugaaaagacuauauccaaagcuaag

SEQ ID NO: 30530 - RNA, 330 nt, Artificial Sequence
  derived and/or modified sequence opt3 from IgG1_HeavyChain_CH2_constant_domain
gcccccgagcuggcuggcgggccuagcguguuccucuuuccaccgaagcccaaagacacccuuaugaucuccagaacaccugaagucacuugcguugugguagaugugucucacgaggacccagaagucaaguucaacugguacguggauggaguugaggugcauaaugcaaaaacgaagcccagggaggaacaguaugccucaaccuaccgggucgugaguguacugacaguuuugcaccaagacugguuaaacgguaaagaguauaaguguaaggugagcaauaaagcgcugccugcuccaauugaaaagacuauauccaaagccaag

SEQ ID NO: 30531 - RNA, 330 nt, Artificial Sequence
  derived and/or modified sequence opt3 from IgG1_HeavyChain_CH2_constant_domain
gcccccgagcuggcuggcgcaccuagcguguuccucuuuccaccgaagcccaaagacacccuuaugaucuccagaacaccugaagucacuugcguugugguagaugugucucacgaggacccagaagucaaguucaacguguacguugaugggguggagguccauaaugccaaaacgaagcccagggaggaacaguauaacucaaccuaccgggugguaaguguucugacaguguugcaccaagacugguuaaauggaaaagaguauaaguguaaggucagcaacaaagcgcugccugcuccaauugaaaagacuauauccaaagccaag

SEQ ID NO: 30532 - RNA, 330 nt, Artificial Sequence
  derived and/or modified sequence opt3 from IgG1_HeavyChain_CH2_constant_domain
gcccccgagcuggcuggcgcaccuagcguguuccucuuuccaccgaagcccaaagacacccuuaugaucuccagaacaccugaagucacuugcguugugguagaugugucucacgaggacccagaagucaaguucaacguguacguugaugggguggagguccauaaugccaaaacgaagcccagggaggaacaguaugcgucaaccuaccgggugguaaguguucugacaguguugcaccaagacugguuaaacggaaaagaguauaaguguaaggucagcaauaaagcucugccugccccaauugaaaagacuauauccaaagcaaag

SEQ ID NO: 30533 - RNA, 330 nt, Artificial Sequence
  derived and/or modified sequence opt3 from IgG1_HeavyChain_CH2_constant_domain
gcccccgagcuggcuggcgcaccuagcguguuccucuuuccaccgaagcccaaagacacccuuaugaucuccagaacaccugaagucacuugcguugugguagaugugucucacgaggacccagaagucaaguucaacugguacguggaugggguugaggugcauaaugccaaaacgaagcccagggaggaacaguauaacucaaccuaccgggucgugaguguacugacaguuuugcaccaagacugguuaaauggaaaagaguauaaguguaaggugagcaacaaagcgcugccugcuccaauugaaaagacuauauccaaagccaag

SEQ ID NO: 30534 - RNA, 330 nt, Artificial Sequence
  derived and/or modified sequence opt3 from IgG1_HeavyChain_CH2_constant_domain
gcccccgagcuggcuggcgcaccuagcguguuccucuuuccaccgaagcccaaagacacccuuaugaucuccagaacaccugaagucacuugcguugugguagaugugucucacgaggacccagaagucaaguucaacugguacguggaugggguugaggugcauaaugccaaaacgaagcccagggaggaacaguaugcgucaaccuaccgggucgugaguguacugacaguuuugcaccaagacugguuaaacggaaaagaguauaaguguaaggugagcaauaaagcucugccugccccaauugaaaagacuauauccaaagcaaag

SEQ ID NO: 30535 - RNA, 330 nt, Artificial Sequence
  derived and/or modified sequence opt3 from IgG1_HeavyChain_CH2_constant_domain
gcccccgaggcucugggcgggccuagcguguuccucuuuccaccgaagcccaaagacacccuuaugaucuccagaacaccugaagucacuugcguugugguagaugugucucacgaggacccagaagucaaguucaacguguacguugauggaguggagguccauaaugcaaaaacgaagcccagggaggaacaguauaacucaaccuaccgggugguaaguguucugacaguguugcaccaagacugguuaaaugguaaagaguauaaguguaaggucagcaacaaagcccugccugcgccaauugaaaagacuauauccaaagcuaag

SEQ ID NO: 30536 - RNA, 330 nt, Artificial Sequence
  derived and/or modified sequence opt3 from IgG1_HeavyChain_CH2_constant_domain
gcccccgaggcucugggcgggccuagcguguuccucuuuccaccgaagcccaaagacacccuuaugaucuccagaacaccugaagucacuugcguugugguagaugugucucacgaggacccagaagucaaguucaacguguacguugauggaguggagguccauaaugcaaaaacgaagcccagggaggaacaguaugccucaaccuaccgggugguaaguguucugacaguguugcaccaagacugguuaaacgguaaagaguauaaguguaaggucagcaauaaagcgcugccugcuccaauugaaaagacuauauccaaagccaag

SEQ ID NO: 30537 - RNA, 330 nt, Artificial Sequence
  derived and/or modified sequence opt3 from IgG1_HeavyChain_CH2_constant_domain
gcccccgaggcucugggcgggccuagcguguuccucuuuccaccgaagcccaaagacacccuuaugaucuccagaacaccugaagucacuugcguugugguagaugugucucacgaggacccagaagucaaguucaacugguacguggauggaguugaggugcauaaugcaaaaacgaagcccagggaggaacaguauaacucaaccuaccgggucgugaguguacugacaguuuugcaccaagacugguuaaaugguaaagaguauaaguguaaggugagcaacaaagcccugccugcgccaauugaaaagacuauauccaaagcuaag

SEQ ID NO: 30538 - RNA, 330 nt, Artificial Sequence
  derived and/or modified sequence opt3 from IgG1_HeavyChain_CH2_constant_domain
gcccccgaggcucugggcgggccuagcguguuccucuuuccaccgaagcccaaagacacccuuaugaucuccagaacaccugaagucacuugcguugugguagaugugucucacgaggacccagaagucaaguucaacugguacguggauggaguugaggugcauaaugcaaaaacgaagcccagggaggaacaguaugccucaaccuaccgggucgugaguguacugacaguuuugcaccaagacugguuaaacgguaaagaguauaaguguaaggugagcaauaaagcgcugccugcuccaauugaaaagacuauauccaaagccaag

SEQ ID NO: 30539 - RNA, 330 nt, Artificial Sequence
  derived and/or modified sequence opt3 from IgG1_HeavyChain_CH2_constant_domain
gcccccgaggcucugggcgcaccuagcguguuccucuuuccaccgaagcccaaagacacccuuaugaucuccagaacaccugaagucacuugcguugugguagaugugucucacgaggacccagaagucaaguucaacguguacguugaugggguggagguccauaaugccaaaacgaagcccagggaggaacaguauaacucaaccuaccgggugguaaguguucugacaguguugcaccaagacugguuaaauggaaaagaguauaaguguaaggucagcaacaaagcgcugccugcuccaauugaaaagacuauauccaaagccaag

SEQ ID NO: 30540 - RNA, 330 nt, Artificial Sequence
  derived and/or modified sequence opt3 from IgG1_HeavyChain_CH2_constant_domain
gcccccgaggcucugggcgcaccuagcguguuccucuuuccaccgaagcccaaagacacccuuaugaucuccagaacaccugaagucacuugcguugugguagaugugucucacgaggacccagaagucaaguucaacguguacguugaugggguggagguccauaaugccaaaacgaagcccagggaggaacaguaugcgucaaccuaccgggugguaaguguucugacaguguugcaccaagacugguuaaacggaaaagaguauaaguguaaggucagcaauaaagcucugccugccccaauugaaaagacuauauccaaagcaaag

SEQ ID NO: 30541 - RNA, 330 nt, Artificial Sequence
  derived and/or modified sequence opt3 from IgG1_HeavyChain_CH2_constant_domain
gcccccgaggcucugggcgcaccuagcguguuccucuuuccaccgaagcccaaagacacccuuaugaucuccagaacaccugaagucacuugcguugugguagaugugucucacgaggacccagaagucaaguucaacugguacguggaugggguugaggugcauaaugccaaaacgaagcccagggaggaacaguauaacucaaccuaccgggucgugaguguacugacaguuuugcaccaagacugguuaaauggaaaagaguauaaguguaaggugagcaacaaagcgcugccugcuccaauugaaaagacuauauccaaagccaag

SEQ ID NO: 30542 - RNA, 330 nt, Artificial Sequence
  derived and/or modified sequence opt3 from IgG1_HeavyChain_CH2_constant_domain
gcccccgaggcucugggcgcaccuagcguguuccucuuuccaccgaagcccaaagacacccuuaugaucuccagaacaccugaagucacuugcguugugguagaugugucucacgaggacccagaagucaaguucaacugguacguggaugggguugaggugcauaaugccaaaacgaagcccagggaggaacaguaugcgucaaccuaccgggucgugaguguacugacaguuuugcaccaagacugguuaaacggaaaagaguauaaguguaaggugagcaauaaagcucugccugccccaauugaaaagacuauauccaaagcaaag

SEQ ID NO: 30543 - RNA, 330 nt, Artificial Sequence
  derived and/or modified sequence opt3 from IgG1_HeavyChain_CH2_constant_domain
gcccccgaggcugcaggcgggccuagcguguuccuguuuccaccgaagcccaaagacacccucaugaucuccagaacaccugaagucacuugcguugugguagaugugucucacgaggacccagaagucaaguucaacguguacguugauggaguggagguccauaaugccaaaacgaagcccagggaggaacaguauaacucaaccuaccgggugguaaguguucuuacagugcugcaccaagacugguugaaugguaaagaguauaaguguaaggucagcaacaaagcguuaccugcuccaauugaaaagacuauauccaaagccaag

SEQ ID NO: 30544 - RNA, 330 nt, Artificial Sequence
  derived and/or modified sequence opt3 from IgG1_HeavyChain_CH2_constant_domain
gcccccgaggcugcaggcgggccuagcguguuccuguuuccaccgaagcccaaagacacccucaugaucuccagaacaccugaagucacuugcguugugguagaugugucucacgaggacccagaagucaaguucaacguguacguugauggaguggagguccauaaugccaaaacgaagcccagggaggaacaguaugcgucaaccuaccgggugguaaguguucuuacagugcugcaccaagacugguugaacgguaaagaguauaaguguaaggucagcaauaaagccuuaccugcuccaauugaaaagacuauauccaaagcaaag

SEQ ID NO: 30545 - RNA, 330 nt, Artificial Sequence
  derived and/or modified sequence opt3 from IgG1_HeavyChain_CH2_constant_domain
gcccccgaggcugcaggcgggccuagcguguuccuguuuccaccgaagcccaaagacacccucaugaucuccagaacaccugaagucacuugcguugugguagaugugucucacgaggacccagaagucaaguucaacugguacguggauggaguugaggugcauaaugccaaaacgaagcccagggaggaacaguauaacucaaccuaccgggucgugaguguacuuacaguucugcaccaagacugguugaaugguaaagaguauaaguguaaggugagcaacaaagcguuaccugcuccaauugaaaagacuauauccaaagccaag

SEQ ID NO: 30546 - RNA, 330 nt, Artificial Sequence
  derived and/or modified sequence opt3 from IgG1_HeavyChain_CH2_constant_domain
gcccccgaggcugcaggcgggccuagcguguuccuguuuccaccgaagcccaaagacacccucaugaucuccagaacaccugaagucacuugcguugugguagaugugucucacgaggacccagaagucaaguucaacugguacguggauggaguugaggugcauaaugccaaaacgaagcccagggaggaacaguaugcgucaaccuaccgggucgugaguguacuuacaguucugcaccaagacugguugaacgguaaagaguauaaguguaaggugagcaauaaagccuuaccugcuccaauugaaaagacuauauccaaagcaaag

SEQ ID NO: 30547 - RNA, 330 nt, Artificial Sequence
  derived and/or modified sequence opt3 from IgG1_HeavyChain_CH2_constant_domain
gcccccgaggcugcaggcgccccuagcguguuccuguuuccaccgaagcccaaagacacccucaugaucuccagaacaccugaagucacuugcguugugguagaugugucucacgaggacccagaagucaaguucaacguguacguugaugggguggagguccauaaugcgaaaacgaagcccagggaggaacaguauaacucaaccuaccgggugguaaguguucuuacagugcugcaccaagacugguugaauggaaaagaguauaaguguaaggucagcaacaaagccuuaccugcuccaauugaaaagacuauauccaaagcaaag

SEQ ID NO: 30548 - RNA, 330 nt, Artificial Sequence
  derived and/or modified sequence opt3 from IgG1_HeavyChain_CH2_constant_domain
gcccccgaggcugcaggcgccccuagcguguuccuguuuccaccgaagcccaaagacacccucaugaucuccagaacaccugaagucacuugcguugugguagaugugucucacgaggacccagaagucaaguucaacguguacguugaugggguggagguccauaaugcgaaaacgaagcccagggaggaacaguaugcuucaaccuaccgggugguaaguguucuuacagugcugcaccaagacugguugaacggaaaagaguauaaguguaaggucagcaauaaagccuuaccugcaccaauugaaaagacuauauccaaagccaag

SEQ ID NO: 30549 - RNA, 330 nt, Artificial Sequence
  derived and/or modified sequence opt3 from IgG1_HeavyChain_CH2_constant_domain
gcccccgaggcugcaggcgccccuagcguguuccuguuuccaccgaagcccaaagacacccucaugaucuccagaacaccugaagucacuugcguugugguagaugugucucacgaggacccagaagucaaguucaacugguacguggaugggguugaggugcauaaugcgaaaacgaagcccagggaggaacaguauaacucaaccuaccgggucgugaguguacuuacaguucugcaccaagacugguugaauggaaaagaguauaaguguaaggugagcaacaaagccuuaccugcuccaauugaaaagacuauauccaaagcaaag

SEQ ID NO: 30550 - RNA, 330 nt, Artificial Sequence
  derived and/or modified sequence opt3 from IgG1_HeavyChain_CH2_constant_domain
gcccccgaggcugcaggcgccccuagcguguuccuguuuccaccgaagcccaaagacacccucaugaucuccagaacaccugaagucacuugcguugugguagaugugucucacgaggacccagaagucaaguucaacugguacguggaugggguugaggugcauaaugcgaaaacgaagcccagggaggaacaguaugcuucaaccuaccgggucgugaguguacuuacaguucugcaccaagacugguugaacggaaaagaguauaaguguaaggugagcaauaaagccuuaccugcaccaauugaaaagacuauauccaaagccaag

SEQ ID NO: 30551 - RNA, 318 nt, Artificial Sequence
  derived and/or modified sequence opt3 from IgG1_HeavyChain_CH3_constant_domain
ggccagcccagagagccucaaguguacacccugccaccgagcagggaagagaugacaaagaaccaggucucccucacuugccuuguuaaaggguucuaucccucugacaucgccguggaaugggagucaaauggacagccugaaaacaauuacaagacgaccccacccguacuggauagugacgguagcuuuuucuuguauuccaaauuaacaguggauaagucucgguggcagcaaggcaacgucuuuucguguucagugaugcacgaggcucugcauaaucacuacacucagaaaagccuaagucucuccccuggg

SEQ ID NO: 30552 - RNA, 318 nt, Artificial Sequence
  derived and/or modified sequence opt3 from IgG1_HeavyChain_CH3_constant_domain
ggccagcccagagagccucaaguguacacccugccaccgagcagggaggaacucacaaagaaccaggucucccuuacuugccugguuaaaggguucuaucccucugacaucgccguggaaugggagucaaauggacagccugaaaacaauuacaagacgaccccacccguauuggauagugacgguagcuuuuucuuauauuccaaacugacaguggauaagucucgguggcagcaaggcaacgucuuuucguguucagugaugcacgaggcucuacauaaucacuacacucagaaaagccucagucuguccccuggg

SEQ ID NO: 30553 - RNA, 318 nt, Artificial Sequence
  derived and/or modified sequence opt3 from IgG1_HeavyChain_CH3_constant_domain
ggccagcccagagagccucaaguguacacccugccaccgagcagggacgaaaugacaaagaaccaggucucccucacuugccuuguuaaaggguucuaucccucugauaucgccguggagugggaaucaaauggacagccugagaacaauuacaagacgaccccacccguacuggacagugaugguagcuuuuucuuguauuccaaauuaacaguggacaagucucgguggcagcaaggcaacgucuuuucguguucagugaugcacgaagcucugcauaaucacuacacucagaaaagccuaagucucuccccuggg

SEQ ID NO: 30554 - RNA, 318 nt, Artificial Sequence
  derived and/or modified sequence opt3 from IgG1_HeavyChain_CH3_constant_domain
ggccagcccagagagccucaaguguacacccugccaccgagcagggacgaacucacaaagaaccaggucucccuuacuugccugguuaaaggguucuaucccucugauaucgccguggagugggaaucaaauggacagccugagaacaauuacaagacgaccccacccguauuggacagugaugguagcuuuuucuuauauuccaaacugacaguggacaagucucgguggcagcaaggcaacgucuuuucguguucagugaugcacgaagcucuacauaaucacuacacucagaaaagccucagucuguccccuggg

SEQ ID NO: 30555 - RNA, 297 nt, Artificial Sequence
  derived and/or modified sequence opt3 from IgG2_HeavyChain_CH1_constant_domain
agcgccuccaccaagggccccucuguguucccucuggcuccaugcucaagaaguacaagcgaguccacugcagcccucgggugucuugucaaagacuacuuuccggaacccguuacggugucuuggaacucgggagcgcugaccucagguguacacacauucccugcuguguugcagagcaguggcuuauacucccugucuagcgucgugacuguuccauccucaaauuuugggacccaaacauauaccugcaacguggaucauaagcccaguaauacuaaagucgacaagacagug

SEQ ID NO: 30556 - RNA, 297 nt, Artificial Sequence
  derived and/or modified sequence opt3 from IgG2_HeavyChain_CH1_constant_domain
agcgccuccaccaagggccccucuguguucccucuggcuccaugcucaagaaguacaagcgaguccacugcagcccucgggugucuugucaaagacuacuuuccggaacccguuacggugucuuggaacucgggagcgcugaccucagguguacacacauucccugcuguguugcagagcaguggcuuauauucccugucuagcgucgugacuguuaccuccucaaauuuugggacacaaaccuacacuugcaacguggaucauaagccaaguaauacaaaagucgacaagaccgug

SEQ ID NO: 30557 - RNA, 327 nt, Artificial Sequence
  derived and/or modified sequence opt3 from IgG2_HeavyChain_CH2_constant_domain
gcucccccuguggccggcccaagcgucuuccuguuuccgcccaagccuaaagacacccucaugaucuccagaacaccagagguuacuugcgugguaguggaugucucucacgaagaccccgaggugcaguucaacugguacguugaugggguggaaguccauaaugcaaagacgaaaccuagggaggaacaauuuaacucaaccuuccgggugguaaguguucuuacagugguccaccaggacuggcugaauggaaaggaguauaaauguaaggugagcaacaaggguuugccagcccccauugagaaaacuauauccaagaccaaa

SEQ ID NO: 30558 - RNA, 327 nt, Artificial Sequence
  derived and/or modified sequence opt3 from IgG2_HeavyChain_CH2_constant_domain
gcucccccuguggccggcccaagcgucuuccuguuuccgcccaagccuaaagacacccucaugaucuccagaacaccagagguuacuugcgugguaguggaugucucucacgaagaccccgaggugcaguucaacugguacguugaugggguggaaguccauaaugcaaagacgaaaccuagggaggaacaauuuaacucaaccuuccgggugguaaguguucuuacagugguccaccaggacuggcugaauggaaaggaguauaaauguaaggugagcaacaaggguuugccagccuccauugagaaaacuauaucuaagaccaaa

SEQ ID NO: 30559 - RNA, 327 nt, Artificial Sequence
  derived and/or modified sequence opt3 from IgG2_HeavyChain_CH2_constant_domain
gcucccccuguggccggcccaagcgucuuccuguuuccgcccaagccuaaagacacccucaugaucuccagaacaccagagguuacuugcgugguaguggaugucucucacgaagaccccgaggugcaguucaacugguacguugaugggguggaaguccauaaugcaaagacgaaaccuagggaggaacaauuuaacucaaccuuccgggugguaaguguucuuacagugguccaccaggacuggcugaauggaaaggaguauaaauguaaggugagcaacaaggguuugccaucccccauugagaaaacuauaucuaagaccaaa

SEQ ID NO: 30560 - RNA, 327 nt, Artificial Sequence
  derived and/or modified sequence opt3 from IgG2_HeavyChain_CH2_constant_domain
gcucccccuguggccggcccaagcgucuuccuguuuccgcccaagccuaaagacacccucaugaucuccagaacaccagagguuacuugcgugguaguggaugucucucacgaagaccccgaggugcaguucaacugguacguugaugggguggaaguccauaaugcaaagacgaaaccuagggaggaacaauuuaacucaaccuuccgggugguaaguguucuuacagugguccaccaggacuggcugaauggaaaggaguauaaauguaaggugagcaacaaggguuugccauccucuauugagaaaacuauaucgaagaccaaa

SEQ ID NO: 30561 - RNA, 327 nt, Artificial Sequence
  derived and/or modified sequence opt3 from IgG2_HeavyChain_CH2_constant_domain
gcucccccuguggccggcccaagcgucuuccuguuuccgcccaagccuaaagacacccucaugaucuccagaacaccagagguuacuugcgugguaguggaugucucucacgaagaccccgaggugcaguucaacugguacguugaugggauggaagugcauaaugcaaagacgaaaccuagggaggaacaauuuaacucaaccuuccgggucgugaguguacuuacaguugugcaccaggacuggcugaauggaaaggaguauaaauguaaggucagcaacaaggguuugccagcccccauugagaaaacuauauccaagaccaaa

SEQ ID NO: 30562 - RNA, 327 nt, Artificial Sequence
  derived and/or modified sequence opt3 from IgG2_HeavyChain_CH2_constant_domain
gcucccccuguggccggcccaagcgucuuccuguuuccgcccaagccuaaagacacccucaugaucuccagaacaccagagguuacuugcgugguaguggaugucucucacgaagaccccgaggugcaguucaacugguacguugaugggauggaagugcauaaugcaaagacgaaaccuagggaggaacaauuuaacucaaccuuccgggucgugaguguacuuacaguugugcaccaggacuggcugaauggaaaggaguauaaauguaaggucagcaacaaggguuugccagccuccauugagaaaacuauaucuaagaccaaa

SEQ ID NO: 30563 - RNA, 327 nt, Artificial Sequence
  derived and/or modified sequence opt3 from IgG2_HeavyChain_CH2_constant_domain
gcucccccuguggccggcccaagcgucuuccuguuuccgcccaagccuaaagacacccucaugaucuccagaacaccagagguuacuugcgugguaguggaugucucucacgaagaccccgaggugcaguucaacugguacguugaugggauggaagugcauaaugcaaagacgaaaccuagggaggaacaauuuaacucaaccuuccgggucgugaguguacuuacaguugugcaccaggacuggcugaauggaaaggaguauaaauguaaggucagcaacaaggguuugccaucccccauugagaaaacuauaucuaagaccaaa

SEQ ID NO: 30564 - RNA, 327 nt, Artificial Sequence
  derived and/or modified sequence opt3 from IgG2_HeavyChain_CH2_constant_domain
gcucccccuguggccggcccaagcgucuuccuguuuccgcccaagccuaaagacacccucaugaucuccagaacaccagagguuacuugcgugguaguggaugucucucacgaagaccccgaggugcaguucaacugguacguugaugggauggaagugcauaaugcaaagacgaaaccuagggaggaacaauuuaacucaaccuuccgggucgugaguguacuuacaguugugcaccaggacuggcugaauggaaaggaguauaaauguaaggucagcaacaaggguuugccauccucuauugagaaaacuauaucgaagaccaaa

SEQ ID NO: 30565 - RNA, 318 nt, Artificial Sequence
  derived and/or modified sequence opt3 from IgG2_HeavyChain_CH3_constant_domain
ggccagcccagagagccucaaguguacacccugccaccgagcagggaagagaugacaaagaaccaggucucccucacuugccuuguuaaaggguucuaucccucugacaucgccguggaaugggagucaaauggacagccugaaaacaauuacaagacgaccccacccaugcuggauagugacgguagcuuuuucuuguauuccaaauuaacaguagauaagucucgguggcagcaaggcaacguguuuucguguucagucaugcacgaggcucugcauaaucacuacacucagaaaagccuaagucucuccccuggg

SEQ ID NO: 30566 - RNA, 297 nt, Artificial Sequence
  derived and/or modified sequence opt3 from IgG4_HeavyChain_CH1_constant_domain
agcgccuccaccaagggccccucuguguucccucuggcuccaugcucaagaaguacaagcgaguccacugcagcccucgggugucuugucaaagacuacuuuccggaacccguuacggugucuuggaacucgggagcgcugaccucagguguacacacauucccugcuguguugcagagcaguggcuuauacucccugucuagcgucgugacuguuccauccucaagucuagggaccaagacauauaccugcaauguggaucauaaacccagcaacacuaaggucgacaaaagggug

SEQ ID NO: 30567 - RNA, 330 nt, Artificial Sequence
  derived and/or modified sequence opt3 from IgG4_HeavyChain_CH2_constant_domain
gcccccgaguuccugggcgggccuagcguguuucucuucccaccgaagcccaaagacacccuuaugaucuccagaacaccugaagucacuugcguugugguagaugugucucaggaggacccagaaguccaauuuaacugguacguggauggaguugaggugcacaaugcuaagacgaaacccagggaagaacaguucaacucaaccuaucgggucgugaguguacugacaguuuugcaucaggacugguuaaaugguaaggaguacaaauguaaggugagcaacaagggccugccuuccucuauugagaaaacuauaucgaaggcaaaa

SEQ ID NO: 30568 - RNA, 318 nt, Artificial Sequence
  derived and/or modified sequence opt3 from IgG4_HeavyChain_CH3_constant_domain
ggccagcccagagagccucagguguacacccugccaccgagccaggaagagaugacaaagaaccaggucucccucacuugccuuguuaaaggguucuaucccucugacaucgccguggaaugggagucaaauggacagccugaaaacaauuacaagacgaccccacccguacuggauagugacgguagcuuuuucuuguauuccagguuaacaguggauaaaucucgguggcaagagggcaacgucuuuucguguucagugaugcacgaggcucugcauaaucacuacacucaaaagagccuaagucucucccugggg

SEQ ID NO: 30569 - RNA, 1347 nt, Artificial Sequence
  derived and/or modified sequence opt4 from AAB-003_gamma1-Chain
gaggugcagcugcuggagagcggcggcggccuggugcagcccggcggcagccugagacugagcugcgccgccagcggcuucaccuucagcaacuacggcaugagcugggugagacaggcccccggcaagggccuggaguggguggccagcaucagaagcggcggcggcagaaccuacuacagcgacaacgugaagggcagauucaccaucagcagagacaacagcaagaacacccuguaccugcagaugaacagccugagagccgaggacaccgccguguacuacugcgugagauacgaccacuacagcggcagcagcgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgaggccgccggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30570 - RNA, 1329 nt, Artificial Sequence
  derived and/or modified sequence opt4 from Abagovomab_HeavyChain
caggugaagcugcaggagagcggcgccgagcuggccagacccggcgccagcgugaagcugagcugcaaggccagcggcuacaccuucaccaacuacuggaugcagugggugaagcagagacccggccagggccuggacuggaucggcgccaucuaccccggcgacggcaacaccagauacacccacaaguucaagggcaaggccacccugaccgccgacaagagcagcagcaccgccuacaugcagcugagcagccuggccagcgaggacagcggcguguacuacugcgccagaggcgagggcaacuacgccugguucgccuacuggggccagggcaccaccgugaccgugagcagcgccaagaccaccccccccagcguguacccccuggcccccggcagcgccgcccagaccaacagcauggugacccugggcugccuggugaagggcuacuuccccgagcccgugaccgugaccuggaacagcggcagccugagcagcggcgugcacaccuuccccgccgugcugcagagcgaccuguacacccugagcagcagcgugaccgugcccagcagcaccuggcccagcgagaccgugaccugcaacguggcccaccccgccagcagcaccaagguggacaagaagaucgugcccagagacugcggcugcaagcccugcaucugcaccgugcccgaggugagcagcguguucaucuucccccccaagcccaaggacgugcugaccaucacccugacccccaaggugaccugcguggugguggacaucagcaaggacgaccccgaggugcaguucagcugguucguggacgacguggaggugcacaccgcccagacccagcccagagaggagcaguucaacagcaccuucagaagcgugagcgagcugcccaucaugcaccaggacuggcugaacggcaaggaguucaagugcagagugaacagcgccgccuuccccgcccccaucgagaagaccaucagcaagaccaagggcagacccaaggccccccagguguacaccauccccccccccaaggagcagauggccaaggacaaggugagccugaccugcaugaucaccgacuucuuccccgaggacaucaccguggaguggcaguggaacggccagcccgccgagaacuacaagaacacccagcccaucauggacaccgacggcagcuacuucguguacagcaagcugaacgugcagaagagcaacugggaggccggcaacaccuucaccugcagcgugcugcacgagggccugcacaaccaccacaccgagaagagccugagccacagccccggcaag

SEQ ID NO: 30571 - RNA, 642 nt, Artificial Sequence
  derived and/or modified sequence opt4 from Abagovomab_LightChain
gacaucgagcugacccagagccccgccagccugagcgccagcgugggcgagaccgugaccaucaccugccaggccagcgagaacaucuacagcuaccuggccuggcaccagcagaagcagggcaagagcccccagcugcugguguacaacgccaagacccuggccggcggcgugagcagcagauucagcggcagcggcagcggcacccacuucagccugaagaucaagagccugcagcccgaggacuucggcaucuacuacugccagcaccacuacggcauccugcccaccuucggcggcggcaccaagcuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagugc

SEQ ID NO: 30572 - RNA, 1350 nt, Artificial Sequence
  derived and/or modified sequence opt4 from Abciximab_HeavyChain
gaggugcagcugcagcagagcggcgccgagcuggugaagcccggcgccagcgugaagcugagcugcaccgccagcggcuucaacaucaaggacaccuacgugcacugggugaagcagagacccgagcagggccuggaguggaucggcagaaucgaccccgccaacggcuacaccaaguacgaccccaaguuccagggcaaggccaccaucaccgccgacaccagcagcaacaccgccuaccugcagcugagcagccugaccagcgaggacaccgccguguacuacugcgugagaccccuguacgacuacuacgccauggacuacuggggccagggcaccagcgugaccgugagcagcgccaagaccaccgcccccagcguguacccccuggcccccgugugcggcgacaccaccggcagcagcgugacccugggcugccuggugaagggcuacuuccccgagcccgugacccugaccuggaacagcggcagccugagcagcggcgugcacaccuuccccgccgugcugcagagcgaccuguacacccugagcagcagcgugaccgugaccagcagcaccuggcccagccagagcaucaccugcaacguggcccaccccgccagcagcaccaagguggacaagaagaucgagcccagacccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30573 - RNA, 642 nt, Artificial Sequence
  derived and/or modified sequence opt4 from Abciximab_LightChain
gacauccugaugacccagagccccagcagcaugagcgugagccugggcgacaccgugagcaucaccugccacgccagccagggcaucagcagcaacaucggcuggcugcagcagaagcccggcaagagcuucaugggccugaucuacuacggcaccaaccugguggacggcgugcccagcagauucagcggcagcggcagcggcgccgacuacagccugaccaucagcagccuggacagcgaggacuucgccgacuacuacugcgugcaguacgcccagcugcccuacaccuucggcggcggcaccaagcuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagugc

SEQ ID NO: 30574 - RNA, 1341 nt, Artificial Sequence
  derived and/or modified sequence opt4 from Abituzumab_HeavyChain1
caggugcagcugcagcagagcggcggcgagcuggccaagcccggcgccagcgugaaggugagcugcaaggccagcggcuacaccuucagcagcuucuggaugcacugggugagacaggcccccggccagggccuggaguggaucggcuacaucaaccccagaagcggcuacaccgaguacaacgagaucuucagagacaaggccaccaugaccaccgacaccagcaccagcaccgccuacauggagcugagcagccugagaagcgaggacaccgccguguacuacugcgccagcuuccugggcagaggcgccauggacuacuggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagcccaagagcagcgacaagacccacaccugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaggcccagagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30575 - RNA, 642 nt, Artificial Sequence
  derived and/or modified sequence opt4 from Abituzumab_LightChain1
gacauccagaugacccagagccccagcagccugagcgccagcgugggcgacagagugaccaucaccugcagagccagccaggacaucagcaacuaccuggccugguaccagcagaagcccggcaaggcccccaagcugcugaucuacuacaccagcaagauccacagcggcgugcccagcagauucagcggcagcggcagcggcaccgacuacaccuucaccaucagcagccugcagcccgaggacaucgccaccuacuacugccagcagggcaacaccuuccccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30576 - RNA, 1332 nt, Artificial Sequence
  derived and/or modified sequence opt4 from Abrilumab_HeavyChain1
caggugcagcuggugcagagcggcgccgaggugaagaagcccggcgccagcgugaaggugagcugcaaggugagcggcuacacccugagcgaccugagcauccacugggugagacaggcccccggcaagggccuggaguggaugggcggcuucgacccccaggacggcgagaccaucuacgcccagaaguuccagggcagagugaccaugaccgaggacaccagcaccgacaccgccuacauggagcugagcagccugaagagcgaggacaccgccguguacuacugcgccaccggcagcagcagcagcugguucgaccccuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30577 - RNA, 642 nt, Artificial Sequence
  derived and/or modified sequence opt4 from Abrilumab_LightChain1
gacauccagaugacccagagccccagcagcgugagcgccagcgugggcgacagagugaccaucaccugcagagccagccagggcaucagcagcuggcuggccugguaccagcagaagcccggcaaggcccccaagcugcugaucuacggcgccagcaaccuggagagcggcgugcccagcagauucagcggcagcggcagcggcaccgacuucacccugaccaucagcagccugcagcccgaggacuucgccaacuacuacugccagcaggccaacagcuuccccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30578 - RNA, 639 nt, Artificial Sequence
  derived and/or modified sequence opt4 from Abrilumab_LightChain1_variant2
cagaucgugcugacccagagccccgccaucaugagcgccagccccggcgagaaggugaccaucaccugcagcgccagcagcagcgugagcuacaugaacugguuccagcagaagcccggcaccagccccaagcuguggaucuacagcaccagcaaccuggccagcggcgugcccgccagauucagcggcagcggcagcggcaccagcuacagccugaccaucagcagaauggaggccgaggacgccgccaccuacuacugccagcagagaagcagcuaccccaacaccuucggcggcggcaccaagcuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagugc

SEQ ID NO: 30579 - RNA, 1347 nt, Artificial Sequence
  derived and/or modified sequence opt4 from Actoxumab_HeavyChain1
gaggugcagcuggugcagagcggcgccgaggugaagaagagcggcgagagccugaagaucagcugcaagggcagcggcuacagcuucaccagcuacuggaucggcugggugagacagaugcccggcaagggccuggaguggaugggcaucuucuaccccggcgacagcagcaccagauacagccccagcuuccagggccaggugaccaucagcgccgacaagagcgugaacaccgccuaccugcaguggagcagccugaaggccagcgacaccgccauguacuacugcgccagaagaagaaacuggggcaacgccuucgacaucuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30580 - RNA, 645 nt, Artificial Sequence
  derived and/or modified sequence opt4 from Actoxumab_LightChain1
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagcaccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30581 - RNA, 672 nt, Artificial Sequence
  derived and/or modified sequence opt4 from Adalimumab_HeavyChain
gaggugcagcugguggagagcggcggcggccuggugcagcccggcagaagccugagacugagcugcgccgccagcggcuucaccuucgacgacuacgccaugcacugggugagacaggcccccggcaagggccuggagugggugagcgccaucaccuggaacagcggccacaucgacuacgccgacagcguggagggcagauucaccaucagcagagacaacgccaagaacagccuguaccugcagaugaacagccugagagccgaggacaccgccguguacuacugcgccaaggugagcuaccugagcaccgccagcagccuggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugc

SEQ ID NO: 30582 - RNA, 642 nt, Artificial Sequence
  derived and/or modified sequence opt4 from Adalimumab_LightChain
gacauccagaugacccagagccccagcagccugagcgccagcgugggcgacagagugaccaucaccugcagagccagccagggcaucagaaacuaccuggccugguaccagcagaagcccggcaaggcccccaagcugcugaucuacgccgccagcacccugcagagcggcgugcccagcagauucagcggcagcggcagcggcaccgacuucacccugaccaucagcagccugcagcccgaggacguggccaccuacuacugccagagauacaacagagcccccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30583 - RNA, 1359 nt, Artificial Sequence
  derived and/or modified sequence opt4 from Aducanumab_HeavyChain1
caggugcagcugguggagagcggcggcggcguggugcagcccggcagaagccugagacugagcugcgccgccagcggcuucgccuucagcagcuacggcaugcacugggugagacaggcccccggcaagggccuggaguggguggccgugaucugguucgacggcaccaagaaguacuacaccgacagcgugaagggcagauucaccaucagcagagacaacagcaagaacacccuguaccugcagaugaacacccugagagccgaggacaccgccguguacuacugcgccagagacagaggcaucggcgccagaagaggccccuacuacauggacguguggggcaagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30584 - RNA, 642 nt, Artificial Sequence
  derived and/or modified sequence opt4 from Aducanumab_LightChain1
gacauccagaugacccagagccccagcagccugagcgccagcgugggcgacagagugaccaucaccugcagagccagccagagcaucagcagcuaccugaacugguaccagcagaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuacugccagcagagcuacagcaccccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30585 - RNA, 1359 nt, Artificial Sequence
  derived and/or modified sequence opt4 from Afasevikumab_HeavyChain1
gaggugcagcugguggagagcggcggcggccuggugcagcccggcagaagccugagacugagcugcgccgccagcggcuucaccuucgacgacuacgccaugcacugggugagacaggcccccggcaagggccuggagugggugagcggcaucaacuggagcagcggcggcaucggcuacgccgacagcgugaagggcagauucaccaucagcagagacaacgccaagaacagccuguaccugcagaugaacagccugagagccgaggacaccgcccuguacuacugcgccagagacaucggcggcuucggcgaguucuacuggaacuucggccuguggggcagaggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30586 - RNA, 645 nt, Artificial Sequence
  derived and/or modified sequence opt4 from Afasevikumab_LightChain1
gagaucgugcugacccagagccccgccacccugagccugagccccggcgagagagccacccugagcugcagagccagccagagcgugagaagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggccccccgccaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30587 - RNA, 1293 nt, Artificial Sequence
  derived and/or modified sequence opt4 from Aflibercept_Fusion_protein1
agcgacaccggcagacccuucguggagauguacagcgagauccccgagaucauccacaugaccgagggcagagagcuggugauccccugcagagugaccagccccaacaucaccgugacccugaagaaguucccccuggacacccugauccccgacggcaagagaaucaucugggacagcagaaagggcuucaucaucagcaacgccaccuacaaggagaucggccugcugaccugcgaggccaccgugaacggccaccuguacaagaccaacuaccugacccacagacagaccaacaccaucaucgacguggugcugagccccagccacggcaucgagcugagcgugggcgagaagcuggugcugaacugcaccgccagaaccgagcugaacgugggcaucgacuucaacugggaguaccccagcagcaagcaccagcacaagaagcuggugaacagagaccugaagacccagagcggcagcgagaugaagaaguuccugagcacccugaccaucgacggcgugaccagaagcgaccagggccuguacaccugcgccgccagcagcggccugaugaccaagaagaacagcaccuucgugagagugcacgagaaggacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30588 - RNA, 1332 nt, Artificial Sequence
  derived and/or modified sequence opt4 from Afutuzuab_HeavyChain1
caggugcagcuggugcagagcggcgccgaggugaagaagcccggcagcagcgugaaggugagcugcaaggccagcggcuacgccuucagcuacagcuggaucaacugggugagacaggcccccggccagggccuggaguggggcagaaucuuccccggcgacggcgacaccgacuacaacggcaaguucaagggcagagugaccaucaccgccgacaagagcaccagcaccgccuacgagcugagcagccugagaagcgaggacaccgccguguacuacugcgccagaaacguguucgacggcuacuggcugguguacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggc

SEQ ID NO: 30589 - RNA, 651 nt, Artificial Sequence
  derived and/or modified sequence opt4 from Afutuzuab_LightChain1
gacaucgugacccagaccccccugagccugcccgugacccccggcgagcccgccagcaucagcugcagaagcagcaagagccugcugcacagcaacggcaucaccuaccuguacugguaccugcagaagcccggccagagcccccagcugcugaucuaccagagcaaccuggugagcggcgugcccgacagauucagcggcagcggcagcggcaccgacuucacccugaagaucagcagaguggaggccgaggacgugggcguguacuacugcgcccagaaccuggagcugcccuacaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30590 - RNA, 1347 nt, Artificial Sequence
  derived and/or modified sequence opt4 from Afutuzumab_HeavyChain1
caggugcagcuggugcagagcggcgccgaggugaagaagcccggcagcagcgugaaggugagcugcaaggccagcggcuacgccuucagcuacagcuggaucaacugggugagacaggcccccggccagggccuggaguggaugggcagaaucuuccccggcgacggcgacaccgacuacaacggcaaguucaagggcagagugaccaucaccgccgacaagagcaccagcaccgccuacauggagcugagcagccugagaagcgaggacaccgccguguacuacugcgccagaaacguguucgacggcuacuggcugguguacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30591 - RNA, 657 nt, Artificial Sequence
  derived and/or modified sequence opt4 from Afutuzumab_LightChain1
gacaucgugaugacccagaccccccugagccugcccgugacccccggcgagcccgccagcaucagcugcagaagcagcaagagccugcugcacagcaacggcaucaccuaccuguacugguaccugcagaagcccggccagagcccccagcugcugaucuaccagaugagcaaccuggugagcggcgugcccgacagauucagcggcagcggcagcggcaccgacuucacccugaagaucagcagaguggaggccgaggacgugggcguguacuacugcgcccagaaccuggagcugcccuacaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30592 - RNA, 684 nt, Artificial Sequence
  derived and/or modified sequence opt4 from Alacizumab_pegol_HeavyChain1
gaggugcagcugguggagagcggcggcggccuggugcagcccggcggcagccugagacugagcugcgccgccagcggcuucaccuucagcagcuacggcaugagcugggugagacaggcccccggcaagggccuggaguggguggccaccaucaccagcggcggcagcuacaccuacuacguggacagcgugaagggcagauucaccaucagcagagacaacgccaagaacacccuguaccugcagaugaacagccugagagccgaggacaccgccguguacuacugcgugagaaucggcgaggacgcccuggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcgccgcc

SEQ ID NO: 30593 - RNA, 642 nt, Artificial Sequence
  derived and/or modified sequence opt4 from Alacizumab_pegol_LightChain1
gacauccagaugacccagagccccagcagccugagcgccagcgugggcgacagagugaccaucaccugcagagccagccaggacaucgccggcagccugaacuggcugcagcagaagcccggcaaggccaucaagagacugaucuacgccaccagcagccuggacagcggcgugcccaagagauucagcggcagcagaagcggcagcgacuacacccugaccaucagcagccugcagcccgaggacuucgccaccuacuacugccugcaguacggcagcuucccccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30594 - RNA, 1353 nt, Artificial Sequence
  derived and/or modified sequence opt4 from Alemtuzumab_HeavyChain
caggugcagcugcaggagagcggccccggccuggugagacccagccagacccugagccugaccugcaccgugagcggcuucaccuucaccgacuucuacaugaacugggugagacagccccccggcagaggccuggaguggaucggcuucaucagagacaaggccaagggcuacaccaccgaguacaaccccagcgugaagggcagagugaccaugcugguggacaccagcaagaaccaguucagccugagacugagcagcgugaccgccgccgacaccgccguguacuacugcgccagagagggccacaccgccgcccccuucgacuacuggggccagggcagccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30595 - RNA, 657 nt, Artificial Sequence
  derived and/or modified sequence opt4 from Alemtuzumab_HeavyChain_variant_1bey_H
caggugcagcugcaggagagcggccccggccuggugagacccagccagacccugagccugaccugcaccgugagcggcuucaccuucaccgacuucuacaugaacugggugagacagccccccggcagaggccuggaguggaucggcuucaucagagacaaggccaagggcuacaccaccgaguacaaccccagcgugaagggcagagugaccaugcugguggacaccagcaagaaccaguucagccugagacugagcagcgugaccgccgccgacaccgccguguacuacugcgccagagagggccacaccgccgcccccuucgacuacuggggccagggcagccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggug

SEQ ID NO: 30596 - RNA, 660 nt, Artificial Sequence
  derived and/or modified sequence opt4 from Alemtuzumab_HeavyChain_variant_1ce1_H
caggugcagcugcaggagagcggccccggccuggugagacccagccagacccugagccugaccugcaccgugagcggcuucaccuucaccgacuucuacaugaacugggugagacagccccccggcagaggccuggaguggaucggcuucaucagagacaaggccaagggcuacaccaccgaguacaaccccagcgugaagggcagagugaccaugcugguggacaccagcaagaaccaguucagccugagacugagcagcgugaccgccgccgacaccgccguguacuacugcgccagagagggccacaccgccgcccccuucgacuacuggggccagggcagccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggag

SEQ ID NO: 30597 - RNA, 1311 nt, Artificial Sequence
  derived and/or modified sequence opt4 from Alemtuzumab_HeavyChain_variant_8005_H
caggugcagcugcaggagagcggccccggccuggugagacccagccagacccugagccugaccugcaccgugagcggcuucaccuucaccgacuucuacaugaacugggugagacagccccccggcagaggccuggaguggaucggcuucaucagagacaaggccaagggcuacaccaccgaguacaaccccagcgugaagggcagagugaccaugcugguggacaccagcaagaaccaguucagccugagacugagcagcgugaccgccgccgacaccgccguguacuacugcgccagagagggccacaccgccgcccccuucgacuacuggggccagggcagccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggaggcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30598 - RNA, 633 nt, Artificial Sequence
  derived and/or modified sequence opt4 from Alemtuzumab_LightChain
gacauccagaugacccagagccccagcagccugagcgccagcgugggcgacagagugaccaucaccugcaaggccagccagaacaucgacaaguaccugaacugguaccagcagaagcccggcaaggcccccaagcugcugaucuacaacaccaacaaccugcagaccggcgugcccagcagauucagcggcagcggcagcggcaccgacuucaccuucaccaucagcagccugcagcccgaggacaucgccaccuacuacugccugcagcacaucagcagacccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacaga

SEQ ID NO: 30599 - RNA, 642 nt, Artificial Sequence
  derived and/or modified sequence opt4 from Alemtuzumab_LightChain_variant_8005_L
gacauccagaugacccagagccccagcagccugagcgccagcgugggcgacagagugaccaucaccugcaaggccagccagaacaucgacaaguaccugaacugguaccagcagaagcccggcaaggcccccaagcugcugaucuacaacaccaacaaccugcagaccggcgugcccagcagauucagcggcagcggcagcggcaccgacuucaccuucaccaucagcagccugcagcccgaggacaucgccaccuacuacugccugcagcacaucagcagacccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30600 - RNA, 1341 nt, Artificial Sequence
  derived and/or modified sequence opt4 from Alirocumab_HeavyChain1
gaggugcagcugguggagagcggcggcggccuggugcagcccggcggcagccugagacugagcugcgccgccagcggcuucaccuucaacaacuacgccaugaacugggugagacaggcccccggcaagggccuggacugggugagcaccaucagcggcagcggcggcaccaccaacuacgccgacagcgugaagggcagauucaucaucagcagagacagcagcaagcacacccuguaccugcagaugaacagccugagagccgaggacaccgccguguacuacugcgccaaggacagcaacuggggcaacuucgaccuguggggcagaggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30601 - RNA, 660 nt, Artificial Sequence
  derived and/or modified sequence opt4 from Alirocumab_LightChain1
gacaucgugaugacccagagccccgacagccuggccgugagccugggcgagagagccaccaucaacugcaagagcagccagagcgugcuguacagaagcaacaacagaaacuuccugggcugguaccagcagaagcccggccagccccccaaccugcugaucuacugggccagcaccagagagagcggcgugcccgacagauucagcggcagcggcagcggcaccgacuucacccugaccaucagcagccugcaggccgaggacguggccguguacuacugccagcaguacuacaccacccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30602 - RNA, 735 nt, Artificial Sequence
  derived and/or modified sequence opt4 from ALX-0061_HeavyChain1
gaggugcagcugguggagagcggcggcggccuggugcagcccggcggcagccugagacugagcugcgccgccagcggcagcguguucaagaucaacgugauggccugguacagacaggcccccggcaagggcagagagcugguggccggcaucaucagcggcggcagcaccagcuacgccgacagcgugaagggcagauucaccaucagcagagacaacgccaagaacacccuguaccugcagaugaacagccugagacccgaggacaccgccguguacuacugcgccuucaucaccaccgagagcgacuacgaccugggcagaagauacuggggccagggcacccuggugaccgugagcagcggcggcggcggcagcggcggcggcagcgaggugcagcugguggagagcggcggcggccuggugcagcccggcaacagccugagacugagcugcgccgccagcggcuucaccuucagcagcuucggcaugagcugggugagacaggcccccggcaagggccuggagugggugagcagcaucagcggcagcggcagcgacacccuguacgccgacagcgugaagggcagauucaccaucagcagagacaacgccaagaccacccuguaccugcagaugaacagccugagacccgaggacaccgccguguacuacugcaccaucggcggcagccugagcagaagcagccagggcacccuggugaccgugagcagc

SEQ ID NO: 30603 - RNA, 1347 nt, Artificial Sequence
  derived and/or modified sequence opt4 from Amatuximab_HeavyChain1
caggugcagcugcagcagagcggccccgagcuggagaagcccggcgccagcgugaagaucagcugcaaggccagcggcuacagcuucaccggcuacaccaugaacugggugaagcagagccacggcaagagccuggaguggaucggccugaucacccccuacaacggcgccagcagcuacaaccagaaguucagaggcaaggccacccugaccguggacaagagcagcagcaccgccuacauggaccugcugagccugaccagcgaggacagcgccguguacuucugcgccagaggcggcuacgacggcagaggcuucgacuacuggggcagcggcacccccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30604 - RNA, 639 nt, Artificial Sequence
  derived and/or modified sequence opt4 from Amatuximab_LightChain1
gacaucgagcugacccagagccccgccaucaugagcgccagccccggcgagaaggugaccaugaccugcagcgccagcagcagcgugagcuacaugcacugguaccagcagaagagcggcaccagccccaagagauggaucuacgacaccagcaagcuggccagcggcgugcccggcagauucagcggcagcggcagcggcaacagcuacagccugaccaucagcagcguggaggccgaggacgacgccaccuacuacugccagcaguggagcaagcacccccugaccuucggcagcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30605 - RNA, 1350 nt, Artificial Sequence
  derived and/or modified sequence opt4 from Anetumab_ravtansine_HeavyChain1
cagguggagcuggugcagagcggcgccgaggugaagaagcccggcgagagccugaagaucagcugcaagggcagcggcuacagcuucaccagcuacuggaucggcugggugagacaggcccccggcaagggccuggaguggaugggcaucaucgaccccggcgacagcagaaccagauacagccccagcuuccagggccaggugaccaucagcgccgacaagagcaucagcaccgccuaccugcaguggagcagccugaaggccagcgacaccgccauguacuacugcgccagaggccagcuguacggcggcaccuacauggacggcuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30606 - RNA, 651 nt, Artificial Sequence
  derived and/or modified sequence opt4 from Anetumab_ravtansine_LightChain1
gacaucgcccugacccagcccgccagcgugagcggcagccccggccagagcaucaccaucagcugcaccggcaccagcagcgacaucggcggcuacaacagcgugagcugguaccagcagcaccccggcaaggcccccaagcugaugaucuacggcgugaacaacagacccagcggcgugagcaacagauucagcggcagcaagagcggcaacaccgccagccugaccaucagcggccugcaggccgaggacgaggccgacuacuacugcagcagcuacgacaucgagagcgccacccccguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaagggcgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 30607 - RNA, 1341 nt, Artificial Sequence
  derived and/or modified sequence opt4 from Anifrolumab_HeavyChain1
gaggugcagcuggugcagagcggcgccgaggugaagaagcccggcgagagccugaagaucagcugcaagggcagcggcuacaucuucaccaacuacuggaucgccugggugagacagaugcccggcaagggccuggagagcaugggcaucaucuaccccggcgacagcgacaucagauacagccccagcuuccagggccaggugaccaucagcgccgacaagagcaucaccaccgccuaccugcaguggagcagccugaaggccagcgacaccgccauguacuacugcgccagacacgacaucgagggcuucgacuacuggggcagaggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgaguucgagggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgccagcaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30608 - RNA, 645 nt, Artificial Sequence
  derived and/or modified sequence opt4 from Anifrolumab_LightChain1
gagaucgugcugacccagagccccggcacccugagccugagccccggcgagagagccacccugagcugcagagccagccagagcgugagcagcagcuucuucgccugguaccagcagaagcccggccaggcccccagacugcugaucuacggcgccagcagcagagccaccggcauccccgacagacugagcggcagcggcagcggcaccgacuucacccugaccaucaccagacuggagcccgaggacuucgccguguacuacugccagcaguacgacagcagcgccaucaccuucggccagggcaccagacuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30609 - RNA, 1344 nt, Artificial Sequence
  derived and/or modified sequence opt4 from Anrukinzumab_HeavyChain1
gaggugcagcugguggagagcggcggcggccuggugcagcccggcggcagccugagacugagcugcgccgccagcggcuucaccuucaucagcuacgccaugagcugggugagacaggcccccggcaagggccuggaguggguggccagcaucagcagcggcggcaacaccuacuaccccgacagcgugaagggcagauucaccaucagcagagacaacgccaagaacagccuguaccugcagaugaacagccugagagccgaggacaccgccguguacuacugcgccagacuggacggcuacuacuucggcuucgccuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgaggcccugggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30610 - RNA, 654 nt, Artificial Sequence
  derived and/or modified sequence opt4 from Anrukinzumab_LightChain1
gacauccagaugacccagagccccagcagccugagcgccagcgugggcgacagagugaccaucaccugcaaggccagcgagagcguggacaacuacggcaagagccugaugcacugguaccagcagaagcccggcaaggcccccaagcugcugaucuacagagccagcaaccuggagagcggcgugcccagcagauucagcggcagcggcagcggcaccgacuucacccugaccaucagcagccugcagcccgaggacuucgccaccuacuacugccagcagagcaacgaggaccccuggaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30611 - RNA, 1338 nt, Artificial Sequence
  derived and/or modified sequence opt4 from Apolizumab_HeavyChain1
caggugcagcugcaggagagcggccccggccuggugaagcccagcgagacccugagccugaccugcaccgugagcggcuucagccugaccaacuacggcgugcacugggugagacagagccccggcaagggccuggaguggaucggcgugaaguggagcggcggcagcaccgaguacaacgccgccuucaucagcagacugaccaucagcaaggacaccagcaagaaccaggugagccugaagcugaacagccugaccgccgccgacaccgccguguacuacugcgccagaaacgacagauacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30612 - RNA, 642 nt, Artificial Sequence
  derived and/or modified sequence opt4 from Apolizumab_LightChain1
gacauccagaugacccagagccccagcagccugagcgccagcgugggcgacagagugaccaucaccugcagagccagcgagaacaucuacagcuaccuggccugguaccagcagaagcccggcaaggcccccaagcugcuggugagcaacgccaagacccuggccgagggcgugcccagcagauucagcggcagcggcagcggcaagcaguucacccugaccaucagcagccugcagcccgaggacuucgccaccuacuacugccagcaccacuacggcaacagcuaccccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30613 - RNA, 378 nt, Artificial Sequence
  derived and/or modified sequence opt4 from Apomab_HeavyChain
gaggugcagcuggugcagagcggcggcggcguggagagacccggcggcagccugagacugagcugcgccgccagcggcuucaccuucgacgacuacgccaugugggugagacaggcccccggcaagggccuggagugggugagcggcaucaacuggcagggcggcagcaccggcuacgccgacagcgugaagggcagagugaccaucagcagagacaacgccaagaacagccuguaccugcagaugaacagccugagagccgaggacaccgccguguacuacugcgccaagauccugggcgccggcagaggcugguacuucgacuacuggggcaagggcaccaccgugaccgugagcagcgccagcaccaagggcccc

SEQ ID NO: 30614 - RNA, 324 nt, Artificial Sequence
  derived and/or modified sequence opt4 from Apomab_LightChain
agcgagcugacccaggaccccgccgugagcguggcccugggccagaccgugagaaucaccugcagcggcgacagccugagaagcuacuacgccagcugguaccagcagaagcccggccaggcccccgugcuggugaucuacggcgccaacaacagacccagcggcauccccgacagauucagcggcagcagcagcggcaacaccgccagccugaccaucaccggcgcccaggccgaggacgaggccgacuacuacugcaacagcgccgacagcagcggcaaccacgugguguucggcggcggcaccaagcugaccgugcugggc

SEQ ID NO: 30615 - RNA, 645 nt, Artificial Sequence
  derived and/or modified sequence opt4 from Aquaporumab_LightChain
gagaucgugcugacccagagccccggcacccugagccugagccccggcgagagagccacccugagcugcagagccagccagaccgugagaaccaacuaccuggccugguuccagcagaagcccggccaggcccccagacugcugaucuucggcgccagcagcagagccaccggcauccccgacagauucagcggcagcggcagcggcaccgacuucacccugaccaucagcagacuggagcccgaggacuucgccguguacuacugccagcaguacggcagcagccccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30616 - RNA, 1326 nt, Artificial Sequence
  derived and/or modified sequence opt4 from Arcitumomab_99tc_HeavyChain
gaggugaagcugguggagagcggcggcggccuggugcagcccggcggcagccugagacugagcugcgccaccagcggcuucaccuucaccgacuacuacaugaacugggugagacagccccccggcaaggcccuggaguggcugggcuucaucggcaacaaggccaacggcuacaccaccgaguacagcgccagcgugaagggcagauucaccaucagcagagacaagagccagagcauccuguaccugcagaugaacacccugagagccgaggacagcgccaccuacuacugcaccagagacagaggccugagauucuacuucgacuacuggggccagggcaccacccugaccgugagcagcgccaagaccaccccccccagcguguacccccuggcccccggcagcgccgcccagaccaacagcauggugacccugggcugccuggugaagggcuacuuccccgagcccgugaccgugaccuggaacagcggcagccugagcagcggcgugcacaccuuccccgccgugcugcagagcgaccuguacacccugagcagcagcgugaccgugcccagcagccccagacccagcgagaccgugaccugcaacguggcccaccccgccagcagcaccaagguggacaagaagaucgugcccagagacugcccccccugcaagugccccgcccccaaccugcugggcggccccagcguguucaucuucccccccaagaucaaggacgugcugaugaucagccugagccccaucgugaccugcguggugguggacgugagcgaggacgaccccgacgugcagaucagcugguucgugaacaacguggaggugcacaccgcccagacccagacccacagagaggacuacaacagcacccugagaguggugagcgcccugcccauccagcaccaggacuggaugagcggcaaggaguucaagugcaaggugaacaacaaggaccugcccgcccccaucgagagaaccaucagcaagcccaagggcagcgugagagccccccagguguacgugcugcccccccccgaggaggagaugaccaagaagcaggugacccugaccugcauggugaccgacuucaugcccgaggacaucuacguggaguggaccaacaacggcaagaccgagcugaacuacaagaacaccgagcccgugcuggacagcgacggcagcuacuucauguacagcaagcugagaguggagaagaagaacuggguggagagaaacagcuacagcugcagcguggugcacgagggccugcacaaccaccacaccaccaagagcuucagcaga

SEQ ID NO: 30617 - RNA, 639 nt, Artificial Sequence
  derived and/or modified sequence opt4 from Arcitumomab_99tc_LightChain
cagaccgugcugagccagagccccgccauccugagcgccagccccggcgagaaggugaccaugaccugcagagccagcagcagcgugaccuacauccacugguaccagcagaagcccggcagcagccccaagagcuggaucuacgccaccagcaaccuggccagcggcgugcccgccagauucagcggcagcggcagcggcaccagcuacagccugaccaucagcagaguggaggccgaggacgccgccaccuacuacugccagcacuggagcagcaagccccccaccuucggcggcggcaccaagcuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagugc

SEQ ID NO: 30618 - RNA, 1329 nt, Artificial Sequence
  derived and/or modified sequence opt4 from Ascrinvacumab_HeavyChain1
caggugcagcugcaggagagcggccccggccuggugaagcccagccagacccugagccugaccugcaccgugagcggcggcagcaucagcagcggcgaguacuacuggaacuggaucagacagcaccccggcaagggccuggaguggaucggcuacaucuacuacagcggcagcaccuacuacaaccccagccugaagagcagagugaccaucagcguggacaccagcaagaaccaguucagccugaagcugagcagcgugaccgccgccgacaccgccguguacuacugcgccagagagagcguggccggcuucgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30619 - RNA, 645 nt, Artificial Sequence
  derived and/or modified sequence opt4 from Ascrinvacumab_LightChain1
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcaccagcagcagagccaccggcauccccgacagauucagcggcagcggcagcggcaccgacuucacccugaccaucagcagacuggagcccgaggacuucgccguguacuacugccagcaguacggcagcagccccaucaccuucggccagggcaccagacuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30620 - RNA, 1314 nt, Artificial Sequence
  derived and/or modified sequence opt4 from Aselizuab_HeavyChain1
gaggugcagcugguggagagcggcggcggccuggugcagcccggcggcagccugagacugagcugcgccgccagcggcuucaccuucagcaccuacgccagcugggugagacaggcccccggcaagggccuggaguggguggccagcaucagcaccggcggcagcaccuacuaccccgacagcgugaagggcagauucaccaucagcagagacaacgccaagaacacccuguaccugcagaacagccugagagccgaggacaccgccguguacuacugcgccagagacuacgacggcuacuucgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugccccagcugccccgcccccgaguuccugggcggccccagcguguuccuguucccccccaagcccaaggacacccugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugcacgaggcccugcacaaccacuacacccagaagagccugagccugagccugggcaag

SEQ ID NO: 30621 - RNA, 1311 nt, Artificial Sequence
  derived and/or modified sequence opt4 from Aselizuab_HeavyChain2
gaggugcagcugguggagagcggcggcggccuggugcagcccggcggcagccugagacugagcugcgccgccagcggcuucaccuucagcaccuacgccagcugggugagacaggcccccggcaagggccuggaguggguggccagcaucagcaccggcggcagcaccuacuaccccgacagcgugaagggcagauucaccaucagcagagacaacgccaagaacacccuguaccugcagaacagccugagagccgaggacaccgccguguacuacugcgccagagacuacgacggcuacuucgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugccccagcugccccgcccccgaguuccugggcggccccagcguguuccuguucccccccaagcccaaggacaccaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugcacgaggcccugcacaaccacuacacccagaagagccugagccugagccugggcaag

SEQ ID NO: 30622 - RNA, 648 nt, Artificial Sequence
  derived and/or modified sequence opt4 from Aselizuab_LightChain1
gacauccagacccagagccccagcagccugagcgccagcgugggcgacagagugaccaucaccugcaaggccagccagagcguggacuacgacggcgacagcuacaacugguaccagcagaagcccggcaaggcccccaagcugcugaucuacgccgccagcaaccuggagagcggcauccccagcagauucagcggcagcggcagcggcaccgacuucacccugaccaucagcagccugcagcccgaggacuucgccaccuacuacugccagcagagcaacgaggaccccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30623 - RNA, 1344 nt, Artificial Sequence
  derived and/or modified sequence opt4 from Atezolizumab_HeavyChain1
gaggugcagcugguggagagcggcggcggccuggugcagcccggcggcagccugagacugagcugcgccgccagcggcuucaccuucagcgacagcuggauccacugggugagacaggcccccggcaagggccuggaguggguggccuggaucagccccuacggcggcagcaccuacuacgccgacagcgugaagggcagauucaccaucagcgccgacaccagcaagaacaccgccuaccugcagaugaacagccugagagccgaggacaccgccguguacuacugcgccagaagacacuggcccggcggcuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30624 - RNA, 642 nt, Artificial Sequence
  derived and/or modified sequence opt4 from Atezolizumab_LightChain1
gacauccagaugacccagagccccagcagccugagcgccagcgugggcgacagagugaccaucaccugcagagccagccaggacgugagcaccgccguggccugguaccagcagaagcccggcaaggcccccaagcugcugaucuacagcgccagcuuccuguacagcggcgugcccagcagauucagcggcagcggcagcggcaccgacuucacccugaccaucagcagccugcagcccgaggacuucgccaccuacuacugccagcaguaccuguaccaccccgccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30625 - RNA, 1323 nt, Artificial Sequence
  derived and/or modified sequence opt4 from Atinumab_HeavyChain1
gaggugcagcugguggagagcggcggcggccuggugcagcccggcggcagccugagacugagcugcgccgccagcggcuucaccuucagcaacuacuggaugagcugggugagacaggcccccggcaagggccuggaguggguggccaccaucaagcaggacggcagccagaagaacuacguggacagcgugaagggcagauucaccaucagcagagacaacgccaagaacagccuguaccugagacugaacagccugagagccgaggacaccgccguguacuacugcgccaccgagcuguucgaccuguggggcagaggcagccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugccccagcugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 30626 - RNA, 642 nt, Artificial Sequence
  derived and/or modified sequence opt4 from Atinumab_LightChain1
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggcccaucaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30627 - RNA, 1329 nt, Artificial Sequence
  derived and/or modified sequence opt4 from Atlizuab_HeavyChain1
gugcagcugcaggagagcggccccggccuggugagacccagccagacccugagccugaccugcaccgugagcggcuacagcaucaccagcgaccacgccuggagcugggugagacagccccccggcagaggccuggaguggaucggcuacaucagcuacagcggcaucaccaccuacaaccccagccugaagagcagagugacccugagagacaccagcaagaaccaguucagccugagacugagcagcgugaccgccgccgacaccgccguguacuacugcgccagaagccuggccagaaccaccgccgacuacuggggccagggcagccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggc

SEQ ID NO: 30628 - RNA, 639 nt, Artificial Sequence
  derived and/or modified sequence opt4 from Atlizuab_LightChain1
gacauccagacccagagccccagcagccugagcgccagcgugggcgacagagugaccaucaccugcagagccagccaggacaucagcagcuaccugaacugguaccagcagaagcccggcaaggcccccaagcugcugaucuacuacaccagcagacugcacagcggcgugcccagcagauucagcggcagcggcagcggcaccgacuucaccuucaccaucagcagccugcagcccgaggacaucgccaccuacuacugccagcagggcaacacccugcccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30629 - RNA, 792 nt, Artificial Sequence
  derived and/or modified sequence opt4 from Aurograb_SingleChain
auggccaaggugcagcugcugcagagcgccaccgaggugaagaagcccggcgccagcgugaaggugagcugcaaggccuacggcuacaccuucaccgacuacggcaucaccugggugagacaggcccccggccagggccuggaguggaugggcuggaucagcgccuacaacggcuacaccaacuacgcccagaaguuccaggacagaaucaccaugaccaccgacgccagcaccagcaccgccuacauggagcugagaagccugagacccgacgacaccgccgugcuguacugcgccagagacagagaggacgccagccugcugagagacggccacuggggccagggcacccuggugaccgugagcagcggcggcggcggcagcggcggcggcggcagcggcggcggcggcagcggcggcggcggcagcgagaccacccugacccagagccccggcacccugagccugagccccggcgagagagccacccugagcugcagagccagccagaucgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcaagcuggagcccgaggacuucgccguguacuacugccagcacuacggcagcagcagccccuggaccagcagacccagagaccagagcgacaucaagagagccgccgcccuggagcaccaccaccaccaccac

SEQ ID NO: 30630 - RNA, 1350 nt, Artificial Sequence
  derived and/or modified sequence opt4 from Avelumab_HeavyChain1
gaggugcagcugcuggagagcggcggcggccuggugcagcccggcggcagccugagacugagcugcgccgccagcggcuucaccuucagcagcuacaucaugaugugggugagacaggcccccggcaagggccuggagugggugagcagcaucuaccccagcggcggcaucaccuucuacgccgacaccgugaagggcagauucaccaucagcagagacaacagcaagaacacccuguaccugcagaugaacagccugagagccgaggacaccgccguguacuacugcgccagaaucaagcugggcaccgugaccaccguggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30631 - RNA, 648 nt, Artificial Sequence
  derived and/or modified sequence opt4 from Avelumab_LightChain1
cagagcgcccugacccagcccgccagcgugagcggcagccccggccagagcaucaccaucagcugcaccggcaccagcagcgacgugggcggcuacaacuacgugagcugguaccagcagcaccccggcaaggcccccaagcugaugaucuacgacgugagcaacagacccagcggcgugagcaacagauucagcggcagcaagagcggcaacaccgccagccugaccaucagcggccugcaggccgaggacgaggccgacuacuacugcagcagcuacaccagcagcagcaccagaguguucggcaccggcaccaaggugaccgugcugggccagcccaaggccaaccccaccgugacccuguucccccccagcagcgaggagcugcaggccaacaaggccacccuggugugccugaucagcgacuucuaccccggcgccgugaccguggccuggaaggccgacggcagccccgugaaggccggcguggagaccaccaagcccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 30632 - RNA, 1344 nt, Artificial Sequence
  derived and/or modified sequence opt4 from Bapineuzumab_HeavyChain1
gaggugcagcugcuggagagcggcggcggccuggugcagcccggcggcagccugagacugagcugcgccgccagcggcuucaccuucagcaacuacggcaugagcugggugagacaggcccccggcaagggccuggaguggguggccagcaucagaagcggcggcggcagaaccuacuacagcgacaacgugaagggcagauucaccaucagcagagacaacagcaagaacacccuguaccugcagaugaacagccugagagccgaggacaccgccguguacuacugcgugagauacgaccacuacagcggcagcagcgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30633 - RNA, 657 nt, Artificial Sequence
  derived and/or modified sequence opt4 from Bapineuzumab_LightChain1
gacguggugaugacccagagcccccugagccugcccgugacccccggcgagcccgccagcaucagcugcaagagcagccagagccugcuggacagcgacggcaagaccuaccugaacuggcugcugcagaagcccggccagagcccccagagacugaucuaccuggugagcaagcuggacagcggcgugcccgacagauucagcggcagcggcagcggcaccgacuucacccugaagaucagcagaguggaggccgaggacgugggcguguacuacugcuggcagggcacccacuuccccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30634 - RNA, 1338 nt, Artificial Sequence
  derived and/or modified sequence opt4 from Basiliximab_HeavyChain
cagcugcagcagagcggcaccgugcuggccagacccggcgccagcgugaagaugagcugcaaggccagcggcuacagcuucaccagauacuggaugcacuggaucaagcagagacccggccagggccuggaguggaucggcgccaucuaccccggcaacagcgacaccagcuacaaccagaaguucgagggcaaggccaagcugaccgccgugaccagcgccagcaccgccuacauggagcugagcagccugacccacgaggacagcgccguguacuacugcagcagagacuacggcuacuacuucgacuucuggggccagggcaccacccugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagccccccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30635 - RNA, 630 nt, Artificial Sequence
  derived and/or modified sequence opt4 from Basiliximab_LightChain
cagaucgugagcacccagagccccgccaucaugagcgccagccccggcgagaaggugaccaugaccugcagcgccagcagcagcagaagcuacaugcagugguaccagcagaagcccggcaccagccccaagagauggaucuacgacaccagcaagcuggccagcggcgugcccgccagauucagcggcagcggcagcggcaccagcuacagccugaccaucagcagcauggaggccgaggacgccgccaccuacuacugccaccagagaagcagcuacaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgag

SEQ ID NO: 30636 - RNA, 1350 nt, Artificial Sequence
  derived and/or modified sequence opt4 from Bavituximab_HeavyChain
gaggugcagcugcagcagagcggccccgagcuggagaagcccggcgccagcgugaagcugagcugcaaggccagcggcuacagcuucaccggcuacaacaugaacugggugaagcagagccacggcaagagccuggaguggaucggccacaucgaccccuacuacggcgacaccagcuacaaccagaaguucagaggcaaggccacccugaccguggacaagagcagcagcaccgccuacaugcagcugaagagccugaccagcgaggacagcgccguguacuacugcgugaagggcggcuacuacggccacugguacuucgacguguggggcgccggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30637 - RNA, 642 nt, Artificial Sequence
  derived and/or modified sequence opt4 from Bavituximab_LightChain
gacauccagaugacccagagccccagcagccugagcgccagccugggcgagagagugagccugaccugcagagccagccaggacaucggcagcagccugaacuggcugcagcagggccccgacggcaccaucaagagacugaucuacgccaccagcagccuggacagcggcgugcccaagagauucagcggcagcagaagcggcagcgacuacagccugaccaucagcagccuggagagcgaggacuucguggacuacuacugccugcaguacgugagcagcccccccaccuucggcgccggcaccaagcuggagcugaagagagccgacgccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30638 - RNA, 624 nt, Artificial Sequence
  derived and/or modified sequence opt4 from Bavituximab_LightChain_variant_8734_L
gacauccagaugacccagagccccagcagccugagcgccagccugggcgagagagugagccugaccugcagagccagccaggacaucggcagcagccugaacuggcugcagcagggccccgacggcaccaucaagagacugaucuacgccaccagcagccuggacagcggcgugcccaagagauucagcggcagcagaagcggcagcgacuacagccugaccaucagcagccuggagagcgaggacuucguggacuacuacugccugcaguacgugagcagcccccccaccuucggcgccggcaccaagcuggagcugaagagagccgacgccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcaaggccgacuacgagaagcacaagguguacgccugcgaggugacccaccagggccugagcagccccgugaccaagagcuucaacagaggcgagugc

SEQ ID NO: 30639 - RNA, 1368 nt, Artificial Sequence
  derived and/or modified sequence opt4 from Begelomab_HeavyChain1
caggugcagcugcagcagagcggcgccgagcuggugaagcccggcgccagcgugaagcugagcugcaaggccagcggcuacaccuucagaagcuacgacaucaacugggugagacagagacccgagcagggccuggaguggaucggcuggaucuuccccggcgacggcagcaccaaguacaacgagaaguucaagggcaaggccacccugaccaccgacaagagcagcagcaccgccuacaugcagcugagcagacugaccagcgaggacagcgccguguacuucugcgccagauggaccguggugggccccggcuacuucgacguguggggcgccggcaccaccgugaccgugagcagcgccaagaccaccccccccagcguguacccccuggcccccggcugcggcgacaccaccggcagcagcgugacccugggcugccuggugaagggcuacuuccccgagagcgugaccgugaccuggaacagcggcagccugagcagcagcgugcacaccuuccccgcccugcugcagagcggccuguacaccaugagcagcagcgugaccgugcccagcagcaccuggcccagccagaccgugaccugcagcguggcccaccccgccagcagcaccaccguggacaagaagcuggagcccagcggccccaucagcaccaucaaccccugcccccccugcaaggagugccacaagugccccgcccccaaccuggagggcggccccagcguguucaucuucccccccaacaucaaggacgugcugaugaucagccugacccccaaggugaccugcguggugguggacgugagcgaggacgaccccgacgugcagaucagcugguucgugaacaacguggaggugcacaccgcccagacccagacccacagagaggacuacaacagcaccaucagaguggugagcacccugcccauccagcaccaggacuggaugagcggcaaggaguucaagugcaaggugaacaacaaggaccugcccagccccaucgagagaaccaucagcaagaucaagggccuggugagagccccccagguguacauccugcccccccccgccgagcagcugagcagaaaggacgugagccugaccugccugguggugggcuucaaccccggcgacaucagcguggaguggaccagcaacggccacaccgaggagaacuacaaggacaccgcccccgugcuggacagcgacggcagcuacuucaucuacagcaagcugaacaugaagaccagcaagugggagaagaccgacagcuucagcugcaacgugagacacgagggccugaagaacuacuaccugaagaagaccaucagcagaagccccggcaag

SEQ ID NO: 30640 - RNA, 639 nt, Artificial Sequence; identical to SEQ ID NO: 30578
  derived and/or modified sequence opt4 from Begelomab_LightChain1

SEQ ID NO: 30641 - RNA, 1353 nt, Artificial Sequence
  derived and/or modified sequence opt4 from Benralizumab_HeavyChain1
gaggugcagcuggugcagagcggcgccgaggugaagaagcccggcgccagcgugaaggugagcugcaaggccagcggcuacaccuucaccagcuacgugauccacugggugagacagagacccggccagggccuggccuggaugggcuacaucaaccccuacaacgacggcaccaaguacaacgagagauucaagggcaaggugaccaucaccagcgacagaagcaccagcaccguguacauggagcugagcagccugagaagcgaggacaccgccguguaccugugcggcagagagggcaucagauacuacggccugcugggcgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30642 - RNA, 642 nt, Artificial Sequence
  derived and/or modified sequence opt4 from Benralizumab_LightChain1
gacauccagaugacccagagccccagcagccugagcgccagcgugggcgacagagugaccaucaccugcggcaccagcgaggacaucaucaacuaccugaacugguaccagcagaagcccggcaaggcccccaagcugcugaucuaccacaccagcagacugcagagcggcgugcccagcagauucagcggcagcggcagcggcaccgacuucacccugaccaucagcagccugcagcccgaggacuucgccaccuacuacugccagcagggcuacacccugcccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30643 - RNA, 1329 nt, Artificial Sequence
  derived and/or modified sequence opt4 from Betalutin_HeavyChain1
gagauccagcugcagcagagcggccccgagcuggugaagcccggcgccagcgugaaggugagcugcaaggccagcggcuacagcuucaccgacuacaacauguacugggugaagcagagccacggcaagagccuggaguggaucggcuacaucgaccccuacaacggcgacaccaccuacaaccagaaguucaagggcaaggccacccugaccguggacaagagcagcagcaccgccuucauccaccugaacagccugaccagcgaggacagcgccguguacuacugcgccagaagccccuacggccacuacgccauggacuacuggggccagggcaccagcgugaccgugagcagcgccaagaccaccccccccagcguguacccccuggcccccggcagcgccgcccagaccaacagcauggugacccugggcugccuggugaagggcuacuuccccgagcccgugaccgugaccuggaacagcggcagccugagcagcggcgugcacaccuuccccgccgugcugcagagcgaccuguacacccugagcagcagcgugaccgugcccagcagcaccuggcccagcgagaccgugaccugcaacguggcccaccccgccagcagcaccaagguggacaagaagaucgugcccagagacugcggcugcaagcccugcaucugcaccgugcccgaggugagcagcguguucaucuucccccccaagcccaaggacgugcugaccaucacccugacccccaaggugaccugcguggugguggacaucagcaaggacgaccccgaggugcaguucagcugguucguggacgacguggaggugcacaccgcccagacccagcccagagaggagcaguucaacagcaccuucagaagcgugagcgagcugcccaucaugcaccaggacuggcugaacggcaaggaguucaagugcagagugaacagcgccgccuuccccgcccccaucgagaagaccaucagcaagaccaagggcagacccaaggccccccagguguacaccauccccccccccaaggagcagauggccaaggacaaggugagccugaccugcaugaucaccgacuucuuccccgaggacaucaccguggaguggcaguggaacggccagcccgccgagaacuacaagaacacccagcccaucauggacaccgacggcagcuacuucguguacagcaagcugaacgugcagaagagcaacugggaggccggcaacaccuucaccugcagcgugcugcacgagggccugcacaaccaccacaccgagaagagccugagccacagccccggcaag

SEQ ID NO: 30644 - RNA, 642 nt, Artificial Sequence
  derived and/or modified sequence opt4 from Betalutin_LightChain1
gacaucgugaugacccagagccacaagcugcugagcaccagcgugggcgacagagugagcaucaccugcaaggccagccaggacgugagcaccgccguggacugguaccagcagaagcccggccagagccccaagcugcugaucaacugggccagcaccagacacaccggcgugcccgacagauucaccggcagcggcagcggcaccgacuacacccugaccaucagcagcaugcaggccgaggaccuggcccuguacuacugcagacagcacuacagcacccccuucaccuucggcagcggcaccaagcuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagugc

SEQ ID NO: 30645 - RNA, 1344 nt, Artificial Sequence
  derived and/or modified sequence opt4 from Bevacituzuab_HeavyChain1
gaggugcagcugguggagagcggcggcggccuggugcagcccggcggcagccugagacugagcugcgccgccagcggcuacaccuucaccaacuacggcaacugggugagacaggcccccggcaagggccuggagugggugggcuggaucaacaccuacaccggcgagcccaccuacgccgccgacuucaagagaagauucaccuucagccuggacaccagcaagagcaccgccuaccugcagaacagccugagagccgaggacaccgccguguacuacugcgccaaguacccccacuacuacggcagcagccacugguacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggcaag

SEQ ID NO: 30646 - RNA, 639 nt, Artificial Sequence
  derived and/or modified sequence opt4 from Bevacituzuab_LightChain1
gacauccagacccagagccccagcagccugagcgccagcgugggcgacagagugaccaucaccugcagcgccagccaggacaucagcaacuaccugaacugguaccagcagaagcccggcaaggcccccaaggugcugaucuacuucaccagcagccugcacagcggcgugcccagcagauucagcggcagcggcagcggcaccgacuucacccugaccaucagcagccugcagcccgaggacuucgccaccuacuacugccagcaguacagcaccgugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30647 - RNA, 639 nt, Artificial Sequence
  derived and/or modified sequence opt4 from Bevacizumab_154-aspartic_acid_LightChain
gacauccagaugacccagagccccagcagccugagcgccagcgugggcgacagagugaccaucaccugcagcgccagccaggacaucagcaacuaccugaacugguaccagcagaagcccggcaaggcccccaaggugcugaucuacuucaccagcagccugcacagcggcgugcccagcagauucagcggcagcggcagcggcaccgacuucacccugaccaucagcagccugcagcccgaggacuucgccaccuacuacugccagcaguacagcaccgugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgccgaccagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgag

SEQ ID NO: 30648 - RNA, 639 nt, Artificial Sequence; identical to SEQ ID NO: 30647
  derived and/or modified sequence opt4 from Bevacizumab_154-substitution_deriv_LightChain

SEQ ID NO: 30649 - RNA, 672 nt, Artificial Sequence
  derived and/or modified sequence opt4 from Bevacizumab_180-serine_HeavyChain
gaggugcagcugguggagagcggcggcggccuggugcagcccggcggcagccugagacugagcugcgccgccagcggcuacaccuucaccaacuacggcaugaacugggugagacaggcccccggcaagggccuggagugggugggcuggaucaacaccuacaccggcgagcccaccuacgccgccgacuucaagagaagauucaccuucagccuggacaccagcaagagcaccgccuaccugcagaugaacagccugagagccgaggacaccgccguguacuacugcgccaaguacccccacuacuacggcagcagccacugguacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugagccagagcagcggccuguacagccugagcagcguggugaccgugcccagcagcagccugggcacccagaccuacaucugcaacgugaaccacaagcccagcaacaccaagguggacaagaagguggagcccaag

SEQ ID NO: 30650 - RNA, 672 nt, Artificial Sequence; identical to SEQ ID NO: 30649
  derived and/or modified sequence opt4 from Bevacizumab_180-substitution_deriv_HeavyCahin

SEQ ID NO: 30651 - RNA, 1359 nt, Artificial Sequence
  derived and/or modified sequence opt4 from Bevacizumab_beta_HeavyChain1
gaggugcagcugguggagagcggcggcggccuggugcagcccggcggcagccugagacugagcugcgccgccagcggcuacaccuucaccaacuacggcaugaacugggugagacaggcccccggcaagggccuggagugggugggcuggaucaacaccuacaccggcgagcccaccuacgccgccgacuucaagagaagauucaccuucagccuggacaccagcaagagcaccgccuaccugcagaugaacagccugagagccgaggacaccgccguguacuacugcgccaaguacccccacuacuacggcagcagccacugguacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30652 - RNA, 642 nt, Artificial Sequence
  derived and/or modified sequence opt4 from Bevacizumab_beta_LightChain1
gacauccagaugacccagagccccagcagccugagcgccagcgugggcgacagagugaccaucaccugcagcgccagccaggacaucagcaacuaccugaacugguaccagcagaagcccggcaaggcccccaaggugcugaucuacuucaccagcagccugcacagcggcgugcccagcagauucagcggcagcggcagcggcaccgacuucacccugaccaucagcagccugcagcccgaggacuucgccaccuacuacugccagcaguacagcaccgugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30653 - RNA, 687 nt, Artificial Sequence
  derived and/or modified sequence opt4 from Bevacizumab_FcDomain
agcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30654 - RNA, 672 nt, Artificial Sequence
  derived and/or modified sequence opt4 from Bevacizumab_HeavyChain
gaggugcagcugguggagagcggcggcggccuggugcagcccggcggcagccugagacugagcugcgccgccagcggcuacaccuucaccaacuacggcaugaacugggugagacaggcccccggcaagggccuggagugggugggcuggaucaacaccuacaccggcgagcccaccuacgccgccgacuucaagagaagauucaccuucagccuggacaccagcaagagcaccgccuaccugcagaugaacagccugagagccgaggacaccgccguguacuacugcgccaaguacccccacuacuacggcagcagccacugguacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaag

SEQ ID NO: 30655 - RNA, 1428 nt, Artificial Sequence
  derived and/or modified sequence opt4 from Bevacizumab_HeavyChain_variant1
gccagcgccaccaugggcuggagcugcaucauccuguuccugguggccaccgccaccggcgugcacagcgaggugcagcugguggagagcggcggcggccuggugcagcccggcggcagccugagacugagcugcgccgccagcggcuacaccuucaccaacuacggcaugaacugggugagacaggcccccggcaagggccuggagugggugggcuggaucaacaccuacaccggcgagcccaccuacgccgccgacuucaagagaagauucaccuucagccuggacaccagcaagagcaccgccuaccugcagaugaacagccugagagccgaggacaccgccguguacuacugcgccaaguacccccacuacuacggcagcagccacugguacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30656 - RNA, 369 nt, Artificial Sequence
  derived and/or modified sequence opt4 from Bevacizumab_HeavyChain_V-Region
gaggugcagcugguggagagcggcggcggccuggugcagcccggcggcagccugagacugagcugcgccgccagcggcuacaccuucaccaacuacggcaugaacugggugagacaggcccccggcaagggccuggagugggugggcuggaucaacaccuacaccggcgagcccaccuacgccgccgacuucaagagaagauucaccuucagccuggacaccagcaagagcaccgccuaccugcagaugaacagccugagagccgaggacaccgccguguacuacugcgccaaguacccccacuacuacggcagcagccacugguacuucgacguguggggccagggcacccuggugaccgugagcagc

SEQ ID NO: 30657 - RNA, 717 nt, Artificial Sequence
  derived and/or modified sequence opt4 from Bevacizumab_LightChain1
gccagcaagcuggccaccaugggcuggagcugcaucauccuguuccugguggccaccgccaccggcgugcacagcgacauccagaugacccagagccccagcagccugagcgccagcgugggcgacagagugaccaucaccugcagagccagccaggacaucagcagcuaccugaacugguaccagcagaagcccggcaaggcccccaagcugcugaucuacuacaccagcagacugcacagcggcgugcccagcagauucagcggcagcggcagcggcaccgacuucaccuucaccaucagcagccugcagcccgaggacaucgccaccuacuacugccagcagggcaacacccugcccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30658 - RNA, 711 nt, Artificial Sequence
  derived and/or modified sequence opt4 from Bevacizumab_LightChain2
gccagcgccaccaugggcuggagcugcaucauccuguuccugguggccaccgccaccggcgugcacagcgacauccagaugacccagagccccagcagccugagcgccagcgugggcgacagagugaccaucaccugcagcgccagccaggacaucagcaacuaccugaacugguaccagcagaagcccggcaaggcccccaaggugcugaucuacuucaccagcagccugcacagcggcgugcccagcagauucagcggcagcggcagcggcaccgacuucacccugaccaucagcagccugcagcccgaggacuucgccaccuacuacugccagcaguacagcaccgugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30659 - RNA, 642 nt, Artificial Sequence; identical to SEQ ID NO: 30652
  derived and/or modified sequence opt4 from Bevacizumab_LightChain

SEQ ID NO: 30660 - RNA, 324 nt, Artificial Sequence
  derived and/or modified sequence opt4 from Bevacizumab_LightChain_VJ-Region
gacauccagaugacccagagccccagcagccugagcgccagcgugggcgacagagugaccaucaccugcagcgccagccaggacaucagcaacuaccugaacugguaccagcagaagcccggcaaggcccccaaggugcugaucuacuucaccagcagccugcacagcggcgugcccagcagauucagcggcagcggcagcggcaccgacuucacccugaccaucagcagccugcagcccgaggacuucgccaccuacuacugccagcaguacagcaccgugcccuggaccuucggccagggcaccaagguggagaucaagaga

SEQ ID NO: 30661 - RNA, 321 nt, Artificial Sequence
  derived and/or modified sequence opt4 from Bevacizumab_LightChain_V-Region
gacauccagaugacccagagccccagcagccugagcgccagcgugggcgacagagugaccaucaccugcagcgccagccaggacaucagcaacuaccugaacugguaccagcagaagcccggcaaggcccccaaggugcugaucuacuucaccagcagccugcacagcggcgugcccagcagauucagcggcagcggcagcggcaccgacuucacccugaccaucagcagccugcagcccgaggacuucgccaccuacuacugccagcaguacagcaccgugcccuggaccuucggccagggcaccaagguggagaucaag

SEQ ID NO: 30662 - RNA, 369 nt, Artificial Sequence; identical to SEQ ID NO: 30656
  derived and/or modified sequence opt4 from Bevacizumab-rhuMAb-VEGF_HeavyChain_gamma1-Chain_VDJ-Region

SEQ ID NO: 30663 - RNA, 321 nt, Artificial Sequence; identical to SEQ ID NO: 30661
  derived and/or modified sequence opt4 from Bevacizumab-rhuMAb-VEGF_LightChain_VJ-Region

SEQ ID NO: 30664 - RNA, 1341 nt, Artificial Sequence
  derived and/or modified sequence opt4 from Bevacizumab_gamma1-Chain
gaggugcagcugguggagagcggcggcggccuggugcagcccggcggcagccugagacugagcugcgccgccagcggcuacaccuucaccaacuacggcaugaacugggugagacaggcccccggcaagggccuggagugggugggcuggaucaacaccuacaccggcgagcccaccuacgccgccgacuucaagagaagauucaccuucagccuggacaccagcaagagcaccgccuaccugcagaugaacagccugagagccgaggacaccgccguguacuacugcgccaaguacccccacuacuacggcagcagccacugguacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggcagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcuacguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuucaagaagcugaccguggacaagagcagauggcagcagggcaacguguucagcugcagcgugaugcacgaggcccugcacaaccacuacacccagaagagccugagccugagccccggcaag

SEQ ID NO: 30665 - RNA, 1359 nt, Artificial Sequence
  derived and/or modified sequence opt4 from Bevacizumab_gamma1-Chain_CH3-Region_mutein
gaggugcagcugguggagagcggcggcggccuggugcagcccggcggcagccugagacugagcugcgccgccagcggcuacaccuucaccaacuacggcaugaacugggugagacaggcccccggcaagggccuggagugggugggcuggaucaacaccuacaccggcgagcccaccuacgccgccgacuucaagagaagauucaccuucagccuggacaccagcaagagcaccgccuaccugcagaugaacagccugagagccgaggacaccgccguguacuacugcgccaaguacccccacuacuacggcagcagccacugguacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccaggugugcacccugccccccagcagagacgagcugaccaagaaccaggugagccugagcugcgccgugaagggcuucuaccccagcgacaucgccguggagugggagagcaacggccagcccgagaacaacuacaagaccaccccccccgugcuggacagcgacggcagcuucuuccuggugagcaagcugaccguggacaagagcagauggcagcagggcaacguguucagcugcagcgugaugcacgaggcccugcacaaccacuacacccagaagagccugagccugagccccggcaag

SEQ ID NO: 30666 - RNA, 1347 nt, Artificial Sequence; identical to SEQ ID NO: 30579
  derived and/or modified sequence opt4 from Bezlotoxumab_HeavyChain1

SEQ ID NO: 30667 - RNA, 645 nt, Artificial Sequence; identical to SEQ ID NO: 30580
  derived and/or modified sequence opt4 from Bezlotoxumab_LightChain1

SEQ ID NO: 30668 - RNA, 1335 nt, Artificial Sequence
  derived and/or modified sequence opt4 from Bimagrumab_HeavyChain1
caggugcagcuggugcagagcggcgccgaggugaagaagcccggcgccagcgugaaggugagcugcaaggccagcggcuacaccuucaccagcagcuacaucaacugggugagacaggcccccggccagggccuggaguggaugggcaccaucaaccccgugagcggcagcaccagcuacgcccagaaguuccagggcagagugaccaugaccagagacaccagcaucagcaccgccuacauggagcugagcagacugagaagcgacgacaccgccguguacuacugcgccagaggcggcugguucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgaggccgccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30669 - RNA, 1332 nt, Artificial Sequence
  derived and/or modified sequence opt4 from Bimagrumab_HeavyChain
caggugcagcuggugcagagcggcgccgaggugaagaagcccggcgccagcgugaaggugagcugcaaggccagcggcuacaccuucaccagcagcuacaucaacugggugagacaggcccccggccagggccuggaguggaugggcaccaucaaccccgugagcggcagcaccagcuacgcccagaaguuccagggcagagugaccaugaccagagacaccagcaucagcaccgccuacauggagcugagcagacugagaagcgacgacaccgccguguacuacugcgccagaggcggcugguucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgaggccgccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30670 - RNA, 651 nt, Artificial Sequence
  derived and/or modified sequence opt4 from Bimagrumab_LightChain1
cagagcgcccugacccagcccgccagcgugagcggcagccccggccagagcaucaccaucagcugcaccggcaccagcagcgacgugggcagcuacaacuacgugaacugguaccagcagcaccccggcaaggcccccaagcugaugaucuacggcgugagcaagagacccagcggcgugagcaacagauucagcggcagcaagagcggcaacaccgccagccugaccaucagcggccugcaggccgaggacgaggccgacuacuacugcggcaccuucgccggcggcagcuacuacggcguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 30671 - RNA, 1365 nt, Artificial Sequence
  derived and/or modified sequence opt4 from Bimekizumab_HeavyChain1
gaggugcagcugguggagagcggcggcggccuggugcagcccggcggcagccugagacugagcugcgccgccagcggcuucaccuucagcgacuacaacauggccugggugagacaggcccccggcaagggccuggaguggguggccaccaucaccuacgagggcagaaacaccuacuacagagacagcgugaagggcagauucaccaucagcagagacaacgccaagaacagccuguaccugcagaugaacagccugagagccgaggacaccgccguguacuacugcgccagccccccccaguacuacgagggcagcaucuacagacugugguucgcccacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30672 - RNA, 642 nt, Artificial Sequence
  derived and/or modified sequence opt4 from Bimekizumab_LightChain1
gccauccagcugacccagagccccagcagccugagcgccagcgugggcgacagagugaccaucaccugcagagccgacgagagcgugagaacccugaugcacugguaccagcagaagcccggcaaggcccccaagcugcugaucuaccuggugagcaacagcgagaucggcgugcccgacagauucagcggcagcggcagcggcaccgacuucagacugaccaucagcagccugcagcccgaggacuucgccaccuacuacugccagcagaccuggagcgaccccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30673 - RNA, 1344 nt, Artificial Sequence
  derived and/or modified sequence opt4 from Bleselumab_HeavyChain1
cagcugcagcugcaggagagcggccccggccugcugaagcccagcgagacccugagccugaccugcaccgugagcggcggcagcaucagcagccccggcuacuacggcggcuggaucagacagccccccggcaagggccuggaguggaucggcagcaucuacaagagcggcagcaccuaccacaaccccagccugaagagcagagugaccaucagcguggacaccagcaagaaccaguucagccugaagcugagcagcgugaccgccgccgacaccgccguguacuacugcaccagacccguggugagauacuucggcugguucgaccccuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguucgagggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 30674 - RNA, 639 nt, Artificial Sequence
  derived and/or modified sequence opt4 from Bleselumab_LightChain1
gccauccagcugacccagagccccagcagccugagcgccagcgugggcgacagagugaccaucaccugcagagccagccagggcaucagcagcgcccuggccugguaccagcagaagcccggcaaggcccccaagcugcugaucuacgacgccagcaaccuggagagcggcgugcccagcagauucagcggcagcggcagcggcaccgacuucacccugaccaucagcagccugcagcccgaggacuucgccaccuacuacugccagcaguucaacagcuaccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30675 - RNA, 1512 nt, Artificial Sequence
  derived and/or modified sequence opt4 from Blinatumomab_HeavyChain1
gacauccagcugacccagagccccgccagccuggccgugagccugggccagagagccaccaucagcugcaaggccagccagagcguggacuacgacggcgacagcuaccugaacugguaccagcagauccccggccagccccccaagcugcugaucuacgacgccagcaaccuggugagcggcaucccccccagauucagcggcagcggcagcggcaccgacuucacccugaacauccaccccguggagaagguggacgccgccaccuaccacugccagcagagcaccgaggaccccuggaccuucggcggcggcaccaagcuggagaucaagggcggcggcggcagcggcggcggcggcagcggcggcggcggcagccaggugcagcugcagcagagcggcgccgagcuggugagacccggcagcagcgugaagaucagcugcaaggccagcggcuacgccuucagcagcuacuggaugaacugggugaagcagagacccggccagggccuggaguggaucggccagaucuggcccggcgacggcgacaccaacuacaacggcaaguucaagggcaaggccacccugaccgccgacgagagcagcagcaccgccuacaugcagcugagcagccuggccagcgaggacagcgccguguacuucugcgccagaagagagaccaccaccgugggcagauacuacuacgccauggacuacuggggccagggcaccaccgugaccgugagcagcggcggcggcggcagcgacaucaagcugcagcagagcggcgccgagcuggccagacccggcgccagcgugaagaugagcugcaagaccagcggcuacaccuucaccagauacaccaugcacugggugaagcagagacccggccagggccuggaguggaucggcuacaucaaccccagcagaggcuacaccaacuacaaccagaaguucaaggacaaggccacccugaccaccgacaagagcagcagcaccgccuacaugcagcugagcagccugaccagcgaggacagcgccguguacuacugcgccagauacuacgacgaccacuacugccuggacuacuggggccagggcaccacccugaccgugagcagcguggagggcggcagcggcggcagcggcggcagcggcggcagcggcggcguggacgacauccagcugacccagagccccgccaucaugagcgccagccccggcgagaaggugaccaugaccugcagagccagcagcagcgugagcuacaugaacugguaccagcagaagagcggcaccagccccaagagauggaucuacgacaccagcaagguggccagcggcgugcccuacagauucagcggcagcggcagcggcaccagcuacagccugaccaucagcagcauggaggccgaggacgccgccaccuacuacugccagcaguggagcagcaacccccugaccuucggcgccggcaccaagcuggagcugaagcaccaccaccaccaccac

SEQ ID NO: 30676 - RNA, 1512 nt, Artificial Sequence; identical to SEQ ID NO: 30675
  derived and/or modified sequence opt4 from Blinatumomab_SingleChain

SEQ ID NO: 30677 - RNA, 1512 nt, Artificial Sequence; identical to SEQ ID NO: 30675
  derived and/or modified sequence opt4 from Blinatumumab_SingleChain_variable_fragment_fusion_protein_(bite)

SEQ ID NO: 30678 - RNA, 1344 nt, Artificial Sequence
  derived and/or modified sequence opt4 from Blontuvetmab_HeavyChain
caggugcagcugcagcagagcagagccgagcuggugagacccggcgccagcgugacccugagcugcaagcccagcggcuacaccuucaccgacuacgaggugcacugggugaagcagacccccgugcacggccuggaguggaucggcgccaucgaccccgagaccggcggcaccgccgacaaccagaaguucaagggcaaggccauccugaccgccgacaagagcagcagcaccgccuacauggagcugagaagccugaccagcgaggacagcgccguguacuacugcaccaacuucguggacguguggggcaccggcaccaccgugaccgugagcagcgccagcaccaccgcccccagcguguucccccuggcccccagcugcggcagccagagcggcagcaccguggcccuggccugccuggugagcggcuacuuccccgagcccgugaccgugagcuggaacagcggcagccugaccagcggcgugcacaccuuccccagcgugcugcagagcagcggccuguacagccugagcagcauggugaccgugcccagcagcagauggcccagcgagaccuucaccugcaacguggcccaccccgccagcaagaccaagguggacaagcccgugcccaagagagagaacggcagagugcccagaccccccgacugccccaagugccccgcccccgagaugcugggcggccccagcguguucaucuucccccccaagcccaaggacacccugcugaucgccagaacccccgaggugaccugcguggugguggaccuggaccccgaggaccccgaggugcagaucagcugguucguggacggcaagcagaugcagaccgccaagacccagcccagagaggagcaguucaacggcaccuacagaguggugagcgugcugcccaucggccaccaggacuggcugaagggcaagcaguucaccugcaaggugaacaacaaggcccugcccagccccaucgagagaaccaucagcaaggccagaggccaggcccaccagcccagcguguacgugcugccccccagcagagaggagcugagcaagaacaccgugagccugaccugccugaucaaggacuucuucccccccgacaucgacguggaguggcagagcaacggccagcaggagcccgagagcaaguacagaaccacccccccccagcuggacgaggacggcagcuacuuccuguacagcaagcugagcguggacaagagcagauggcagagaggcgacaccuucaucugcgccgugaugcacgaggcccugcacaaccacuacacccagaagagccugagccacagccccggcaag

SEQ ID NO: 30679 - RNA, 657 nt, Artificial Sequence
  derived and/or modified sequence opt4 from Blontuvetmab_LightChain
gacguggugaugagccagagccccagcagccuggccgugagcgugggcgagaaggugaccaugagcugcaagagcagccagagccugcuguacagcggcaaccagaagaacuaccuggccugguaccagcagaagcccggccagagccccagacugcugaucuacugggccagcaccagagagagcggcgugcccgacagauucaccggcagcggcagcggcaccgacuucacccugaccaucagcagcgugaaggccgaggaccuggccguguucuacugccagcaguacuacaacuacccccugaccuucggcggcggcacccaccugaccgugcugggccagcccaaggccagccccagcgugacccuguucccccccagcagcgaggagcugggcgccaacaaggccacccuggugugccugaucagcgacuucuaccccagcggcgugaccguggccuggaaggccgacggcagccccaucacccagggcguggagaccaccaagcccagcaagcagagcaacaacaaguacgccgccagcagcuaccugagccugacccccgacaaguggaagagccacagcagcuucagcugccuggugacccacgagggcagcaccguggagaagaagguggcccccgccgagugcagc

SEQ ID NO: 30680 - RNA, 1332 nt, Artificial Sequence
  derived and/or modified sequence opt4 from Blosozumab_HeavyChain1
caggugcagcuggugcagagcggcgccgaggugaagaagcccggcgccagcgugaaggugagcugcaaggugagcggcuuccccaucaaggacaccuuccagcacugggugagacaggcccccggcaagggccuggaguggaugggcuggagcgaccccgagaucggcgacaccgaguacgccagcaaguuccagggcagagugaccaugaccgaggacaccagcaccgacaccgccuacauggagcugagcagccugagaagcgaggacaccgccguguacuacugcgccaccggcgacaccaccuacaaguucgacuucuggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggc

SEQ ID NO: 30681 - RNA, 642 nt, Artificial Sequence
  derived and/or modified sequence opt4 from Blosozumab_LightChain1
gacauccagaugacccagagccccagcagccugagcgccagcgugggcgacagagugaccaucaccugcaaggccagccaggacgugcacaccgccguggccugguaccagcagaagcccggcaaggcccccaagcugcugaucuacugggccagcaccagauggaccggcgugcccagcagauucagcggcagcggcagcggcaccgacuucacccugaccaucagcagccugcagcccgaggacuucgccaccuacuacugccagcaguacagcgacuaccccuggaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30682 - RNA, 1332 nt, Artificial Sequence
  derived and/or modified sequence opt4 from Bococizumab_HeavyChain1
caggugcagcuggugcagagcggcgccgaggugaagaagcccggcgccagcgugaaggugagcugcaaggccagcggcuacaccuucaccagcuacuacaugcacugggugagacaggcccccggccagggccuggaguggaugggcgagaucagccccuucggcggcagaaccaacuacaacgagaaguucaagagcagagugaccaugaccagagacaccagcaccagcaccguguacauggagcugagcagccugagaagcgaggacaccgccguguacuacugcgccagagagagaccccuguacgccagcgaccuguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccagcagcaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30683 - RNA, 642 nt, Artificial Sequence
  derived and/or modified sequence opt4 from Bococizumab_LightChain1
gacauccagaugacccagagccccagcagccugagcgccagcgugggcgacagagugaccaucaccugcagagccagccagggcaucagcagcgcccuggccugguaccagcagaagcccggcaaggcccccaagcugcugaucuacagcgccagcuacagauacaccggcgugcccagcagauucagcggcagcggcagcggcaccgacuucaccuucaccaucagcagccugcagcccgaggacaucgccaccuacuacugccagcagagauacagccuguggagaaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30684 - RNA, 1338 nt, Artificial Sequence
  derived and/or modified sequence opt4 from Brentuximab_vedotin_HeavyChain1
cagauccagcugcagcagagcggccccgagguggugaagcccggcgccagcgugaagaucagcugcaaggccagcggcuacaccuucaccgacuacuacaucaccugggugaagcagaagcccggccagggccuggaguggaucggcuggaucuaccccggcagcggcaacaccaaguacaacgagaaguucaagggcaaggccacccugaccguggacaccagcagcagcaccgccuucaugcagcugagcagccugaccagcgaggacaccgccguguacuucugcgccaacuacggcaacuacugguucgccuacuggggccagggcacccaggugaccgugagcgccgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30685 - RNA, 654 nt, Artificial Sequence
  derived and/or modified sequence opt4 from Brentuximab_vedotin_LightChain1
gacaucgugcugacccagagccccgccagccuggccgugagccugggccagagagccaccaucagcugcaaggccagccagagcguggacuucgacggcgacagcuacaugaacugguaccagcagaagcccggccagccccccaaggugcugaucuacgccgccagcaaccuggagagcggcauccccgccagauucagcggcagcggcagcggcaccgacuucacccugaacauccaccccguggaggaggaggacgccgccaccuacuacugccagcagagcaacgaggaccccuggaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30686 - RNA, 1335 nt, Artificial Sequence
  derived and/or modified sequence opt4 from Briakinumab_HeavyChain1
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccuucaucagauacgacggcagcaacaaguacuacgccgacagcgugaagggcagauucaccaucagcagagacaacagcaagaacacccuguaccugcagaugaacagccugagagccgaggacaccgccguguacuacugcaagacccacggcagccacgacaacuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30687 - RNA, 651 nt, Artificial Sequence
  derived and/or modified sequence opt4 from Briakinumab_LightChain1
cagagcgugcugacccagccccccagcgugagcggcgcccccggccagagagugaccaucagcugcagcggcagcagaagcaacaucggcagcaacaccgugaagugguaccagcagcugcccggcaccgcccccaagcugcugaucuacuacaacgaccagagacccagcggcgugcccgacagauucagcggcagcaagagcggcaccagcgccagccuggccaucaccggccugcaggccgaggacgaggccgacuacuacugccagagcuacgacagauacacccaccccgcccugcuguucggcaccggcaccaaggugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 30688 - RNA, 1326 nt, Artificial Sequence
  derived and/or modified sequence opt4 from Brodalumab_HeavyChain1
caggugcagcuggugcagagcggcgccgaggugaagaagcccggcgccagcgugaaggugagcugcaaggccagcggcuacaccuucaccagauacggcaucagcugggugagacaggcccccggccagggccuggaguggaugggcuggaucagcaccuacagcggcaacaccaacuacgcccagaagcugcagggcagagugaccaugaccaccgacaccagcaccagcaccgccuacauggagcugagaagccugagaagcgacgacaccgccguguacuacugcgccagaagacagcuguacuucgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30689 - RNA, 642 nt, Artificial Sequence
  derived and/or modified sequence opt4 from Brodalumab_LightChain1
gagaucgugaugacccagagccccgccacccugagcgugagccccggcgagagagccacccugagcugcagagccagccagagcgugagcagcaaccuggccugguuccagcagaagcccggccaggcccccagaccccugaucuacgacgccagcaccagagccaccggcgugcccgccagauucagcggcagcggcagcggcaccgacuucacccugaccaucagcagccugcagagcgaggacuucgccguguacuacugccagcaguacgacaacuggccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30690 - RNA, 756 nt, Artificial Sequence
  derived and/or modified sequence opt4 from Brolucizumab_HeavyChain1
auggagaucgugaugacccagagccccagcacccugagcgccagcgugggcgacagagugaucaucaccugccaggccagcgagaucauccacagcuggcuggccugguaccagcagaagcccggcaaggcccccaagcugcugaucuaccuggccagcacccuggccagcggcgugcccagcagauucagcggcagcggcagcggcgccgaguucacccugaccaucagcagccugcagcccgacgacuucgccaccuacuacugccagaacguguaccuggccagcaccaacggcgccaacuucggccagggcaccaagcugaccgugcugggcggcggcggcggcagcggcggcggcggcagcggcggcggcggcagcggcggcggcggcagcgaggugcagcugguggagagcggcggcggccuggugcagcccggcggcagccugagacugagcugcaccgccagcggcuucagccugaccgacuacuacuacaugaccugggugagacaggcccccggcaagggccuggagugggugggcuucaucgaccccgacgacgaccccuacuacgccaccugggccaagggcagauucaccaucagcagagacaacagcaagaacacccuguaccugcagaugaacagccugagagccgaggacaccgccguguacuacugcgccggcggcgaccacaacagcggcuggggccuggacaucuggggccagggcacccuggugaccgugagcagc

SEQ ID NO: 30691 - RNA, 756 nt, Artificial Sequence; identical to SEQ ID NO: 30690
  derived and/or modified sequence opt4 from Brolucizumab_scFv_fragment

SEQ ID NO: 30692 - RNA, 1341 nt, Artificial Sequence
  derived and/or modified sequence opt4 from Brontictuzumab_HeavyChain1
caggugcagcuggugcagagcggcgccgaggugaagaagcccggcgccagcgugaagaucagcugcaaggugagcggcuacacccugagaggcuacuggaucgagugggugagacaggcccccggcaagggccuggaguggaucggccagauccugcccggcaccggcagaaccaacuacaacgagaaguucaagggcagagugaccaugaccgccgacaccagcaccgacaccgccuacauggagcugagcagccugagaagcgaggacaccgccguguacuacugcgccagauucgacggcaacuacggcuacuacgccauggacuacuggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30693 - RNA, 645 nt, Artificial Sequence
  derived and/or modified sequence opt4 from Brontictuzumab_LightChain1
caggccguggugacccaggagcccagccugaccgugagccccggcggcaccgugacccugaccugcagaagcagcaccggcgccgugaccaccagcaacuacgccaacugguuccagcagaagcccggccaggcccccagaacccugaucggcggcaccaacaacagagcccccggcgugcccgccagauucagcggcagccugcugggcggcaaggccgcccugacccugagcggcgcccagcccgaggacgaggccgaguacuacugcgcccugugguacagcaaccacuggguguucggcggcggcaccaagcugaccgugcugggccagcccaaggccgcccccagcgugacccuguucccccccagcagcgaggagcugcaggccaacaaggccacccuggugugccuggugagcgacuucuaccccggcgccgugaccguggccuggaaggccgacggcagccccgugaaggugggcguggagaccaccaagcccagcaagcagagcaacaacaaguacgccgccagcagcuaccugagccugacccccgagcaguggaagagccacagaagcuacagcugcagagugacccacgagggcagcaccguggagaagaccguggcccccgccgagugcagc

SEQ ID NO: 30694 - RNA, 1332 nt, Artificial Sequence
  derived and/or modified sequence opt4 from BTT-1023_HeavyChain1
caggugcagcugguggagagcggcggcggcguggugcagcccggcagaagccugagacugagcugcgccgccagcggcuucaccuucuucagcuacgccaugcacugggugagacagacccccggcaagggccuggaguggguggccgugaucugguucgacggcagcaacgagaacuacguggacagcgugaagggcagauucaccaucagcagagacaacagcaagaacacccuguaccugcagaugaacacccugagagccgaggacaccgccguguacuacugcgccagagacgccuggagcuacuucgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguucgccggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 30695 - RNA, 642 nt, Artificial Sequence
  derived and/or modified sequence opt4 from BTT-1023_LightChain1
gugauccagcugacccagagccccagcagccugagcgccagcgugggcgacagagugaccaucaccugcagagccagccagggcaucagcagagcccuggccugguaccagcagaagcccggcaagggccccaagcugcugaucuacgacgccagcagccuggagagcggcgugcccagcagauucagcggcagcggcagcggcaccgacuucacccugaccaucagcagccugcagcccgaggacuucgccaccuacuacugccagcaguucaacagcuacccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30696 - RNA, 1341 nt, Artificial Sequence
  derived and/or modified sequence opt4 from Burosumab_HeavyChain1
caggugcagcuggugcagagcggcgccgaggugaagaagcccggcgccagcgugaaggugagcugcaaggccagcggcuacaccuucaccaaccacuacaugcacugggugagacaggcccccggccagggccuggaguggaugggcaucaucaaccccaucagcggcagcaccagcaacgcccagaaguuccagggcagagugaccaugaccagagacaccagcaccagcaccguguacauggagcugagcagccugagaagcgaggacaccgccguguacuacugcgccagagacaucguggacgccuucgacuucuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30697 - RNA, 639 nt, Artificial Sequence
  derived and/or modified sequence opt4 from Burosumab_LightChain1
gccauccagcugacccagagccccagcagccugagcgccagcgugggcgacagagugaccaucaccugcagagccagccagggcaucagcagcgcccuggugugguaccagcagaagcccggcaaggcccccaagcugcugaucuacgacgccagcagccuggagagcggcgugcccagcagauucagcggcagcggcagcggcaccgacuucacccugaccaucagcagccugcagcccgaggacuucgccaccuacuacugccagcaguucaacgacuacuucaccuucggccccggcaccaagguggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30698 - RNA, 1344 nt, Artificial Sequence
  derived and/or modified sequence opt4 from Canakinumab_HeavyChain1
caggugcagcugguggagagcggcggcggcguggugcagcccggcagaagccugagacugagcugcgccgccagcggcuucaccuucagcguguacggcaugaacugggugagacaggcccccggcaagggccuggaguggguggccaucaucugguacgacggcgacaaccaguacuacgccgacagcgugaagggcagauucaccaucagcagagacaacagcaagaacacccuguaccugcagaugaacggccugagagccgaggacaccgccguguacuacugcgccagagaccugagaaccggccccuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30699 - RNA, 1344 nt, Artificial Sequence; identical to SEQ ID NO: 30698
  derived and/or modified sequence opt4 from Canakinumab_HeavyChain

SEQ ID NO: 30700 - RNA, 642 nt, Artificial Sequence
  derived and/or modified sequence opt4 from Canakinumab_LightChain1
gagaucgugcugacccagagccccgacuuccagagcgugacccccaaggagaaggugaccaucaccugcagagccagccagagcaucggcagcagccugcacugguaccagcagaagcccgaccagagccccaagcugcugaucaaguacgccagccagagcuucagcggcgugcccagcagauucagcggcagcggcagcggcaccgacuucacccugaccaucaacagccuggaggccgaggacgccgccgccuacuacugccaccagagcagcagccugcccuucaccuucggccccggcaccaagguggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30701 - RNA, 642 nt, Artificial Sequence; identical to SEQ ID NO: 30700
  derived and/or modified sequence opt4 from Canakinumab_LightChain

SEQ ID NO: 30702 - RNA, 1182 nt, Artificial Sequence
  derived and/or modified sequence opt4 from Canakinumab_LightChain_variant_8836_L
caggugcagcugguggagagcggcggcggcguggugcagcccggcagaagccugagacugagcugcgccgccagcggcuucaccuucagcguguacggcaugaacugggugagacaggcccccggcaagggccuggaguggguggccaucaucugguacgacggcgacaaccaguacuacgccgacagcgugaagggcagauucaccaucagcagagacaacagcaagaacacccuguaccugcagaugaacggccugagagccgaggacaccgccguguacuacugcgccagagaccugagaaccggccccuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuggagaucgugcugacccagagccccgacuuccagagcgugacccccaaggagaaggugaccaucaccugcagagccagccagagcaucggcagcagccugcacugguaccagcagaagcccgaccagagccccaagcugcugaucaaguacgccagccagagcuucagcggcgugcccagcagauucagcggcagcggcagcggcaccgacuucacccugaccaucaacagccuggaggccgaggacgccgccgccuacuacugccaccagagcagcagccugcccuucaccuucggccccggcaccaagguggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30703 - RNA, 1197 nt, Artificial Sequence
  derived and/or modified sequence opt4 from Cantuzumab_HeavyChain1
aucgacaccaccaccggcgagcccaccuacgcccagaaguuccagggcagaaucgccuucagccuggagaccagcgccagcaccgccuaccugcagaucaagagccugaagagcgaggacaccgccaccuacuucugcgccagaagaggccccuacaacugguacuucgacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30704 - RNA, 1347 nt, Artificial Sequence
  derived and/or modified sequence opt4 from Cantuzumab_HeavyChain
caggugcagcuggugcagagcggcgccgaggugaagaagcccggcgagaccgugaagaucagcugcaaggccagcgacuacaccuucaccuacuacggcaugaacugggugaagcaggcccccggccagggccugaaguggaugggcuggaucgacaccaccaccggcgagcccaccuacgcccagaaguuccagggcagaaucgccuucagccuggagaccagcgccagcaccgccuaccugcagaucaagagccugaagagcgaggacaccgccaccuacuucugcgccagaagaggccccuacaacugguacuucgacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30705 - RNA, 657 nt, Artificial Sequence
  derived and/or modified sequence opt4 from Cantuzumab_LightChain1
gacaucgugaugacccagagcccccugagcgugcccgugacccccggcgagcccgugagcaucagcugcagaagcagcaagagccugcugcacagcaacggcaacaccuaccuguacugguuccugcagagacccggccagagcccccagcugcugaucuacagaaugagcaaccuggugagcggcgugcccgacagauucagcggcagcggcagcggcaccgccuucacccugagaaucagcagaguggaggccgaggacgugggcguguacuacugccugcagcaccuggaguaccccuucaccuucggccccggcaccaagcuggagcugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30706 - RNA, 1344 nt, Artificial Sequence
  derived and/or modified sequence opt4 from Cantuzumab_mertansine_HeavyChain1
gugcagcuggugcagagcggcgccgaggugaagaagcccggcgagaccgugaagaucagcugcaaggccagcgacuacaccuucaccuacuacggcaugaacugggugaagcaggcccccggccagggccugaaguggaugggcuggaucgacaccaccaccggcgagcccaccuacgcccagaaguuccagggcagaaucgccuucagccuggagaccagcgccagcaccgccuaccugcagaucaagagccugaagagcgaggacaccgccaccuacuucugcgccagaagaggccccuacaacugguacuucgacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30707 - RNA, 657 nt, Artificial Sequence; identical to SEQ ID NO: 30705
  derived and/or modified sequence opt4 from Cantuzumab_mertansine_LightChain1

SEQ ID NO: 30708 - RNA, 1347 nt, Artificial Sequence; identical to SEQ ID NO: 30704
  derived and/or modified sequence opt4 from Cantuzumab_ravtansine_HeavyChain1

SEQ ID NO: 30709 - RNA, 657 nt, Artificial Sequence; identical to SEQ ID NO: 30705
  derived and/or modified sequence opt4 from Cantuzumab_ravtansine_LightChain1

SEQ ID NO: 30710 - RNA, 777 nt, Artificial Sequence
  derived and/or modified sequence opt4 from Caplacizumab
gaggugcagcugguggagagcggcggcggccuggugcagcccggcggcagccugagacugagcugcgccgccagcggcagaaccuucagcuacaaccccaugggcugguucagacaggcccccggcaagggcagagagcugguggccgccaucagcagaaccggcggcagcaccuacuaccccgacagcguggagggcagauucaccaucagcagagacaacgccaagagaaugguguaccugcagaugaacagccugagagccgaggacaccgccguguacuacugcgccgccgccggcgugagagccgaggacggcagagugagaacccugcccagcgaguacaccuucuggggccagggcacccaggugaccgugagcagcgccgccgccgaggugcagcugguggagagcggcggcggccuggugcagcccggcggcagccugagacugagcugcgccgccagcggcagaaccuucagcuacaaccccaugggcugguucagacaggcccccggcaagggcagagagcugguggccgccaucagcagaaccggcggcagcaccuacuaccccgacagcguggagggcagauucaccaucagcagagacaacgccaagagaaugguguaccugcagaugaacagccugagagccgaggacaccgccguguacuacugcgccgccgccggcgugagagccgaggacggcagagugagaacccugcccagcgaguacaccuucuggggccagggcacccaggugaccgugagcagc

SEQ ID NO: 30711 - RNA, 777 nt, Artificial Sequence; identical to SEQ ID NO: 30710
  derived and/or modified sequence opt4 from Caplacizumab_HeavyChain1

SEQ ID NO: 30712 - RNA, 777 nt, Artificial Sequence; identical to SEQ ID NO: 30710
  derived and/or modified sequence opt4 from Caplacizumab_HeavyChain1

SEQ ID NO: 30713 - RNA, 1347 nt, Artificial Sequence
  derived and/or modified sequence opt4 from Carlumab_HeavyChain1
caggugcagcuggugcagagcggcgccgaggugaagaagcccggcagcagcgugaaggugagcugcaaggccagcggcggcaccuucagcagcuacggcaucagcugggugagacaggcccccggccagggccuggaguggaugggcggcaucauccccaucuucggcaccgccaacuacgcccagaaguuccagggcagagugaccaucaccgccgacgagagcaccagcaccgccuacauggagcugagcagccugagaagcgaggacaccgccguguacuacugcgccagauacgacggcaucuacggcgagcuggacuucuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30714 - RNA, 648 nt, Artificial Sequence
  derived and/or modified sequence opt4 from Carlumab_LightChain1
gagaucgugcugacccagagccccgccacccugagccugagccccggcgagagagccacccugagcugcagagccagccagagcgugagcgacgccuaccuggccugguaccagcagaagcccggccaggcccccagacugcugaucuacgacgccagcagcagagccaccggcgugcccgccagauucagcggcagcggcagcggcaccgacuucacccugaccaucagcagccuggagcccgaggacuucgccguguacuacugccaccaguacauccagcugcacagcuucaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30715 - RNA, 1353 nt, Artificial Sequence
  derived and/or modified sequence opt4 from Cergutuzumab_amunaleukin_HeavyChain1
caggugcagcuggugcagagcggcgccgaggugaagaagcccggcgccagcgugaaggugagcugcaaggccagcggcuacaccuucaccgaguucggcaugaacugggugagacaggcccccggccagggccuggaguggaugggcuggaucaacaccaagaccggcgaggccaccuacguggaggaguucaagggcagagugaccuucaccaccgacaccagcaccagcaccgccuacauggagcugagaagccugagaagcgacgacaccgccguguacuacugcgccagaugggacuucgccuacuacguggaggccauggacuacuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgaggccgccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugggcgcccccaucgagaagaccaucagcaaggccaagggccagcccagagagccccaggugugcacccugccccccagcagagacgagcugaccaagaaccaggugagccugagcugcgccgugaagggcuucuaccccagcgacaucgccguggagugggagagcaacggccagcccgagaacaacuacaagaccaccccccccgugcuggacagcgacggcagcuucuuccuggugagcaagcugaccguggacaagagcagauggcagcagggcaacguguucagcugcagcgugaugcacgaggcccugcacaaccacuacacccagaagagccugagccugagccccggcaag

SEQ ID NO: 30716 - RNA, 1794 nt, Artificial Sequence
  derived and/or modified sequence opt4 from Cergutuzumab_amunaleukin_HeavyChain2
caggugcagcuggugcagagcggcgccgaggugaagaagcccggcgccagcgugaaggugagcugcaaggccagcggcuacaccuucaccgaguucggcaugaacugggugagacaggcccccggccagggccuggaguggaugggcuggaucaacaccaagaccggcgaggccaccuacguggaggaguucaagggcagagugaccuucaccaccgacaccagcaccagcaccgccuacauggagcugagaagccugagaagcgacgacaccgccguguacuacugcgccagaugggacuucgccuacuacguggaggccauggacuacuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgaggccgccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugggcgcccccaucgagaagaccaucagcaaggccaagggccagcccagagagccccagguguacacccugccccccugcagagacgagcugaccaagaaccaggugagccuguggugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcggcggcggcggcagcggcggcggcggcagcggcggcggcggcagcgcccccgccagcagcagcaccaagaagacccagcugcagcuggagcaccugcugcuggaccugcagaugauccugaacggcaucaacaacuacaagaaccccaagcugaccagaaugcugaccgccaaguucgccaugcccaagaaggccaccgagcugaagcaccugcagugccuggaggaggagcugaagccccuggaggaggugcugaacggcgcccagagcaagaacuuccaccugagacccagagaccugaucagcaacaucaacgugaucgugcuggagcugaagggcagcgagaccaccuucaugugcgaguacgccgacgagaccgccaccaucguggaguuccugaacagauggaucaccuucgcccagagcaucaucagcacccugacc

SEQ ID NO: 30717 - RNA, 645 nt, Artificial Sequence
  derived and/or modified sequence opt4 from Cergutuzumab_amunaleukin_LightChain1
gacauccagaugacccagagccccagcagccugagcgccagcgugggcgacagagugaccaucaccugcaaggccagcgccgccgugggcaccuacguggccugguaccagcagaagcccggcaaggcccccaagcugcugaucuacagcgccagcuacagaaagagaggcgugcccagcagauucagcggcagcggcagcggcaccgacuucacccugaccaucagcagccugcagcccgaggacuucgccaccuacuacugccaccaguacuacaccuacccccuguucaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30718 - RNA, 687 nt, Artificial Sequence
  derived and/or modified sequence opt4 from Certolizumab_pegol_HeavyChain1
gaggugcagcugguggagagcggcggcggccuggugcagcccggcggcagccugagacugagcugcgccgccagcggcuacguguucaccgacuacggcaugaacugggugagacaggcccccggcaagggccuggaguggaugggcuggaucaacaccuacaucggcgagcccaucuacgccgacagcgugaagggcagauucaccuucagccuggacaccagcaagagcaccgccuaccugcagaugaacagccugagagccgaggacaccgccguguacuacugcgccagaggcuacagaagcuacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcgccgcc

SEQ ID NO: 30719 - RNA, 687 nt, Artificial Sequence; identical to SEQ ID NO: 30718
  derived and/or modified sequence opt4 from Certolizumab_pegol_HeavyChain

SEQ ID NO: 30720 - RNA, 642 nt, Artificial Sequence
  derived and/or modified sequence opt4 from Certolizumab_pegol_LightChain1
gacauccagaugacccagagccccagcagccugagcgccagcgugggcgacagagugaccaucaccugcaaggccagccagaacgugggcaccaacguggccugguaccagcagaagcccggcaaggcccccaaggcccugaucuacagcgccagcuuccuguacagcggcgugcccuacagauucagcggcagcggcagcggcaccgacuucacccugaccaucagcagccugcagcccgaggacuucgccaccuacuacugccagcaguacaacaucuacccccugaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30721 - RNA, 642 nt, Artificial Sequence; identical to SEQ ID NO: 30720
  derived and/or modified sequence opt4 from Certolizumab_pegol_LightChain

SEQ ID NO: 30722 - RNA, 1356 nt, Artificial Sequence
  derived and/or modified sequence opt4 from Cetuximab_HeavyChain
caggugcagcugaagcagagcggccccggccuggugcagcccagccagagccugagcaucaccugcaccgugagcggcuucagccugaccaacuacggcgugcacugggugagacagagccccggcaagggccuggaguggcugggcgugaucuggagcggcggcaacaccgacuacaacacccccuucaccagcagacugagcaucaacaaggacaacagcaagagccagguguucuucaagaugaacagccugcagagcaacgacaccgccaucuacuacugcgccagagcccugaccuacuacgacuacgaguucgccuacuggggccagggcacccuggugaccgugagcgccgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagccccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30723 - RNA, 1347 nt, Artificial Sequence
  derived and/or modified sequence opt4 from Cetuximab_HeavyChain_variant
caggugcagcugaagcagagcggccccggccuggugcagcccagccagagccugagcaucaccugcaccgugagcggcuucagccugaccaacuacggcgugcacugggugagacagagccccggcaagggccuggaguggcugggcgugaucuggagcggcggcaacaccgacuacaacacccccuucaccagcagacugagcaucaacaaggacaacagcaagagccagguguucuucaagaugaacagccugcagagcaacgacaccgccaucuacuacugcgccagagcccugaccuacuacgacuacgaguucgccuacuggggccagggcacccuggugaccgugagcgccgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30724 - RNA, 639 nt, Artificial Sequence
  derived and/or modified sequence opt4 from Cetuximab_LightChain
gacauccugcugacccagagccccgugauccugagcgugagccccggcgagagagugagcuucagcugcagagccagccagagcaucggcaccaacauccacugguaccagcagagaaccaacggcagccccagacugcugaucaaguacgccagcgagagcaucagcggcauccccagcagauucagcggcagcggcagcggcaccgacuucacccugagcaucaacagcguggagagcgaggacaucgccgacuacuacugccagcagaacaacaacuggcccaccaccuucggcgccggcaccaagcuggagcugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgcc

SEQ ID NO: 30725 - RNA, 642 nt, Artificial Sequence
  derived and/or modified sequence opt4 from Cetuximab_LightChain_variant
gacauccugcugacccagagccccgugauccugagcgugagccccggcgagagagugagcuucagcugcagagccagccagagcaucggcaccaacauccacugguaccagcagagaaccaacggcagccccagacugcugaucaaguacgccagcgagagcaucagcggcauccccagcagauucagcggcagcggcagcggcaccgacuucacccugagcaucaacagcguggagagcgaggacaucgccgacuacuacugccagcagaacaacaacuggcccaccaccuucggcgccggcaccaagcuggagcugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30726 - RNA, 675 nt, Artificial Sequence
  derived and/or modified sequence opt4 from Citatuzumab_bogatox_HeavyChain1
caccaccaccaccaccacgaggugcagcuggugcagagcggccccggccuggugcagcccggcggcagcgugagaaucagcugcgccgccagcggcuacaccuucaccaacuacggcaugaacugggugaagcaggcccccggcaagggccuggaguggaugggcuggaucaacaccuacaccggcgagagcaccuacgccgacagcuucaagggcagauucaccuucagccuggacaccagcgccagcgccgccuaccugcagaucaacagccugagagccgaggacaccgccguguacuacugcgccagauucgccaucaagggcgacuacuggggccagggcacccugcugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugc

SEQ ID NO: 30727 - RNA, 1443 nt, Artificial Sequence
  derived and/or modified sequence opt4 from Citatuzumab_bogatox_LightChain1
gacauccagaugacccagagccccagcagccugagcgccagcgugggcgacagagugaccaucaccugcagaagcaccaagagccugcugcacagcaacggcaucaccuaccuguacugguaccagcagaagcccggcaaggcccccaagcugcugaucuaccagaugagcaaccuggccagcggcgugcccagcagauucagcagcagcggcagcggcaccgacuucacccugaccaucagcagccugcagcccgaggacuucgccaccuacuacugcgcccagaaccuggagauccccagaaccuucggccagggcaccaagguggagcugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugcaccagacacagacagcccagaggcugggagcagcuguacaacaccgugagcuucaaccugggcgaggccuacgaguaccccaccuucauccaggaccugagaaacgagcuggccaagggcacccccgugugccagcugcccgugacccugcagaccaucgccgacgacaagagauucgugcugguggacaucaccaccaccagcaagaagaccgugaagguggccaucgacgugaccgacguguacguggugggcuaccaggacaagugggacggcaaggacagagccguguuccuggacaaggugcccaccguggccaccagcaagcuguuccccggcgugaccaacagagugacccugaccuucgacggcagcuaccagaagcuggugaacgccgccaaggccgacagaaaggcccuggagcugggcgugaacaagcuggaguucagcaucgaggccauccacggcaagaccaucaacggccaggaggccgccaaguucuuccugaucgugauccagauggugagcgaggccgccagauucaaguacaucgagaccgaggugguggacagaggccuguacggcagcuucaagcccaacuucaaggugcugaaccuggagaacaacuggggcgacaucagcgacgccauccacaagagcagcccccagugcaccaccaucaaccccgcccugcagcugaucagccccagcaacgaccccuggguggugaacaaggugagccagaucagccccgacaugggcauccugaaguucaagagcagcaag

SEQ ID NO: 30728 - RNA, 1380 nt, Artificial Sequence
  derived and/or modified sequence opt4 from Cixutumumab_HeavyChain1
gaggugcagcuggugcagagcggcgccgaggugaagaagcccggcagcagcgugaaggugagcugcaaggccagcggcggcaccuucagcagcuacgccaucagcugggugagacaggcccccggccagggccuggaguggaugggcggcaucauccccaucuucggcaccgccaacuacgcccagaaguuccagggcagagugaccaucaccgccgacaagagcaccagcaccgccuacauggagcugagcagccugagaagcgaggacaccgccguguacuacugcgccagagccccccugagauuccuggaguggagcacccaggaccacuacuacuacuacuacauggacguguggggcaagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30729 - RNA, 642 nt, Artificial Sequence
  derived and/or modified sequence opt4 from Cixutumumab_LightChain1
agcagcgagcugacccaggaccccgccgugagcguggcccugggccagaccgugagaaucaccugccagggcgacagccugagaagcuacuacgccaccugguaccagcagaagcccggccaggcccccauccuggugaucuacggcgagaacaagagacccagcggcauccccgacagauucagcggcagcagcagcggcaacaccgccagccugaccaucaccggcgcccaggccgaggacgaggccgacuacuacugcaagagcagagacggcagcggccagcaccugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccgccgagugcagc

SEQ ID NO: 30730 - RNA, 1350 nt, Artificial Sequence
  derived and/or modified sequence opt4 from Clazakizumab_HeavyChain1
gaggugcagcugguggagagcggcggcggccuggugcagcccggcggcagccugagacugagcugcgccgccagcggcuucagccugagcaacuacuacgugaccugggugagacaggcccccggcaagggccuggagugggugggcaucaucuacggcagcgacgagaccgccuacgccaccagcgccaucggcagauucaccaucagcagagacaacagcaagaacacccuguaccugcagaugaacagccugagagccgaggacaccgccguguacuacugcgccagagacgacagcagcgacugggacgccaaguucaaccuguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacgccagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30731 - RNA, 651 nt, Artificial Sequence
  derived and/or modified sequence opt4 from Clazakizumab_LightChain1
gccauccagaugacccagagccccagcagccugagcgccagcgugggcgacagagugaccaucaccugccaggccagccagagcaucaacaacgagcugagcugguaccagcagaagcccggcaaggcccccaagcugcugaucuacagagccagcacccuggccagcggcgugcccagcagauucagcggcagcggcagcggcaccgacuucacccugaccaucagcagccugcagcccgacgacuucgccaccuacuacugccagcagggcuacagccugagaaacaucgacaacgccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30732 - RNA, 1347 nt, Artificial Sequence
  derived and/or modified sequence opt4 from Clivatuzumab_tetraxetan_HeavyChain1
caggugcagcugcagcagagcggcgccgaggugaagaagcccggcgccagcgugaaggugagcugcgaggccagcggcuacaccuuccccagcuacgugcugcacugggugaagcaggcccccggccagggccuggaguggaucggcuacaucaaccccuacaacgacggcacccaguacaacgagaaguucaagggcaaggccacccugaccagagacaccagcaucaacaccgccuacauggagcugagcagacugagaagcgacgacaccgccguguacuacugcgccagaggcuucggcggcagcuacggcuucgccuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30733 - RNA, 645 nt, Artificial Sequence
  derived and/or modified sequence opt4 from Clivatuzumab_tetraxetan_LightChain1
gacauccagcugacccagagccccagcagccugagcgccagcgugggcgacagagugaccaugaccugcagcgccagcagcagcgugagcagcagcuaccuguacugguaccagcagaagcccggcaaggcccccaagcuguggaucuacagcaccagcaaccuggccagcggcgugcccgccagauucagcggcagcggcagcggcaccgacuucacccugaccaucagcagccugcagcccgaggacagcgccagcuacuucugccaccaguggaacagauaccccuacaccuucggcggcggcaccagacuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30734 - RNA, 1335 nt, Artificial Sequence
  derived and/or modified sequence opt4 from Codrituzumab_HeavyChain1
caggugcagcuggugcagagcggcgccgaggugaagaagcccggcgccagcgugaaggugagcugcaaggccagcggcuacaccuucaccgacuacgagaugcacugggugagacaggcccccggccagggccuggaguggaugggcgcccuggaccccaagaccggcgacaccgccuacagccagaaguucaagggcagagugacccugaccgccgacaagagcaccagcaccgccuacauggagcugagcagccugaccagcgaggacaccgccguguacuacugcaccagauucuacagcuacaccuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30735 - RNA, 657 nt, Artificial Sequence
  derived and/or modified sequence opt4 from Codrituzumab_LightChain1
gacguggugaugacccagagcccccugagccugcccgugacccccggcgagcccgccagcaucagcugcagaagcagccagagccuggugcacagcaacagaaacaccuaccugcacugguaccugcagaagcccggccagagcccccagcugcugaucuacaaggugagcaacagauucagcggcgugcccgacagauucagcggcagcggcagcggcaccgacuucacccugaagaucagcagaguggaggccgaggacgugggcguguacuacugcagccagaacacccacgugccccccaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30736 - RNA, 1350 nt, Artificial Sequence
  derived and/or modified sequence opt4 from Coltuximab_ravtansine_HeavyChain1
caggugcagcuggugcagcccggcgccgagguggugaagcccggcgccagcgugaagcugagcugcaagaccagcggcuacaccuucaccagcaacuggaugcacugggugaagcaggcccccggccagggccuggaguggaucggcgagaucgaccccagcgacagcuacaccaacuacaaccagaacuuccagggcaaggccaagcugaccguggacaagagcaccagcaccgccuacauggaggugagcagccugagaagcgacgacaccgccguguacuacugcgccagaggcagcaaccccuacuacuacgccauggacuacuggggccagggcaccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30737 - RNA, 633 nt, Artificial Sequence
  derived and/or modified sequence opt4 from Coltuximab_ravtansine_LightChain1
gagaucgugcugacccagagccccgccaucaugagcgccagccccggcgagagagugaccaugaccugcagcgccagcagcggcgugaacuacaugcacugguaccagcagaagcccggcaccagccccagaagauggaucuacgacaccagcaagcuggccagcggcgugcccgccagauucagcggcagcggcagcggcaccgacuacagccugaccaucagcagcauggagcccgaggacgccgccaccuacuacugccaccagagaggcagcuacaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30738 - RNA, 1356 nt, Artificial Sequence
  derived and/or modified sequence opt4 from Conatumumab_CV_HeavyChain
caggugcagcugcaggagagcggccccggccuggugaagcccagccagacccugagccugaccugcaccgugagcggcggcagcaucagcagcggcgacuacuucuggagcuggaucagacagcugcccggcaagggccuggaguggaucggccacauccacaacagcggcaccaccuacuacaaccccagccugaagagcagagugaccaucagcguggacaccagcaagaagcaguucagccugagacugagcagcgugaccgccgccgacaccgccguguacuacugcgccagagacagaggcggcgacuacuacuacggcauggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30739 - RNA, 645 nt, Artificial Sequence
  derived and/or modified sequence opt4 from Conatumumab_CV_LightChain
gagaucgugcugacccagagccccggcacccugagccugagccccggcgagagagccacccugagcugcagagccagccagggcaucagcagaagcuaccuggccugguaccagcagaagcccggccaggcccccagccugcugaucuacggcgccagcagcagagccaccggcauccccgacagauucagcggcagcggcagcggcaccgacuucacccugaccaucagcagacuggagcccgaggacuucgccguguacuacugccagcaguucggcagcagccccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30740 - RNA, 1356 nt, Artificial Sequence; identical to SEQ ID NO: 30738
  derived and/or modified sequence opt4 from Conatumumab_HeavyChain1

SEQ ID NO: 30741 - RNA, 1356 nt, Artificial Sequence; identical to SEQ ID NO: 30738
  derived and/or modified sequence opt4 from Conatumumab_HeavyChain

SEQ ID NO: 30742 - RNA, 645 nt, Artificial Sequence; identical to SEQ ID NO: 30739
  derived and/or modified sequence opt4 from Conatumumab_LightChain1

SEQ ID NO: 30743 - RNA, 645 nt, Artificial Sequence; identical to SEQ ID NO: 30739
  derived and/or modified sequence opt4 from Conatumumab_LightChain

SEQ ID NO: 30744 - RNA, 1344 nt, Artificial Sequence
  derived and/or modified sequence opt4 from Concizumab_HeavyChain1
gaggugcagcugguggagagcggcggcggccuggugaagcccggcggcagccugagacugagcugcgccgccagcggcuucaccuucagcaacuacgccaugagcugggugagacagacccccgagaagagacuggaguggguggccaccaucagcagaagcggcagcuacagcuacuuccccgacagcgugcagggcagauucaccaucagcagagacaacgccaagaacagccuguaccugcagaugaacagccugagagccgaggacaccgccguguacuacugcgccagacugggcggcuacgacgagggcgacgccauggacagcuggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 30745 - RNA, 657 nt, Artificial Sequence
  derived and/or modified sequence opt4 from Concizumab_LightChain1
gacaucgugaugacccagaccccccugagccugagcgugacccccggccagcccgccagcaucagcugcaagagcagccagagccugcuggagagcgacggcaagaccuaccugaacugguaccugcagaagcccggccagagcccccagcugcugaucuaccuggugagcauccuggacagcggcgugcccgacagauucagcggcagcggcagcggcaccgacuucacccugaagaucagcagaguggaggccgaggacgugggcguguacuacugccugcaggccacccacuucccccagaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30746 - RNA, 1314 nt, Artificial Sequence
  derived and/or modified sequence opt4 from Crenezumab_HeavyChain1
gaggugcagcugguggagagcggcggcggccuggugcagcccggcggcagccugagacugagcugcgccgccagcggcuucaccuucagcagcuacggcaugagcugggugagacaggcccccggcaagggccuggagcugguggccagcaucaacagcaacggcggcagcaccuacuaccccgacagcgugaagggcagauucaccaucagcagagacaacgccaagaacagccuguaccugcagaugaacagccugagagccgaggacaccgccguguacuacugcgccagcggcgacuacuggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggc

SEQ ID NO: 30747 - RNA, 657 nt, Artificial Sequence
  derived and/or modified sequence opt4 from Crenezumab_LightChain1
gacaucgugaugacccagagcccccugagccugcccgugacccccggcgagcccgccagcaucagcugcagaagcagccagagccugguguacagcaacggcgacaccuaccugcacugguaccugcagaagcccggccagagcccccagcugcugaucuacaaggugagcaacagauucagcggcgugcccgacagauucagcggcagcggcagcggcaccgacuucacccugaagaucagcagaguggaggccgaggacgugggcguguacuacugcagccagagcacccacgugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30748 - RNA, 1365 nt, Artificial Sequence
  derived and/or modified sequence opt4 from Crotedumab_HeavyChain1
gaggugcagcugguggagagcggcggcggccuggugcagcccggcggcagccugagacugagcugcgccgccagcggcuucaccuucagcaacuaccugaugaacugggugagacaggcccccggcaagggccuggaguggcuggccaacauccaggaggacggcaucgagaaguacuacguggacagcgugaagggcagauucaccaucagcagagacaacgccaagaacagccuguaccugcagaugaacagccugagagccgaggacaccgccguguacuacugcgccagagagcccagccacuacgacauccugaccggcuacgacuacuacuacggcauggacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcaacaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 30749 - RNA, 1365 nt, Artificial Sequence
  derived and/or modified sequence opt4 from Crotedumab_HeavyChain2
gaggugcagcugguggagagcggcggcggccuggugcagcccggcggcagccugcaccugagcugcgccgccagcggcuucaccuucagcaacuaccugaugaacugggugagacaggcccccggcaagggccuggaguggcuggccaacauccaggaggacggcaucgagaaguacuacguggacagcgugaagggcagauucaccaucagcagagacaacgccaagaacagccuguaccugcagaugaacagccugagagccgaggacaccgccguguacuacugcgccagagagcccagccacuacgacauccugaccggcuacgacuacuacuacggcauggacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcaacaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccgagguggacgagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucuggagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacgagagcagauggcaggagcacaacguguucagcugcagcgugaugcacgaggcccugcacaaccacuacacccagaagagccugagccugagccugggcaag

SEQ ID NO: 30750 - RNA, 642 nt, Artificial Sequence
  derived and/or modified sequence opt4 from Crotedumab_LightChain1
gacauccagaugacccagagccccagcagccugagcgccagcgugggcgacagagugaccaucaccugcagagccagccagggcaucagaaacgaccugggcugguaccagcagaagcccggcaaggcccccaagagacugaucuacgccgccagcagccugcagagcggcgugcccagcagauucagcggcagcggcagcggcaccgaguucauccugaccgugagcagccugcagcccgaggacuucgccaccuacuacugccugcaguacaacgagaaccccuucaccuucggccccggcaccaagguggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgaggagcacaagguguacgccugcgaggugacccaccagggccugagcagccccgugaccaagagcuucaacagaggcgagugc

SEQ ID NO: 30751 - RNA, 642 nt, Artificial Sequence
  derived and/or modified sequence opt4 from Crotedumab_LightChain2
gacauccagaugacccagagccccagcagccugagcgccagcgugggcgacagagugaccaucaccugcagagccagccagggcaucagaaacgaccugggcugguaccagcagaagcccggcaaggcccccaagagacugaucuacgccgccagcagccugcagagcggcgugcccagcagauucagcggcagcggcagcggcaccgaguucauccugaccgugagcagccugcagcccgaggacuucgccaccuacuacugccugcaguacaacagcaaccccuucaccuucggccccggcaccaagguggacaucaagagaaccguggccgcccccagcguguucaucuucccccccagcgacgagcagcugaagagcggcaccgccagcguggugugccugcugaacaacuucuaccccagagaggccaaggugcagaacaagguggacaacgcccugcagagcggcaacagccaggagagcgugaccgagcaggacagcaaggacagcaccuacagccugagcagcacccugacccugagcgaggccgacuacgagaagcacaagguguacgccugcgaggugacccaccagggccugagcagccccgugaccaagagcuucaacagaggcgagugc

SEQ ID NO: 30752 - RNA, 1332 nt, Artificial Sequence
  derived and/or modified sequence opt4 from Dacetuzumab_HeavyChain1
gaggugcagcugguggagagcggcggcggccuggugcagcccggcggcagccugagacugagcugcgccgccagcggcuacagcuucaccggcuacuacauccacugggugagacaggcccccggcaagggccuggaguggguggccagagugauccccaacgccggcggcaccagcuacaaccagaaguucaagggcagauucacccugagcguggacaacagcaagaacaccgccuaccugcagaugaacagccugagagccgaggacaccgccguguacuacugcgccagagagggcaucuacugguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30753 - RNA, 657 nt, Artificial Sequence
  derived and/or modified sequence opt4 from Dacetuzumab_LightChain1
gacauccagaugacccagagccccagcagccugagcgccagcgugggcgacagagugaccaucaccugcagaagcagccagagccuggugcacagcaacggcaacaccuuccugcacugguaccagcagaagcccggcaaggcccccaagcugcugaucuacaccgugagcaacagauucagcggcgugcccagcagauucagcggcagcggcagcggcaccgacuucacccugaccaucagcagccugcagcccgaggacuucgccaccuacuucugcagccagaccacccacgugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30754 - RNA, 318 nt, Artificial Sequence
  derived and/or modified sequence opt4 from Dacliximab_LightChain_VJ-Region
gacauccagaugacccagagccccagcacccugagcgccagcgugggcgacagagugaccaucaccugcagcgccagcagcagcaucagcuacaugcacugguaccagcagaagcccggcaaggcccccaagcugcugaucuacaccaccagcaaccuggccagcggcgugcccgccagauucagcggcagcggcagcggcaccgaguucacccugaccaucagcagccugcagcccgacgacuucgccaccuacuacugccaccagagaagcaccuacccccugaccuucggccagggcaccaagguggaggugaag

SEQ ID NO: 30755 - RNA, 348 nt, Artificial Sequence
  derived and/or modified sequence opt4 from Dacliximab_gamma2-Chain_VDJ-Region
caggugcagcuggugcagagcggcgccgaggugaagaagcccggcagcagcgugaaggugagcugcaaggccagcggcuacaccuucaccagcuacagaaugcacugggugagacaggcccccggccagggccuggaguggaucggcuacaucaaccccagcaccggcuacaccgaguacaaccagaaguucaaggacaaggccaccaucaccgccgacgagagcaccaacaccgccuacauggagcugagcagccugagaagcgaggacaccgccguguacuacugcgccagaggcggcggcguguucgacuacuggggccagggcacccuggugaccgugagcagc

SEQ ID NO: 30756 - RNA, 1326 nt, Artificial Sequence
  derived and/or modified sequence opt4 from Daclizumab_HeavyChain
caggugcagcuggugcagagcggcgccgaggugaagaagcccggcagcagcgugaaggugagcugcaaggccagcggcuacaccuucaccagcuacagaaugcacugggugagacaggcccccggccagggccuggaguggaucggcuacaucaaccccagcaccggcuacaccgaguacaaccagaaguucaaggacaaggccaccaucaccgccgacgagagcaccaacaccgccuacauggagcugagcagccugagaagcgaggacaccgccguguacuacugcgccagaggcggcggcguguucgacuacuggggccagggcaccacccugaccgugagcagcggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggccgagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30757 - RNA, 630 nt, Artificial Sequence
  derived and/or modified sequence opt4 from Daclizumab_LightChain
gacauccagaugacccagagccccagcacccugagcgccagcgugggcgacagagugaccaucaccugcagcgccagcagcagcaucagcuacaugcacugguaccagcagaagcccggcaaggcccccaagcugcugaucuacaccaccagcaaccuggccagcggcgugcccgccagauucagcggcagcggcagcggcaccgaguucacccugaccaucagcagccugcagcccgacgacuucgccaccuacuacugccaccagagaagcaccuacccccugaccuucggcagcggcaccaagguggaggugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacaga

SEQ ID NO: 30758 - RNA, 1341 nt, Artificial Sequence
  derived and/or modified sequence opt4 from Dalotuzumab_HeavyChain1
caggugcagcugcagcagagcggccccggccuggugaagcccagccagacccugagccugaccugcaccgugagcggcuggagcaucagcggcggcuggcuguggaacuggaucagacagccccccggcaagggccugcaguggaucggcuggaucagcugggacggcaccaacaacuggaagcccagccugaaggacagagugaccaucagcguggacaccagcaagaaccaguucagccugaagcugagcagcgugaccgccgccgacaccgccgugugguggugcgccagauggggcagaguguucuucgacugguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30759 - RNA, 657 nt, Artificial Sequence
  derived and/or modified sequence opt4 from Dalotuzumab_LightChain1
gacaucgugaugacccagagcccccugagccugcccgugacccccggccagcccgccagcaucagcugcagaagcagccagagcaucgugcacagcaacggcaacaccuggcugcagugguggcugcagaagcccggccagagcccccagcugcugaucuggaaggugagcaacagacuguggggcgugcccgacagauucagcggcagcggcagcggcaccgacuucacccugaagaucagcagagugcaggcccaggacgugggcgugugguggugcuuccagggcagccacgugcccuggaccuucggccagggcaccaaggugcagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30760 - RNA, 687 nt, Artificial Sequence
  derived and/or modified sequence opt4 from Dapirolizumab_pegol_HeavyChain1
gaggugcagcugguggagagcggcggcggccuggugcagcccggcggcagccugagacugagcugcgccgugagcggcuucagcagcaccaacuaccacgugcacugggugagacaggcccccggcaagggccuggaguggaugggcgugaucuggggcgacggcgacaccagcuacaacagcgugcugaagagcagauucaccaucagcagagacaccagcaagaacaccguguaccugcagaugaacagccugagagccgaggacaccgccguguacuacugcgccagacagcugacccacuacuacgugcuggccgccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcgccgcc

SEQ ID NO: 30761 - RNA, 642 nt, Artificial Sequence
  derived and/or modified sequence opt4 from Dapirolizumab_pegol_LightChain1
gacauccagaugacccagagccccagcagccugagcgccagcgugggcgacagagugaccaucaccugcagagccagcgaggaccuguacuacaaccuggccugguaccagagaaagcccggcaaggcccccaagcugcugaucuacgacaccuacagacuggccgacggcgugcccagcagauucagcggcagcggcagcggcaccgacuacacccugaccaucagcagccugcagcccgaggacuucgccagcuacuacugccagcaguacuacaaguuccccuucaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30762 - RNA, 1356 nt, Artificial Sequence
  derived and/or modified sequence opt4 from Daratumumab_HeavyChain1
gaggugcagcugcuggagagcggcggcggccuggugcagcccggcggcagccugagacugagcugcgccgugagcggcuucaccuucaacagcuucgccaugagcugggugagacaggcccccggcaagggccuggagugggugagcgccaucagcggcagcggcggcggcaccuacuacgccgacagcgugaagggcagauucaccaucagcagagacaacagcaagaacacccuguaccugcagaugaacagccugagagccgaggacaccgccguguacuucugcgccaaggacaagauccugugguucggcgagcccguguucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30763 - RNA, 642 nt, Artificial Sequence
  derived and/or modified sequence opt4 from Daratumumab_LightChain1
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggccccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30764 - RNA, 1350 nt, Artificial Sequence
  derived and/or modified sequence opt4 from Dectrekumab_HeavyChain1
gaggugcagcugguggagagcggcggcggcguggugcagcccggcagaagccugagacugagcugcgccgccagcggcuucaccuucagcagcuacggcaugcacugggugagacaggcccccggcaagggccuggaguggguggccaucaucugguacgacggcagcaacaaguacuacgccgacagcgugaagggcagauucaccaucagcagagacaacagcaagaacacccuguaccugcagaugaacagccugagagccgaggacaccgccguguacuacugcgccagacugugguucggcgaccuggacgccuucgacaucuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30765 - RNA, 648 nt, Artificial Sequence
  derived and/or modified sequence opt4 from Dectrekumab_LightChain1
gagaucgugcugacccagagccccgccacccugagccugagccccggcgagagagccauccugagcugcagagccggccagagcgugagcagcuaccuggugugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcagcuggccccccguguacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30766 - RNA, 1332 nt, Artificial Sequence
  derived and/or modified sequence opt4 from Demcizumab_HeavyChain1
caggugcagcuggugcagagcggcgccgaggugaagaagcccggcgccagcgugaagaucagcugcaaggccagcggcuacagcuucaccgccuacuacauccacugggugaagcaggcccccggccagggccuggaguggaucggcuacaucagcagcuacaacggcgccaccaacuacaaccagaaguucaagggcagagugaccuucaccaccgacaccagcaccagcaccgccuacauggagcugagaagccugagaagcgacgacaccgccguguacuacugcgccagagacuacgacuacgacgugggcauggacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30767 - RNA, 654 nt, Artificial Sequence
  derived and/or modified sequence opt4 from Demcizumab_LightChain1
gacaucgugaugacccagagccccgacagccuggccgugagccugggcgagagagccaccaucagcugcagagccagcgagagcguggacaacuacggcaucagcuucaugaagugguuccagcagaagcccggccagccccccaagcugcugaucuacgccgccagcaaccagggcagcggcgugcccgacagauucagcggcagcggcagcggcaccgacuucacccugaccaucagcagccugcaggccgaggacguggccguguacuacugccagcagagcaaggaggugcccuggaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30768 - RNA, 1350 nt, Artificial Sequence
  derived and/or modified sequence opt4 from Denintuzumab_mafodotin_HeavyChain1
caggugcagcugcaggagagcggccccggccuggugaagcccagccagacccugagccugaccugcaccgugagcggcggcagcaucagcaccagcggcaugggcgugggcuggaucagacagcaccccggcaagggccuggaguggaucggccacaucuggugggacgacgacaagagauacaaccccgcccugaagagcagagugaccaucagcguggacaccagcaagaaccaguucagccugaagcugagcagcgugaccgccgccgacaccgccguguacuacugcgccagaauggagcuguggagcuacuacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30769 - RNA, 639 nt, Artificial Sequence
  derived and/or modified sequence opt4 from Denintuzumab_mafodotin_LightChain1
gagaucgugcugacccagagccccgccacccugagccugagccccggcgagagagccacccugagcugcagcgccagcagcagcgugagcuacaugcacugguaccagcagaagcccggccaggcccccagacugcugaucuacgacaccagcaagcuggccagcggcauccccgccagauucagcggcagcggcagcggcaccgacuucacccugaccaucagcagccuggagcccgaggacguggccguguacuacugcuuccagggcagcguguaccccuucaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30770 - RNA, 1356 nt, Artificial Sequence
  derived and/or modified sequence opt4 from Denosumab_HeavyChain
gaggugcagcugcuggagagcggcggcggccuggugcagcccggcggcagccugagacugagcugcgccgccagcggcuucaccuucagcagcuacgccaugagcugggugagacaggcccccggcaagggccuggagugggugagcggcaucaccggcagcggcggcagcaccuacuacgccgacagcgugaagggcagauucaccaucagcagagacaacagcaagaacacccuguaccugcagaugaacagccugagagccgaggacaccgccguguacuacugcgccaaggaccccggcaccaccgugaucaugagcugguucgaccccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30771 - RNA, 645 nt, Artificial Sequence
  derived and/or modified sequence opt4 from Denosumab_LightChain
gagaucgugcugacccagagccccggcacccugagccugagccccggcgagagagccacccugagcugcagagccagccagagcgugagaggcagauaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguucuacugccagcaguacggcagcagccccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30772 - RNA, 1338 nt, Artificial Sequence
  derived and/or modified sequence opt4 from Depatuxizumab_HeavyChain1
caggugcagcugcaggagagcggccccggccuggugaagcccagccagacccugagccugaccugcaccgugagcggcuacagcaucagcagcgacuucgccuggaacuggaucagacagccccccggcaagggccuggaguggaugggcuacaucagcuacagcggcaacaccagauaccagcccagccugaagagcagaaucaccaucagcagagacaccagcaagaaccaguucuuccugaagcugaacagcgugaccgccgccgacaccgccaccuacuacugcgugaccgccggcagaggcuuccccuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30773 - RNA, 642 nt, Artificial Sequence
  derived and/or modified sequence opt4 from Depatuxizumab_LightChain1
gacauccagaugacccagagccccagcagcaugagcgugagcgugggcgacagagugaccaucaccugccacagcagccaggacaucaacagcaacaucggcuggcugcagcagaagcccggcaagagcuucaagggccugaucuaccacggcaccaaccuggacgacggcgugcccagcagauucagcggcagcggcagcggcaccgacuacacccugaccaucagcagccugcagcccgaggacuucgccaccuacuacugcgugcaguacgcccaguuccccuggaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30774 - RNA, 1338 nt, Artificial Sequence; identical to SEQ ID NO: 30772
  derived and/or modified sequence opt4 from Depatuxizumab_mafodotin_HeavyChain1

SEQ ID NO: 30775 - RNA, 642 nt, Artificial Sequence; identical to SEQ ID NO: 30773
  derived and/or modified sequence opt4 from Depatuxizumab_mafodotin_LightChain1

SEQ ID NO: 30776 - RNA, 1329 nt, Artificial Sequence
  derived and/or modified sequence opt4 from Dinutuximab_beta_HeavyChain1
gaggugcagcugcugcagagcggccccgagcuggagaagcccggcgccagcgugaugaucagcugcaaggccagcggcagcagcuucaccggcuacaacaugaacugggugagacagaacaucggcaagagccuggaguggaucggcgccaucgaccccuacuacggcggcaccagcuacaaccagaaguucaagggcagagccacccugaccguggacaagagcagcagcaccgccuacaugcaccugaagagccugaccagcgaggacagcgccguguacuacugcgugagcggcauggaguacuggggccagggcaccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30777 - RNA, 660 nt, Artificial Sequence
  derived and/or modified sequence opt4 from Dinutuximab_beta_LightChain1
gagaucgugaugacccagagccccgccacccugagcgugagccccggcgagagagccacccugagcugcagaagcagccagagccuggugcacagaaacggcaacaccuaccugcacugguaccugcagaagcccggccagagccccaagcugcugauccacaaggugagcaacagauucagcggcgugcccgacagauucagcggcagcggcagcggcaccgacuucacccugaagaucagcagaguggaggccgaggaccugggcguguacuucugcagccagagcacccacgugcccccccugaccuucggcgccggcaccaagcuggagcugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30778 - RNA, 1329 nt, Artificial Sequence; identical to SEQ ID NO: 30776
  derived and/or modified sequence opt4 from Dinutuximab_HeavyChain1

SEQ ID NO: 30779 - RNA, 660 nt, Artificial Sequence; identical to SEQ ID NO: 30777
  derived and/or modified sequence opt4 from Dinutuximab_LightChain1

SEQ ID NO: 30780 - RNA, 660 nt, Artificial Sequence; identical to SEQ ID NO: 30777
  derived and/or modified sequence opt4 from Dinutuximab_LightChain

SEQ ID NO: 30781 - RNA, 1350 nt, Artificial Sequence
  derived and/or modified sequence opt4 from Diridavumab_HeavyChain1
gaggugcagcugguggagagcggcgccgaggugaagaagcccggcagcagcgugaaggugagcugcaaggccagcggcggccccuucagaagcuacgccaucagcugggugagacaggcccccggccagggccccgaguggaugggcggcaucauccccaucuucggcaccaccaaguacgcccccaaguuccagggcagagugaccaucaccgccgacgacuucgccggcaccguguacauggagcugagcagccugagaagcgaggacaccgccauguacuacugcgccaagcacaugggcuaccaggugagagagaccauggacguguggggcaagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30782 - RNA, 651 nt, Artificial Sequence
  derived and/or modified sequence opt4 from Diridavumab_LightChain1
cagagcgugcugacccagccccccagcgugagcgccgcccccggccagaaggugaccaucagcugcagcggcagcagcagcaacaucggcaacgacuacgugagcugguaccagcagcugcccggcaccgcccccaagcugcugaucuacgacaacaacaagagacccagcggcauccccgacagauucagcggcagcaagagcggcaccagcgccacccugggcaucaccggccugcagaccggcgacgaggccaacuacuacugcgccaccugggacagaagacccaccgccuacgugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 30783 - RNA, 1338 nt, Artificial Sequence
  derived and/or modified sequence opt4 from Domagrozumab_HeavyChain1
gaggugcagcugcuggagagcggcggcggccuggugcagcccggcggcagccugagacugagcugcgccgccagcggcuucaccuucagcagcuacgccaugagcugggugagacaggcccccggcaagggccuggagugggugagcaccaucagcagcggcggcagcuacaccagcuaccccgacagcgugaagggcagauucaccaucagcagagacaacagcaagaacacccuguaccugcagaugaacagccugagagccgaggacaccgccguguacuacugcgccaagcaggacuacgccaugaacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgaggccgccggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30784 - RNA, 1335 nt, Artificial Sequence
  derived and/or modified sequence opt4 from Domagrozumab_HeavyChain
gaggugcagcugcuggagagcggcggcggccuggugcagcccggcggcagccugagacugagcugcgccgccagcggcuucaccuucagcagcuacgccaugagcugggugagacaggcccccggcaagggccuggagugggugagcaccaucagcagcggcggcagcuacaccagcuaccccgacagcgugaagggcagauucaccaucagcagagacaacagcaagaacacccuguaccugcagaugaacagccugagagccgaggacaccgccguguacuacugcgccaagcaggacuacgccaugaacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgaggccgccggcgcccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30785 - RNA, 642 nt, Artificial Sequence
  derived and/or modified sequence opt4 from Domagrozumab_LightChain1
gacauccagaugacccagagccccagcagccugagcgccagcgugggcgacagagugaccaucaccugcaaggccagccaggacgugagcaccgccguggccugguaccagcagaagcccggcaaggcccccaagcugcugaucuacagcgccagcuacagauacaccggcgugcccagcagauucagcggcagcggcagcggcaccgacuucacccugaccaucagcagccugcagcccgaggacuucgccaccuacuacugccagcagcacuacagcacccccuggaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30786 - RNA, 1335 nt, Artificial Sequence
  derived and/or modified sequence opt4 from Drozituab_HeavyChain1
gaggugcagcuggugcagagcggcggcggcguggagagacccggcggcagccugagacugagcugcgccgccagcggcuucaccuucgacgacuacgccagcugggugagacaggcccccggcaagggccuggagugggugagcggcaucaacuggcagggcggcagcaccggcuacgccgacagcgugaagggcagagugaccaucagcagagacaacgccaagaacagccuguaccugcagaacagccugagagccgaggacaccgccguguacuacugcgccaagauccugggcgccggcagaggcugguacuucgacuacuggggcaagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggc

SEQ ID NO: 30787 - RNA, 639 nt, Artificial Sequence
  derived and/or modified sequence opt4 from Drozituab_LightChain1
agcgagcugacccaggaccccgccgugagcguggcccugggccagaccgugagaaucaccugcagcggcgacagccugagaagcuacuacgccagcugguaccagcagaagcccggccaggcccccgugcuggugaucuacggcgccaacaacagacccagcggcauccccgacagauucagcggcagcagcagcggcaacaccgccagccugaccaucaccggcgcccaggccgaggacgaggccgacuacuacugcaacagcgccgacagcagcggcaaccacgugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacaagagcuacagcugccaggugacccacgagggcagcaccguggagaagaccguggcccccaccgagugcagc

SEQ ID NO: 30788 - RNA, 1353 nt, Artificial Sequence
  derived and/or modified sequence opt4 from Drozitumab_HeavyChain1
gaggugcagcuggugcagagcggcggcggcguggagagacccggcggcagccugagacugagcugcgccgccagcggcuucaccuucgacgacuacgccaugagcugggugagacaggcccccggcaagggccuggagugggugagcggcaucaacuggcagggcggcagcaccggcuacgccgacagcgugaagggcagagugaccaucagcagagacaacgccaagaacagccuguaccugcagaugaacagccugagagccgaggacaccgccguguacuacugcgccaagauccugggcgccggcagaggcugguacuucgacuacuggggcaagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30789 - RNA, 639 nt, Artificial Sequence; identical to SEQ ID NO: 30787
  derived and/or modified sequence opt4 from Drozitumab_LightChain1

SEQ ID NO: 30790 - RNA, 1353 nt, Artificial Sequence
  derived and/or modified sequence opt4 from Duligotumab_HeavyChain1
gaggugcagcugguggagagcggcggcggccuggugcagcccggcggcagccugagacugagcugcgccgccagcggcuucacccugagcggcgacuggauccacugggugagacaggcccccggcaagggccuggagugggugggcgagaucagcgccgccggcggcuacaccgacuacgccgacagcgugaagggcagauucaccaucagcgccgacaccagcaagaacaccgccuaccugcagaugaacagccugagagccgaggacaccgccguguacuacugcgccagagagagcagagugagcuucgaggccgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30791 - RNA, 642 nt, Artificial Sequence
  derived and/or modified sequence opt4 from Duligotumab_LightChain1
gacauccagaugacccagagccccagcagccugagcgccagcgugggcgacagagugaccaucaccugcagagccagccagaacaucgccaccgacguggccugguaccagcagaagcccggcaaggcccccaagcugcugaucuacagcgccagcuuccuguacagcggcgugcccagcagauucagcggcagcggcagcggcaccgacuucacccugaccaucagcagccugcagcccgaggacuucgccaccuacuacugccagcagagcgagcccgagcccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30792 - RNA, 1353 nt, Artificial Sequence; identical to SEQ ID NO: 30790
  derived and/or modified sequence opt4 from Duligotuzumab_HeavyChain1

SEQ ID NO: 30793 - RNA, 642 nt, Artificial Sequence; identical to SEQ ID NO: 30791
  derived and/or modified sequence opt4 from Duligotuzumab_LightChain1

SEQ ID NO: 30794 - RNA, 1353 nt, Artificial Sequence
  derived and/or modified sequence opt4 from Dupilumab_HeavyChain1
gaggugcagcugguggagagcggcggcggccuggagcagcccggcggcagccugagacugagcugcgccggcagcggcuucaccuucagagacuacgccaugaccugggugagacaggcccccggcaagggccuggagugggugagcagcaucagcggcagcggcggcaacaccuacuacgccgacagcgugaagggcagauucaccaucagcagagacaacagcaagaacacccuguaccugcagaugaacagccugagagccgaggacaccgccguguacuacugcgccaaggacagacugagcaucaccaucagacccagauacuacggccuggacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggc

SEQ ID NO: 30795 - RNA, 657 nt, Artificial Sequence
  derived and/or modified sequence opt4 from Dupilumab_LightChain1
gacaucgugaugacccagagcccccugagccugcccgugacccccggcgagcccgccagcaucagcugcagaagcagccagagccugcuguacagcaucggcuacaacuaccuggacugguaccugcagaagagcggccagagcccccagcugcugaucuaccugggcagcaacagagccagcggcgugcccgacagauucagcggcagcggcagcggcaccgacuucacccugaagaucagcagaguggaggccgaggacgugggcuucuacuacugcaugcaggcccugcagacccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30796 - RNA, 1353 nt, Artificial Sequence
  derived and/or modified sequence opt4 from Durvalumab_HeavyChain1
gaggugcagcugguggagagcggcggcggccuggugcagcccggcggcagccugagacugagcugcgccgccagcggcuucaccuucagcagauacuggaugagcugggugagacaggcccccggcaagggccuggaguggguggccaacaucaagcaggacggcagcgagaaguacuacguggacagcgugaagggcagauucaccaucagcagagacaacgccaagaacagccuguaccugcagaugaacagccugagagccgaggacaccgccguguacuacugcgccagagagggcggcugguucggcgagcuggccuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgaguucgagggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgccagcaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30797 - RNA, 645 nt, Artificial Sequence
  derived and/or modified sequence opt4 from Durvalumab_LightChain1
gagaucgugcugacccagagccccggcacccugagccugagccccggcgagagagccacccugagcugcagagccagccagagagugagcagcagcuaccuggccugguaccagcagaagcccggccaggcccccagacugcugaucuacgacgccagcagcagagccaccggcauccccgacagauucagcggcagcggcagcggcaccgacuucacccugaccaucagcagacuggagcccgaggacuucgccguguacuacugccagcaguacggcagccugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30798 - RNA, 1338 nt, Artificial Sequence
  derived and/or modified sequence opt4 from Dusigitumab_HeavyChain1
caggugcagcuggugcagagcggcgccgaggugaagaagcccggcgccagcgugaaggugagcugcaaggccagcggcuacaccuucaccagcuacgacaucaacugggugagacaggccaccggccagggccuggaguggaugggcuggaugaaccccaacagcggcaacaccggcuacgcccagaaguuccagggcagagugaccaugaccagaaacaccagcaucagcaccgccuacauggagcugagcagccugagaagcgaggacaccgccguguacuacugcgccagagaccccuacuacuacuacuacggcauggacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30799 - RNA, 651 nt, Artificial Sequence
  derived and/or modified sequence opt4 from Dusigitumab_LightChain1
cagagcgugcugacccagccccccagcgugagcgccgcccccggccagaaggugaccaucagcugcagcggcagcagcagcaacaucgagaacaaccacgugagcugguaccagcagcugcccggcaccgcccccaagcugcugaucuacgacaacaacaagagacccagcggcauccccgacagauucagcggcagcaagagcggcaccagcgccacccugggcaucaccggccugcagaccggcgacgaggccgacuacuacugcgagaccugggacaccagccugagcgccggcagaguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 30800 - RNA, 1347 nt, Artificial Sequence
  derived and/or modified sequence opt4 from Ecromeximab_HeavyChain1
gaggugacccugguggagagcggcggcgacuucgugaagcccggcggcagccugaaggugagcugcgccgccagcggcuucgccuucagccacuacgccaugagcugggugagacagacccccgccaagagacuggaguggguggccuacaucagcagcggcggcagcggcaccuacuacagcgacagcgugaagggcagauucaccaucagcagagacaacgccaagaacacccuguaccugcagaugagaagccugagaagcgaggacagcgccauguacuucugcaccagagugaagcugggcaccuacuacuucgacagcuggggccagggcaccacccugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30801 - RNA, 642 nt, Artificial Sequence
  derived and/or modified sequence opt4 from Ecromeximab_LightChain1
gacauccagaugacccagaccgccagcagccugcccgccagccugggcgacagagugaccaucagcugcagcgccagccaggacaucagcaacuaccugaacugguaccagcagaagcccgacggcaccgugaagcugcugaucuucuacagcagcaaccugcacagcggcgugcccagcagauucagcggcggcggcagcggcaccgacuacagccugaccaucagcaaccuggagcccgaggacaucgccaccuacuucugccaccaguacagcaagcugcccuggaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30802 - RNA, 1341 nt, Artificial Sequence
  derived and/or modified sequence opt4 from Eculizumab_HeavyChain1
gugcagcuggugcagagcggcgccgaggugaagaagcccggcgccagcgugaaggugagcugcaaggccagcggcuacaucuucagcaacuacuggauccagugggugagacaggcccccggccagggccuggaguggaugggcgagauccugcccggcagcggcagcaccgaguacaccgagaacuucaaggacagagugaccaugaccagagacaccagcaccagcaccguguacauggagcugagcagccugagaagcgaggacaccgccguguacuacugcgccagauacuucuucggcagcagccccaacugguacuucgacguguggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 30803 - RNA, 642 nt, Artificial Sequence
  derived and/or modified sequence opt4 from Eculizumab_LightChain1
gacauccagaugacccagagccccagcagccugagcgccagcgugggcgacagagugaccaucaccugcggcgccagcgagaacaucuacggcgcccugaacugguaccagcagaagcccggcaaggcccccaagcugcugaucuacggcgccaccaaccuggccgacggcgugcccagcagauucagcggcagcggcagcggcaccgacuucacccugaccaucagcagccugcagcccgaggacuucgccaccuacuacugccagaacgugcugaacaccccccugaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30804 - RNA, 375 nt, Artificial Sequence
  derived and/or modified sequence opt4 from Efalizumab_HeavyChain
gaggugcagcugguggagagcggcggcggccuggugcagcccggcggcagccugagacugagcugcgccgccagcggcuacagcuucaccggccacuggaugaacugggugagacaggcccccggcaagggccuggagugggugggcaucaugauccaccccagcgacagcgagaccagauacaaccagaaguucaaggacaucagauucaccaucagcguggacaagagcaagaacacccuguaccugcagaugaacagccugagagccgaggacaccgccguguacuacugcgccagaaucggcaucuacuucuacggcaccaccuacuucgacuacaucuggggccagggcacccuggugaccgugagcagc

SEQ ID NO: 30805 - RNA, 324 nt, Artificial Sequence
  derived and/or modified sequence opt4 from Efalizumab_LightChain
gacauccagaugacccagagccccagcagccugagcgccagcgugggcgacagagugaccaucaccugcagagccagcaagaccaucagcaaguaccuggccugguaccagcagaagcccggcaaggcccccaagcugcugaucuacagcggcagcacccugcagagcggcgugcccagcagauucagcggcagcggcagcggcaccgacuucacccugaccaucagcagccugcagcccgaggacuucgccaccuacuacugccagcagcacaacgaguacccccugaccuucggccagggcaccaagguggagaucaagaga

SEQ ID NO: 30806 - RNA, 768 nt, Artificial Sequence
  derived and/or modified sequence opt4 from Efungumab_SingleChain_variable_fragment
auggccgaggugcagcugguggagagcggcgccgaggugaagaagcccggcgagagccugagaaucagcugcaagggcagcggcugcaucaucagcagcuacuggaucagcugggugagacagaugcccggcaagggccuggaguggaugggcaagaucgaccccggcgacagcuacaucaacuacagccccagcuuccagggccacgugaccaucagcgccgacaagagcaucaacaccgccuaccugcaguggaacagccugaaggccagcgacaccgccauguacuacugcgccagaggcggcagagacuucggcgacagcuucgacuacuggggccagggcacccuggugaccgugagcagcggcggcggcggcagcggcggcggcggcagcggcggcggcggcagcgacguggugaugacccagagccccagcuuccugagcgccuucgugggcgacagaaucaccaucaccugcagagccagcagcggcaucagcagauaccuggccugguaccagcaggcccccggcaaggcccccaagcugcugaucuacgccgccagcacccugcagaccggcgugcccagcagauucagcggcagcggcagcggcaccgaguucacccugaccaucaacagccugcagcccgaggacuucgccaccuacuacugccagcaccugaacagcuacccccugaccuucggcggcggcaccaagguggacaucaagagagccgccgcccuggagcaccaccaccaccaccac

SEQ ID NO: 30807 - RNA, 1362 nt, Artificial Sequence
  derived and/or modified sequence opt4 from Eldelumab_HeavyChain1
cagaugcagcugguggagagcggcggcggcguggugcagcccggcagaagccugagacugagcugcaccgccagcggcuucaccuucagcaacaacggcaugcacugggugagacaggcccccggcaagggccuggaguggguggccgugaucugguucgacggcaugaacaaguucuacguggacagcgugaagggcagauucaccaucagcagagacaacagcaagaacacccuguaccuggagaugaacagccugagagccgaggacaccgccaucuacuacugcgccagagagggcgacggcagcggcaucuacuacuacuacggcauggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30808 - RNA, 648 nt, Artificial Sequence
  derived and/or modified sequence opt4 from Eldelumab_LightChain1
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagccccaucuucaccuucggccccggcaccaagguggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30809 - RNA, 1341 nt, Artificial Sequence
  derived and/or modified sequence opt4 from Elgemtumab_HeavyChain1
gaggugcagcugcuggagagcggcggcggccuggugcagcccggcggcagccugagacugagcugcgccgccagcggcuucaccuucagcagcuacgccaugagcugggugagacaggcccccggcaagggccuggagugggugagcgccaucaacagccagggcaagagcaccuacuacgccgacagcgugaagggcagauucaccaucagcagagacaacagcaagaacacccuguaccugcagaugaacagccugagagccgaggacaccgccguguacuacugcgccagauggggcgacgagggcuucgacaucuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30810 - RNA, 642 nt, Artificial Sequence
  derived and/or modified sequence opt4 from Elgemtumab_LightChain1
gacauccagaugacccagagccccagcagccugagcgccagcgugggcgacagagugaccaucaccugcagagccagccagggcaucagcaacuggcuggccugguaccagcagaagcccggcaaggcccccaagcugcugaucuacggcgccagcagccugcagagcggcgugcccagcagauucagcggcagcggcagcggcaccgacuucacccugaccaucagcagccugcagcccgaggacuucgccaccuacuacugccagcaguacagcagcuuccccaccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30811 - RNA, 1347 nt, Artificial Sequence
  derived and/or modified sequence opt4 from Elotuzumab_HeavyChain1
gaggugcagcugguggagagcggcggcggccuggugcagcccggcggcagccugagacugagcugcgccgccagcggcuucgacuucagcagauacuggaugagcugggugagacaggcccccggcaagggccuggaguggaucggcgagaucaaccccgacagcagcaccaucaacuacgcccccagccugaaggacaaguucaucaucagcagagacaacgccaagaacagccuguaccugcagaugaacagccugagagccgaggacaccgccguguacuacugcgccagacccgacggcaacuacugguacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30812 - RNA, 642 nt, Artificial Sequence
  derived and/or modified sequence opt4 from Elotuzumab_LightChain1
gacauccagaugacccagagccccagcagccugagcgccagcgugggcgacagagugaccaucaccugcaaggccagccaggacgugggcaucgccguggccugguaccagcagaagcccggcaaggugcccaagcugcugaucuacugggccagcaccagacacaccggcgugcccgacagauucagcggcagcggcagcggcaccgacuucacccugaccaucagcagccugcagcccgaggacguggccaccuacuacugccagcaguacagcagcuaccccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30813 - RNA, 1338 nt, Artificial Sequence
  derived and/or modified sequence opt4 from Emactuzumab_HeavyChain1
caggugcagcuggugcagagcggcgccgaggugaagaagcccggcgccagcgugaaggugagcugcaaggccagcggcuacaccuucaccagcuacgacaucagcugggugagacaggcccccggccagggccuggaguggaugggcgugaucuggaccgacggcggcaccaacuacgcccagaagcugcagggcagagugaccaugaccaccgacaccagcaccagcaccgccuacauggagcugagaagccugagaagcgacgacaccgccguguacuacugcgccagagaccagagacuguacuucgacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30814 - RNA, 639 nt, Artificial Sequence
  derived and/or modified sequence opt4 from Emactuzumab_LightChain1
gacauccagaugacccagagccccagcagccugagcgccagcgugggcgacagagugaccaucaccugcagagccagcgaggacgugaacaccuacgugagcugguaccagcagaagcccggcaaggcccccaagcugcugaucuacgccgccagcaacagauacaccggcgugcccagcagauucagcggcagcggcagcggcaccgacuucacccugaccaucagcagccugcagcccgaggacuucgccaccuacuacugccagcagagcuucagcuaccccaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30815 - RNA, 1323 nt, Artificial Sequence
  derived and/or modified sequence opt4 from Emibetuzumab_HeavyChain1
caggugcagcuggugcagagcggcgccgaggugaagaagcccggcgccagcgugaaggugagcugcaaggccagcggcuacaccuucaccgacuacuacaugcacugggugagacaggcccccggccagggccuggaguggaugggcagagugaaccccaacagaagaggcaccaccuacaaccagaaguucgagggcagagugaccaugaccaccgacaccagcaccagcaccgccuacauggagcugagaagccugagaagcgacgacaccgccguguacuacugcgccagagccaacuggcuggacuacuggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaggccgccggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggc

SEQ ID NO: 30816 - RNA, 645 nt, Artificial Sequence
  derived and/or modified sequence opt4 from Emibetuzumab_LightChain1
gacauccagaugacccagagccccagcagccugagcgccagcgugggcgacagagugaccaucaccugcagcgugagcagcagcgugagcagcaucuaccugcacugguaccagcagaagcccggcaaggcccccaagcugcugaucuacagcaccagcaaccuggccagcggcgugcccagcagauucagcggcagcggcagcggcaccgacuucacccugaccaucagcagccugcagcccgaggacuucgccaccuacuacugccagguguacagcggcuacccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30817 - RNA, 1344 nt, Artificial Sequence
  derived and/or modified sequence opt4 from Emicizumab_HeavyChain1
caggugcagcugguggagagcggcggcggccuggugcagcccggcggcagccugagacugagcugcgccgccagcggcuucaccuucagcuacuacgacauccagugggugagacaggcccccggcaagggccuggagugggugagcagcaucagccccagcggccagagcaccuacuacagaagagaggugaagggcagauucaccaucagcagagacaacagcaagaacacccuguaccugcagaugaacagccugagagccgaggacaccgccguguacuacugcgccagaagaaccggcagagaguacggcggcggcugguacuucgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccagaaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcaggagggcaacguguucagcugcagcgugaugcacgaggcccugcacaacagauacacccagaagagccugagccugagcccc

SEQ ID NO: 30818 - RNA, 1332 nt, Artificial Sequence
  derived and/or modified sequence opt4 from Emicizumab_HeavyChain2
caggugcagcuggugcagagcggcagcgagcugaagaagcccggcgccagcgugaaggugagcugcaaggccagcggcuacaccuucaccgacaacaacauggacugggugagacaggcccccggccagggccuggaguggaugggcgacaucaacaccagaagcggcggcagcaucuacaacgaggaguuccaggacagagugaucaugaccguggacaagagcaccgacaccgccuacauggagcugagcagccugagaagcgaggacaccgccaccuaccacugcgccagaagaaagagcuacggcuacuaccuggacgaguggggcgagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcaggagggcaacguguucagcugcagcgugaugcacgaggcccugcacaaccacuacacccaggagagccugagccugagcccc

SEQ ID NO: 30819 - RNA, 642 nt, Artificial Sequence
  derived and/or modified sequence opt4 from Emicizumab_LightChain1
gacauccagaugacccagagccccagcagccugagcgccagcgugggcgacagagugaccaucaccugcaaggccagcagaaacaucgagagacagcuggccugguaccagcagaagcccggccaggcccccgagcugcugaucuaccaggccagcagaaaggagagcggcgugcccgacagauucagcggcagcagauacggcaccgacuucacccugaccaucagcagccugcagcccgaggacaucgccaccuacuacugccagcaguacagcgaccccccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30820 - RNA, 1347 nt, Artificial Sequence
  derived and/or modified sequence opt4 from Enavatuzumab_HeavyChain1
gaggugcagcugguggagagcggcggcggccuggugcagcccggcggcagccugagacugagcugcgccgccagcggcuucaccuucagcagcuacuggaugagcugggugagacaggcccccggcaagggccuggaguggguggccgagaucagacugaagagcgacaacuacgccacccacuacgccgagagcgugaagggcagauucaccaucagcagagacgacagcaagaacagccuguaccugcagaugaacagccugagagccgaggacaccgccguguacuacugcaccggcuacuacgccgacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30821 - RNA, 654 nt, Artificial Sequence
  derived and/or modified sequence opt4 from Enavatuzumab_LightChain1
gacauccagaugacccagagccccagcagccugagcgccagcgugggcgacagagugaccaucaccugcagagccagccagagcgugagcaccagcagcuacagcuacaugcacugguaccagcagaagcccggcaaggcccccaagcugcugaucaaguacgccagcaaccuggagagcggcgugcccagcagauucagcggcagcggcagcggcaccgacuucacccugaccaucagcagccugcagcccgaggacuucgccaccuacuacugccagcacagcugggagauccccuacaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30822 - RNA, 1341 nt, Artificial Sequence
  derived and/or modified sequence opt4 from Enfortumab_HeavyChain
gaggugcagcugguggagagcggcggcggccuggugcagcccggcggcagccugagacugagcugcgccgccagcggcuucaccuucagcagcuacaacaugaacugggugagacaggcccccggcaagggccuggagugggugagcuacaucagcagcagcagcagcaccaucuacuacgccgacagcgugaagggcagauucaccaucagcagagacaacgccaagaacagccugagccugcagaugaacagccugagagacgaggacaccgccguguacuacugcgccagagccuacuacuacggcauggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30823 - RNA, 642 nt, Artificial Sequence
  derived and/or modified sequence opt4 from Enfortumab_LightChain
gacauccagaugacccagagccccagcagcgugagcgccagcgugggcgacagagugaccaucaccugcagagccagccagggcaucagcggcuggcuggccugguaccagcagaagcccggcaaggcccccaaguuccugaucuacgccgccagcacccugcagagcggcgugcccagcagauucagcggcagcggcagcggcaccgacuucacccugaccaucagcagccugcagcccgaggacuucgccaccuacuacugccagcaggccaacagcuucccccccaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30824 - RNA, 1341 nt, Artificial Sequence; identical to SEQ ID NO: 30822
  derived and/or modified sequence opt4 from Enfortumab_vedotin_HeavyChain1

SEQ ID NO: 30825 - RNA, 642 nt, Artificial Sequence; identical to SEQ ID NO: 30823
  derived and/or modified sequence opt4 from Enfortumab_vedotin_LightChain1

SEQ ID NO: 30826 - RNA, 1356 nt, Artificial Sequence
  derived and/or modified sequence opt4 from Enoblituzumab_HeavyChain
gaggugcagcugguggagagcggcggcggccuggugcagcccggcggcagccugagacugagcugcgccgccagcggcuucaccuucagcagcuucggcaugcacugggugagacaggcccccggcaagggccuggaguggguggccuacaucagcagcgacagcagcgccaucuacuacgccgacaccgugaagggcagauucaccaucagcagagacaacgccaagaacagccuguaccugcagaugaacagccugagagacgaggacaccgccguguacuacugcggcagaggcagagagaacaucuacuacggcagcagacuggacuacuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcuggugggcggccccagcguguuccugcugccccccaagcccaaggacacccugaugaucagcagaacccccgaggugaccugcguggugguggacgugagccacgaggaccccgaggugaaguucaacugguacguggacggcguggaggugcacaacgccaagaccaagccccccgaggagcaguacaacagcacccugagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccuggugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30827 - RNA, 642 nt, Artificial Sequence
  derived and/or modified sequence opt4 from Enoblituzumab_LightChain
gacauccagcugacccagagccccagcuuccugagcgccagcgugggcgacagagugaccaucaccugcaaggccagccagaacguggacaccaacguggccugguaccagcagaagcccggcaaggcccccaaggcccugaucuacagcgccagcuacagauacagcggcgugcccagcagauucagcggcagcggcagcggcaccgacuucacccugaccaucagcagccugcagcccgaggacuucgccaccuacuacugccagcaguacaacaacuaccccuucaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30828 - RNA, 1356 nt, Artificial Sequence
  derived and/or modified sequence opt4 from Enokizumab_HeavyChain1
caggugcagcuggugcagagcggcgccgaggugaagaagcccggcagcagcgugaaggugagcugcaaggccagcggcggcaccuucagcuacuacuggaucgagugggugagacaggcccccggccagggccuggaguggaugggcgagauccugcccggcagcggcaccaccaaccccaacgagaaguucaagggcagagugaccaucaccgccgacgagagcaccagcaccgccuacauggagcugagcagccugagaagcgaggacaccgccguguacuacugcgccagagccgacuacuacggcagcgacuacgugaaguucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30829 - RNA, 642 nt, Artificial Sequence
  derived and/or modified sequence opt4 from Enokizumab_LightChain1
gacauccagaugacccagagccccagcagccugagcgccagcgugggcgacagagugaccaucaccugcaaggccagccagcacgugaucacccacgugaccugguaccagcagaagcccggcaaggcccccaagcugcugaucuacggcaccagcuacagcuacagcggcgugcccagcagauucagcggcagcggcagcggcaccgacuucacccugaccaucagcagccugcagcccgaggacuucgccaccuacuacugccagcaguucuacgaguacccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30830 - RNA, 612 nt, Artificial Sequence
  derived and/or modified sequence opt4 from Enokizumab_LightChain
gacauccagaugacccagagccccagcagccugagcgccagcgugggcgacagagugaccaucaccugcaaggccagccagcacgugaucacccacgugaccugguaccagcagaagcccggcaaggcccccaagcugcugaucuacggcaccagcuacagcuacagcggcgugcccagcagauucagcggcagcggcagcggcaccgacuucacccugaccaucagcagccugcagcccgaggacuucgccaccuacuacugccagcaguucuacgaguacccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30831 - RNA, 1356 nt, Artificial Sequence
  derived and/or modified sequence opt4 from Enoticumab_HeavyChain1
caggugcagcugguggagagcggcggcggcguggugcagcccggcagaagccugagacugagcugcgccgccagcggcuucaccuucagcagcuacggcaugcacugggugagacaggcccccggcaagggccuggagugggugagcuuccugugguacgacggcaccaacaagaacuacguggagagcgugaagggcagauucaccaucagcagagacaacagcaagaacaugcuguaccuggagaugaacagccugagagccgaggacaccgccguguacuacugcgccagagaccacgacuucagaagcggcuacgagggcugguucgaccccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30832 - RNA, 642 nt, Artificial Sequence
  derived and/or modified sequence opt4 from Enoticumab_LightChain1
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcacagaagcaacuggccccccaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30833 - RNA, 1329 nt, Artificial Sequence
  derived and/or modified sequence opt4 from Ensituximab_HeavyChain1
caggugcagcugaaggagagcggccccgaccugguggcccccagccagagccugagcaucaccugcaccgugagcggcuucagccugagcaaguucggcgugaacugggugagacagccccccggcaagggccuggaguggcugggcgugaucuggggcgacggcagcaccagcuacaacagcggccugaucagcagacugagcaucagcaaggagaacagcaagagccagguguuccugaagcugaacagccugcaggccgacgacaccgccaccuacuacugcgugaagcccggcggcgacuacuggggccacggcaccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccccuacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaugccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30834 - RNA, 639 nt, Artificial Sequence
  derived and/or modified sequence opt4 from Ensituximab_LightChain1
cagguggugcugacccagagccccgugaucaugagcgccagccccggcgagaaggugaccaugaccugcagcgccagcagcagcaucagcuacauguacugguaccagcagaagcccggcaccagccccaagagauggaucuacgacaccagcaagcuggccagcggcgugcccgccagauucagcggcagcggcagcggcaccagcuacagccugaccaucagcaacauggaggccggcgacgccgccaccuacuacugccaccagagagacagcuaccccuggaccuucggcggcggcaccaaccuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30835 - RNA, 768 nt, Artificial Sequence; identical to SEQ ID NO: 30806
  derived and/or modified sequence opt4 from Ensituximab_SingleChain_variable_fragment

SEQ ID NO: 30836 - RNA, 987 nt, Artificial Sequence
  derived and/or modified sequence opt4 from Entolimod_chain1
augagaggcagccaccaccaccaccaccacggcauggccagcaugaccggcggccagcagaugggcagagaccuguacgacgacgacgacaaggaccccauggcccaggugaucaacaccaacagccugagccugcugacccagaacaaccugaacaagagccagagcagccugagcagcgccaucgagagacugagcagcggccugagaaucaacagcgccaaggacgacgccgccggccaggccaucgccaacagauucaccagcaacaucaagggccugacccaggccagcagaaacgccaacgacggcaucagcaucgcccagaccaccgagggcgcccugaacgagaucaacaacaaccugcagagagugagagagcugagcgugcaggccaccaacggcaccaacagcgacagcgaccugaagagcauccaggacgagauccagcagagacuggaggagaucgacagagugagcaaccagacccaguucaacggcgugaaggugcugagccaggacaaccagaugaagauccaggugggcgccaacgacggcgagaccaucaccaucgaccugcagaagaucgacgugaagagccugggccuggacggcuucaacgugaacagccccggcaucagcggcggcggcggcggcauccuggacagcaugggcacccugaucaacgaggacgccgccgccgccaagaagagcaccgccaacccccuggccagcaucgacagcgcccugagcaagguggacgccgugagaagcagccugggcgccauccagaacagauucgacagcgccaucaccaaccugggcaacaccgugaccaaccugaacagcgccagaagcagaaucgaggacgccgacuacgccaccgaggugagcaacaugagcaaggcccagauccugcagcaggccggcaccagcgugcuggcccaggccaaccaggugccccagaacgugcugagccugcugaga

SEQ ID NO: 30837 - RNA, 1338 nt, Artificial Sequence
  derived and/or modified sequence opt4 from Epratuzumab_HeavyChain
caggugcagcuggugcagagcggcgccgaggugaagaagcccggcagcagcgugaaggugagcugcaaggccagcggcuacaccuucaccagcuacuggcugcacugggugagacaggcccccggccagggccuggaguggaucggcuacaucaaccccagaaacgacuacaccgaguacaaccagaacuucaaggacaaggccaccaucaccgccgacgagagcaccaacaccgccuacauggagcugagcagccugagaagcgaggacaccgccuucuacuucugcgccagaagagacaucaccaccuucuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30838 - RNA, 657 nt, Artificial Sequence
  derived and/or modified sequence opt4 from Epratuzumab_LightChain
gacauccagcugacccagagccccagcagccugagcgccagcgugggcgacagagugaccaugagcugcaagagcagccagagcgugcuguacagcgccaaccacaagaacuaccuggccugguaccagcagaagcccggcaaggcccccaagcugcugaucuacugggccagcaccagagagagcggcgugcccagcagauucagcggcagcggcagcggcaccgacuucaccuucaccaucagcagccugcagcccgaggacaucgccaccuacuacugccaccaguaccugagcagcuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30839 - RNA, 762 nt, Artificial Sequence
  derived and/or modified sequence opt4 from Eptacog_beta_HeavyChain1
aucgugggcggcaaggugugccccaagggcgagugccccuggcaggugcugcugcuggugaacggcgcccagcugugcggcggcacccugaucaacaccaucuggguggugagcgccgcccacugcuucgacaagaucaagaacuggagaaaccugaucgccgugcugggcgagcacgaccugagcgagcacgacggcgacgagcagagcagaagaguggcccaggugaucauccccagcaccuacgugcccggcaccaccaaccacgacaucgcccugcugagacugcaccagcccguggugcugaccgaccacguggugccccugugccugcccgagagaaccuucagcgagagaacccuggccuucgugagauucagccuggugagcggcuggggccagcugcuggacagaggcgccaccgcccuggagcugauggugcugaacgugcccagacugaugacccaggacugccugcagcagagcagaaaggugggcgacagccccaacaucaccgaguacauguucugcgccggcuacagcgacggcagcaaggacagcugcaagggcgacagcggcggcccccacgccacccacuacagaggcaccugguaccugaccggcaucgugagcuggggccagggcugcgccaccgugggccacuucggcguguacaccagagugagccaguacaucgaguggcugcagaagcugaugagaagcgagcccagacccggcgugcugcugagagcccccuucccc

SEQ ID NO: 30840 - RNA, 456 nt, Artificial Sequence
  derived and/or modified sequence opt4 from Eptacog_beta_LightChain1
gccaacgccuuccuggaggagcugagacccggcagccuggagagagagugcaaggaggagcagugcagcuucgaggaggccagagagaucuucaaggacgccgagagaaccaagcuguucuggaucagcuacagcgacggcgaccagugcgccagcagccccugccagaacggcggcagcugcaaggaccagcugcagagcuacaucugcuucugccugcccgccuucgagggcagaaacugcgagacccacaaggacgaccagcugaucugcgugaacgagaacggcggcugcgagcaguacugcagcgaccacaccggcaccaagagaagcugcagaugccacgagggcuacagccugcuggccgacggcgugagcugcacccccaccguggaguaccccugcggcaagauccccauccuggagaagagaaacgccagcaagccccagggcaga

SEQ ID NO: 30841 - RNA, 708 nt, Artificial Sequence
  derived and/or modified sequence opt4 from Erlizuab_HeavyChain1
gaggugcagcugguggagagcggcggcggccuggugcagcccggcggcagccugagacugagcugcgccaccagcggcuacaccuucaccgaguacacccacuggagacaggcccccggcaagggccuggaguggguggccggcaucaaccccaagaacggcggcaccagccacaaccagagauucgacagauucaccaucagcguggacaagagcaccagcaccgccuaccagaacagccugagagccgaggacaccgccguguacuacugcgccagauggagaggccugaacuacggcuucgacgugagauacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcug

SEQ ID NO: 30842 - RNA, 639 nt, Artificial Sequence
  derived and/or modified sequence opt4 from Erlizuab_LightChain1
gacauccagacccagagccccagcagccugagcgccagcgugggcgacagagugaccaucaccugcagagccagccaggacaucaacaacuaccugaacugguaccagcagaagcccggcaaggcccccaagcugcugaucuacuacaccagcacccugcacagcggcgugcccagcagauucagcggcagcggcagcggcaccgacuacacccugaccaucagcagccugcagcccgaggacuucgccaccuacuacugccagcagggcaacacccugccccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30843 - RNA, 1341 nt, Artificial Sequence
  derived and/or modified sequence opt4 from Etaracizumab_HeavyChain1
caggugcagcugguggagagcggcggcggcguggugcagcccggcagaagccugagacugagcugcgccgccagcggcuucaccuucagcagcuacgacaugagcugggugagacaggcccccggcaagggccuggaguggguggccaaggugagcagcggcggcggcagcaccuacuaccuggacaccgugcagggcagauucaccaucagcagagacaacagcaagaacacccuguaccugcagaugaacagccugagagccgaggacaccgccguguacuacugcgccagacaccugcacggcagcuucgccagcuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30844 - RNA, 642 nt, Artificial Sequence
  derived and/or modified sequence opt4 from Etaracizumab_LightChain1
gagaucgugcugacccagagccccgccacccugagccugagccccggcgagagagccacccugagcugccaggccagccagagcaucagcaacuuccugcacugguaccagcagagacccggccaggcccccagacugcugaucagauacagaagccagagcaucagcggcauccccgccagauucagcggcagcggcagcggcaccgacuucacccugaccaucagcagccuggagcccgaggacuucgccguguacuacugccagcagagcggcagcuggccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30845 - RNA, 1326 nt, Artificial Sequence
  derived and/or modified sequence opt4 from Etrolizuab_HeavyChain1
gaggugcagcugguggagagcggcggcggccuggugcagcccggcggcagccugagacugagcugcgccgccagcggcuucuucaucaccaacaacuacuggggcugggugagacaggcccccggcaagggccuggagugggugggcuacaucagcuacagcggcagcaccagcuacaaccccagccugaagagcagauucaccaucagcagagacaccagcaagaacaccuucuaccugcagaacagccugagagccgaggacaccgccguguacuacugcgccagaaccggcagcagcggcuacuucgacuucuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggc

SEQ ID NO: 30846 - RNA, 1326 nt, Artificial Sequence
  derived and/or modified sequence opt4 from Etrolizuab_HeavyChain2
gaggugcagcugguggagagcggcggcggccuggugcagcccggcggcagccugagacugagcugcgccgccagcggcuucuucaucaccaacaacuacuggggcugggugagacaggcccccggcaagggccuggagugggugggcuacaucagcuacagcggcagcaccagcuacaaccccagcaagcugagcagauucaccaucagcagagacaccagcaagaacaccuucuaccugcagaacagccugagagccgaggacaccgccguguacuacugcgccagaaccggcagcagcggcuacuucgacuucuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggc

SEQ ID NO: 30847 - RNA, 639 nt, Artificial Sequence
  derived and/or modified sequence opt4 from Etrolizuab_LightChain1
gacauccagacccagagccccagcagccugagcgccagcgugggcgacagagugaccaucaccugcagagccagcgagagcguggacgaccugcugcacugguaccagcagaagcccggcaaggcccccaagcugcugaucaaguacgccagccagagcaucagcggcgugcccagcagauucagcggcagcggcagcggcaccgacuucacccugaccaucagcagccugcagcccgaggacuucgccaccuacuacugccagcagggcaacagccugcccaacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30848 - RNA, 1338 nt, Artificial Sequence
  derived and/or modified sequence opt4 from Etrolizumab_HeavyChain1
gaggugcagcugguggagagcggcggcggccuggugcagcccggcggcagccugagacugagcugcgccgccagcggcuucuucaucaccaacaacuacuggggcugggugagacaggcccccggcaagggccuggagugggugggcuacaucagcuacagcggcagcaccagcuacaaccccagccugaagagcagauucaccaucagcagagacaccagcaagaacaccuucuaccugcagaugaacagccugagagccgaggacaccgccguguacuacugcgccagaaccggcagcagcggcuacuucgacuucuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30849 - RNA, 642 nt, Artificial Sequence
  derived and/or modified sequence opt4 from Etrolizumab_LightChain1
gacauccagaugacccagagccccagcagccugagcgccagcgugggcgacagagugaccaucaccugcagagccagcgagagcguggacgaccugcugcacugguaccagcagaagcccggcaaggcccccaagcugcugaucaaguacgccagccagagcaucagcggcgugcccagcagauucagcggcagcggcagcggcaccgacuucacccugaccaucagcagccugcagcccgaggacuucgccaccuacuacugccagcagggcaacagccugcccaacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30850 - RNA, 1359 nt, Artificial Sequence
  derived and/or modified sequence opt4 from Evinacumab_HeavyChain1
gaggugcagcugguggagagcggcggcggcgugauccagcccggcggcagccugagacugagcugcgccgccagcggcuucaccuucgacgacuacgccaugaacugggugagacagggccccggcaagggccuggagugggugagcgccaucagcggcgacggcggcagcaccuacuacgccgacagcgugaagggcagauucaccaucagcagagacaacagcaagaacagccuguaccugcagaugaacagccugagagccgaggacaccgccuucuucuacugcgccaaggaccugagaaacaccaucuucggcguggugauccccgacgccuucgacaucuggggccagggcaccauggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 30851 - RNA, 642 nt, Artificial Sequence
  derived and/or modified sequence opt4 from Evinacumab_LightChain1
gacauccagaugacccagagccccagcacccugagcgccagcgugggcgacagagugaccaucaccugcagagccagccagagcaucagaagcuggcuggccugguaccagcagaagcccggcaaggcccccaagcugcugaucuacaaggccagcagccuggagagcggcgugcccagcagauucagcggcagcggcagcggcaccgaguucacccugaccaucagcagccugcagcccgacgacuucgccaccuacuacugccagcaguacaacagcuacagcuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30852 - RNA, 1323 nt, Artificial Sequence
  derived and/or modified sequence opt4 from Evolocumab_HeavyChain1
gaggugcagcuggugcagagcggcgccgaggugaagaagcccggcgccagcgugaaggugagcugcaaggccagcggcuacacccugaccagcuacggcaucagcugggugagacaggcccccggccagggccuggaguggaugggcugggugagcuucuacaacggcaacaccaacuacgcccagaagcugcagggcagaggcaccaugaccaccgaccccagcaccagcaccgccuacauggagcugagaagccugagaagcgacgacaccgccguguacuacugcgccagaggcuacggcauggacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30853 - RNA, 645 nt, Artificial Sequence
  derived and/or modified sequence opt4 from Evolocumab_LightChain1
gagagcgcccugacccagcccgccagcgugagcggcagccccggccagagcaucaccaucagcugcaccggcaccagcagcgacgugggcggcuacaacagcgugagcugguaccagcagcaccccggcaaggcccccaagcugaugaucuacgaggugagcaacagacccagcggcgugagcaacagauucagcggcagcaagagcggcaacaccgccagccugaccaucagcggccugcaggccgaggacgaggccgacuacuacugcaacagcuacaccagcaccagcaugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 30854 - RNA, 1353 nt, Artificial Sequence
  derived and/or modified sequence opt4 from Exbivirumab_HeavyChain1
caggugcagcugguggagagcggcggcggcguggugcagcccggcggcagccugagacugagcugcgcccccagcggcuucguguucagaagcuacggcaugcacugggugagacagacccccggcaagggccuggagugggugagccugaucuggcacgacggcagcaacagauucuacgccgacagcgugaagggcagauucaccaucagcagagacaacagcaagaacacccuguaccugcagaugaacagccugagagccgaggacaccgccauguacuucugcgccagagagagacugaucgccgcccccgccgccuucgaccuguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30855 - RNA, 642 nt, Artificial Sequence
  derived and/or modified sequence opt4 from Exbivirumab_LightChain1
agcuacgugcugacccagccccccagcgugagcguggcccccggcaagaccgccagaaucagcugcggcggcaacaacaucggcaccaagaacgugcacugguaccagcagaagcccggccaggcccccgugcuggugguguacgccgacagcgacagacccagcggcauccccgagagauucagcggcagcaacagcggcaacaccgccacccugaccaucagcagaguggaggccggcgacgaggccgacuacuacugccaggugugggacagcgugagcuaccacgugguguucggcggcggcaccacccugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 30856 - RNA, 1347 nt, Artificial Sequence
  derived and/or modified sequence opt4 from Farletuzumab_HeavyChain1
gaggugcagcugguggagagcggcggcggcguggugcagcccggcagaagccugagacugagcugcagcgccagcggcuucaccuucagcggcuacggccugagcugggugagacaggcccccggcaagggccuggaguggguggccaugaucagcagcggcggcagcuacaccuacuacgccgacagcgugaagggcagauucgccaucagcagagacaacgccaagaacacccuguuccugcagauggacagccugagacccgaggacaccggcguguacuucugcgccagacacggcgacgaccccgccugguucgccuacuggggccagggcacccccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30857 - RNA, 651 nt, Artificial Sequence
  derived and/or modified sequence opt4 from Farletuzumab_LightChain1
gacauccagcugacccagagccccagcagccugagcgccagcgugggcgacagagugaccaucaccugcagcgugagcagcagcaucagcagcaacaaccugcacugguaccagcagaagcccggcaaggcccccaagcccuggaucuacggcaccagcaaccuggccagcggcgugcccagcagauucagcggcagcggcagcggcaccgacuacaccuucaccaucagcagccugcagcccgaggacaucgccaccuacuacugccagcaguggagcagcuaccccuacauguacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30858 - RNA, 1338 nt, Artificial Sequence
  derived and/or modified sequence opt4 from Fasinumab_HeavyChain1
caggugcagcuggugcagagcggcgccgaggugaagaagcccggcgccagcgugaaggugagcugcaaggugagcggcuucacccugaccgagcugagcauccacugggugagacaggcccccggcaagggccuggaguggaugggcggcuucgaccccgaggacggcgagaccaucuacgcccagaaguuccagggcagagugaccaugaccgaggacaccagcaccgacaccgccuacauggagcugaccagccugagaagcgaggacaccgccguguacuacugcagcaccaucuucggcguggugaccaacuucgacaacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 30859 - RNA, 642 nt, Artificial Sequence
  derived and/or modified sequence opt4 from Fasinumab_LightChain1
gacauccagaugacccagagccccagcagccugagcgccagcgccggcgacagagugaccaucaccugcagagccagccaggccaucagaaacgaccugggcugguaccagcagaagcccggcaaggcccccaagagacugaucuacgccgccuucaaccugcagagcggcgugcccagcagauucagcggcagcggcagcggcaccgaguucacccugaccaucagcagccugcagcccgaggaccuggccagcuacuacugccagcaguacaacagauaccccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30860 - RNA, 1350 nt, Artificial Sequence
  derived and/or modified sequence opt4 from Fezakinumab_HeavyChain1
caggugcagcuggugcagagcggcgccgaggugaagaagcccggcgccagcgugaaggugagcugcaaggccagcggcuacaccuucaccaacuacuacaugcacugggugagacaggcccccggccagggccuggagugggugggcuggaucaaccccuacaccggcagcgccuucuacgcccagaaguucagaggcagagugaccaugaccagagacaccagcaucagcaccgccuacauggagcugagcagacugagaagcgacgacaccgccguguacuacugcgccagagagcccgagaaguucgacagcgacgacagcgacguguggggcagaggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30861 - RNA, 651 nt, Artificial Sequence
  derived and/or modified sequence opt4 from Fezakinumab_LightChain1
caggccgugcugacccagccccccagcgugagcggcgcccccggccagagagugaccaucagcugcaccggcagcagcagcaacaucggcgccggcuacggcgugcacugguaccagcagcugcccggcaccgcccccaagcugcugaucuacggcgacagcaacagacccagcggcgugcccgacagauucagcggcagcaagagcggcaccagcgccagccuggccaucaccggccugcaggccgaggacgaggccgacuacuacugccagagcuacgacaacagccugagcggcuacguguucggcggcggcacccagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 30862 - RNA, 1347 nt, Artificial Sequence
  derived and/or modified sequence opt4 from FG-3019_HeavyChain1
gagggccagcuggugcagagcggcggcggccuggugcaccccggcggcagccugagacugagcugcgccggcagcggcuucaccuucagcagcuacggcaugcacugggugagacaggcccccggcaagggccuggagugggugagcggcaucggcaccggcggcggcaccuacagcaccgacagcgugaagggcagauucaccaucagcagagacaacgccaagaacagccuguaccugcagaugaacagccugagagccgaggacauggccguguacuacugcgccagaggcgacuacuacggcagcggcagcuucuucgacugcuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30863 - RNA, 642 nt, Artificial Sequence
  derived and/or modified sequence opt4 from FG-3019_LightChain1
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuacccccccaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30864 - RNA, 1344 nt, Artificial Sequence
  derived and/or modified sequence opt4 from Fibatuzumab_HeavyChain1
caggugcagcuggugcagagcggcgccgaggugaagaagcccggcgccagcgugaaggugagcugcaaggccagcggcuacaccuucaccggcuacuggaugaacugggugagacaggcccccggccagggccuggaguggaugggcgacaucuaccccggcagcggcaacaccaacuacgacgagaaguuccagggcagagugaccaugaccagagacaccagcaucagcaccgccuacauggagcugagcagacugagaagcgacgacaccgccguguacuacugcgccagaggcggcuacuacgaggacuucgacagcuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30865 - RNA, 642 nt, Artificial Sequence
  derived and/or modified sequence opt4 from Fibatuzumab_LightChain1
gacauccagaugacccagagccccagcuuccugagcgccagcgugggcgacagagugaccaucaccugcagagccagccagggcaucaucagcuaccuggccugguaccagcagaagcccgagaaggcccccaagagacugaucuacgccgccagcagccugcagagcggcgugcccagcagauucagcggcagcggcagcggcaccgaguucacccugaccaucagcagccugcagcccgaggacuucgccaccuacuacugcggccaguacgccaacuaccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30866 - RNA, 1344 nt, Artificial Sequence
  derived and/or modified sequence opt4 from Ficlatuzumab_HeavyChain1
caggugcagcuggugcagcccggcgccgaggugaagaagcccggcaccagcgugaagcugagcugcaaggccagcggcuacaccuucaccaccuacuggaugcacugggugagacaggcccccggccagggccuggaguggaucggcgagaucaaccccaccaacggccacaccaacuacaaccagaaguuccagggcagagccacccugaccguggacaagagcaccagcaccgccuacauggagcugagcagccugagaagcgaggacaccgccguguacuacugcgccagaaacuacgugggcagcaucuucgacuacuggggccagggcacccugcugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30867 - RNA, 1341 nt, Artificial Sequence
  derived and/or modified sequence opt4 from Ficlatuzumab_HeavyChain
gugcagcuggugcagcccggcgccgaggugaagaagcccggcaccagcgugaagcugagcugcaaggccagcggcuacaccuucaccaccuacuggaugcacugggugagacaggcccccggccagggccuggaguggaucggcgagaucaaccccaccaacggccacaccaacuacaaccagaaguuccagggcagagccacccugaccguggacaagagcaccagcaccgccuacauggagcugagcagccugagaagcgaggacaccgccguguacuacugcgccagaaacuacgugggcagcaucuucgacuacuggggccagggcacccugcugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30868 - RNA, 642 nt, Artificial Sequence
  derived and/or modified sequence opt4 from Ficlatuzumab_LightChain1
gacaucgugaugacccagagccccgacagccuggccaugagccugggcgagagagugacccugaacugcaaggccagcgagaacguggugagcuacgugagcugguaccagcagaagcccggccagagccccaagcugcugaucuacggcgccagcaacagagagagcggcgugcccgacagauucagcggcagcggcagcgccaccgacuucacccugaccaucagcagcgugcaggccgaggacguggccgacuaccacugcggccagagcuacaacuaccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30869 - RNA, 1350 nt, Artificial Sequence
  derived and/or modified sequence opt4 from Figitumumab_HeavyChain1
gaggugcagcugcuggagagcggcggcggccuggugcagcccggcggcagccugagacugagcugcaccgccagcggcuucaccuucagcagcuacgccaugaacugggugagacaggcccccggcaagggccuggagugggugagcgccaucagcggcagcggcggcaccaccuucuacgccgacagcgugaagggcagauucaccaucagcagagacaacagcagaaccacccuguaccugcagaugaacagccugagagccgaggacaccgccguguacuacugcgccaaggaccugggcuggagcgacagcuacuacuacuacuacggcauggacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30870 - RNA, 642 nt, Artificial Sequence
  derived and/or modified sequence opt4 from Figitumumab_LightChain1
gacauccagaugacccaguuccccagcagccugagcgccagcgugggcgacagagugaccaucaccugcagagccagccagggcaucagaaacgaccugggcugguaccagcagaagcccggcaaggcccccaagagacugaucuacgccgccagcagacugcacagaggcgugcccagcagauucagcggcagcggcagcggcaccgaguucacccugaccaucagcagccugcagcccgaggacuucgccaccuacuacugccugcagcacaacagcuaccccugcagcuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30871 - RNA, 1359 nt, Artificial Sequence
  derived and/or modified sequence opt4 from Firivumab_HeavyChain1
caggugcagcuggugcagagcggcgccgaggugaagaugcccggcagcagcgugaaggugagcugcaagaccagcggcguguucuucagcagccacgccaucagcugggugagacaggcccccggccagggccuggaguggaugggcggcaucagccccauguucggcaccacccacuacgcccagaaguuccagggcagagugaccaucaccgccgaccagagcaccaccaccgccuacauggagcugaccagccugaccagcgaggacaccgccguguacuacugcgccagagacggcgccggcagcuacuacccccugaacugguucgaccccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgagggccugcacaaccacuacacccagaagagccugagccugagccccggcaag

SEQ ID NO: 30872 - RNA, 642 nt, Artificial Sequence
  derived and/or modified sequence opt4 from Firivumab_LightChain1
gagaucgugcugacccagagccccgccacccugagccugagccccggcgagagagccacccugagcugcagagccagcgagaacaucuggaacaaccuggccugguaccagcagaagcccggccaggcccccagacugcugaucagcggcgccagcaccggcgccaccggcgugcccagcagauucagaggcagcggcagcagaaccgaguucacccugaccaucagcagccugcagagcgaggacuucgccaucuacuucugccagcaguacaacagcuggcccagaaccuucggccccggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30873 - RNA, 1347 nt, Artificial Sequence
  derived and/or modified sequence opt4 from Flanvotumab_HeavyChain1
caggugcagcuggugcagagcggcagcgagcugaagaagcccggcgccagcgugaagaucagcugcaaggccagcggcuacaccuucaccagcuacgccaugaacugggugagacaggcccccggccagggccuggagagcaugggcuggaucaacaccaacaccggcaaccccaccuacgcccagggcuucaccggcagauucguguucagcauggacaccagcgugagcaccgccuaccugcagaucagcagccugaaggccgaggacaccgccaucuacuacugcgcccccagauacagcagcagcugguaccuggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30874 - RNA, 645 nt, Artificial Sequence
  derived and/or modified sequence opt4 from Flanvotumab_LightChain1
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggcugauguacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30875 - RNA, 1362 nt, Artificial Sequence
  derived and/or modified sequence opt4 from Fletikumab_HeavyChain1
caggugcagcuggugcagagcggcgccgaggugaagagacccggcgccagcgugaaggugagcugcaaggccagcggcuacaccuucaccaacgacaucauccacugggugagacaggcccccggccagagacuggaguggaugggcuggaucaacgccggcuacggcaacacccaguacagccagaacuuccaggacagagugagcaucaccagagacaccagcgccagcaccgccuacauggagcugaucagccugagaagcgaggacaccgccguguacuacugcgccagagagccccugugguucggcgagagcagcccccacgacuacuacggcauggacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 30876 - RNA, 642 nt, Artificial Sequence
  derived and/or modified sequence opt4 from Fletikumab_LightChain1
gccauccagcugacccagagccccagcagccugagcgccagcgugggcgacagagugaccaucaccugcagagccagccagggcaucagcagcgcccuggccugguaccagcagaagcccggcaaggcccccaagcugcugaucuacgacgccagcagccuggagagcggcgugcccagcagauucagcggcagcggcagcggcaccgacuucacccugaccaucagcagccugcagcccgaggacuucgccaccuacuacugccagcaguucaacagcuacccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30877 - RNA, 1341 nt, Artificial Sequence
  derived and/or modified sequence opt4 from Fontolizumab_HeavyChain1
caggugcagcuggugcagagcggcgccgagcugaagaagcccggcagcagcgugaaggugagcugcaaggccagcggcuacaucuucaccagcagcuggaucaacugggugaagcaggcccccggccagggccuggaguggaucggcagaaucgaccccagcgacggcgaggugcacuacaaccaggacuucaaggacaaggccacccugaccguggacaagagcaccaacaccgccuacauggagcugagcagccugagaagcgaggacaccgccguguacuacugcgccagaggcuuccugcccugguucgccgacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30878 - RNA, 642 nt, Artificial Sequence
  derived and/or modified sequence opt4 from Fontolizumab_LightChain1
gacauccagaugacccagagccccagcacccugagcgccagcgugggcgacagagugaccaucaccugcaaggccagcgagaacguggacaccuacgugagcugguaccagcagaagcccggcaaggcccccaagcugcugaucuacggcgccagcaacagauacaccggcgugcccagcagauucagcggcagcggcagcggcaccgacuucacccugaccaucagcagccugcagcccgacgacuucgccaccuacuacugcggccagagcuacaacuaccccuucaccuucggccagggcaccaagguggaggugaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30879 - RNA, 1344 nt, Artificial Sequence
  derived and/or modified sequence opt4 from Foralumab_HeavyChain1
caggugcagcugguggagagcggcggcggcguggugcagcccggcagaagccugagacugagcugcgccgccagcggcuucaaguucagcggcuacggcaugcacugggugagacaggcccccggcaagggccuggaguggguggccgugaucugguacgacggcagcaagaaguacuacguggacagcgugaagggcagauucaccaucagcagagacaacagcaagaacacccuguaccugcagaugaacagccugagagccgaggacaccgccguguacuacugcgccagacagaugggcuacuggcacuucgaccuguggggcagaggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgaggccgagggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30880 - RNA, 645 nt, Artificial Sequence
  derived and/or modified sequence opt4 from Foralumab_LightChain1
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggcccccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30881 - RNA, 1344 nt, Artificial Sequence
  derived and/or modified sequence opt4 from Foravirumab_HeavyChain1
caggugcagcugguggagagcggcggcggcgccgugcagcccggcagaagccugagacugagcugcgccgccagcggcuucaccuucagcagcuacggcaugcacugggugagacaggcccccggcaagggccuggaguggguggccgugauccuguacgacggcagcgacaaguucuacgccgacagcgugaagggcagauucaccaucagcagagacaacagcaagaacacccuguaccugcagaugaacagccugagagccgaggacaccgccguguacuacugcgccaagguggccguggccggcacccacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30882 - RNA, 1344 nt, Artificial Sequence
  derived and/or modified sequence opt4 from Foravirumab_HeavyChain
gaggugcagcugguggagagcggcggcggcgccgugcagcccggcagaagccugagacugagcugcgccgccagcggcuucaccuucagcagcuacggcaugcacugggugagacaggcccccggcaagggccuggaguggguggccgugauccuguacgacggcagcgacaaguucuacgccgacagcgugaagggcagauucaccaucagcagagacaacagcaagaacacccuguaccugcagaugaacagccugagagccgaggacaccgccguguacuacugcgccaagguggccguggccggcacccacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30883 - RNA, 642 nt, Artificial Sequence
  derived and/or modified sequence opt4 from Foravirumab_LightChain1
gacauccagaugacccagagccccagcagccugagcgccagcgugggcgacagagugaccaucaccugcagagccagccagggcaucagaaacgaccugggcugguaccagcagaagcccggcaaggcccccaagcugcugaucuacgccgccagcagccugcagagcggcgugcccagcagauucagcggcagcggcagcggcaccgacuucacccugaccaucagcagccugcagcccgaggacuucgccaccuacuacugccagcagcugaacagcuacccccccaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30884 - RNA, 1341 nt, Artificial Sequence
  derived and/or modified sequence opt4 from Fresolimumab_HeavyChain1
caggugcagcuggugcagagcggcgccgaggugaagaagcccggcagcagcgugaaggugagcugcaaggccagcggcuacaccuucagcagcaacgugaucagcugggugagacaggcccccggccagggccuggaguggaugggcggcgugauccccaucguggacaucgccaacuacgcccagagauucaagggcagagugaccaucaccgccgacgagagcaccagcaccaccuacauggagcugagcagccugagaagcgaggacaccgccguguacuacugcgccagcacccugggccuggugcuggacgccauggacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugccccagcugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 30885 - RNA, 645 nt, Artificial Sequence
  derived and/or modified sequence opt4 from Fresolimumab_LightChain1
gagaccgugcugacccagagccccggcacccugagccugagccccggcgagagagccacccugagcugcagagccagccagagccugggcagcagcuaccuggccugguaccagcagaagcccggccaggcccccagacugcugaucuacggcgccagcagcagagcccccggcauccccgacagauucagcggcagcggcagcggcaccgacuucacccugaccaucagcagacuggagcccgaggacuucgccguguacuacugccagcaguacgccgacagccccaucaccuucggccagggcaccagacuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30886 - RNA, 1347 nt, Artificial Sequence
  derived and/or modified sequence opt4 from Fulranumab_HeavyChain1
gaggugcagcugguggagagcggcggcggccuggugcagcccggcggcagccugagacugagcugcgccgccagcggcuucacccugagaagcuacagcaugaacugggugagacaggcccccggcaagggccuggagugggugagcuacaucagcagaagcagccacaccaucuucuacgccgacagcgugaagggcagauucaccaucagcagagacaacgccaagaacagccuguaccugcagauggacagccugagagacgaggacaccgccauguacuacugcgccagaguguacagcagcggcuggcacgugagcgacuacuucgacuacuggggccagggcauccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30887 - RNA, 642 nt, Artificial Sequence; identical to SEQ ID NO: 30876
  derived and/or modified sequence opt4 from Fulranumab_LightChain1

SEQ ID NO: 30888 - RNA, 1356 nt, Artificial Sequence
  derived and/or modified sequence opt4 from Futuximab_HeavyChain1
gaggugcagcugcagcagcccggcagcgagcuggugagacccggcgccagcgugaagcugagcugcaaggccagcggcuacaccuucaccagcuacuggaugcacugggugaagcagagacccggccagggccuggaguggaucggcaacaucuaccccggcagcagaagcaccaacuacgacgagaaguucaagagcaaggccacccugaccguggacaccagcagcagcaccgccuacaugcagcugagcagccugaccagcgaggacagcgccguguacuacugcaccagaaacggcgacuacuacgugagcagcggcgacgccauggacuacuggggccagggcaccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30889 - RNA, 642 nt, Artificial Sequence
  derived and/or modified sequence opt4 from Futuximab_LightChain1
gacauccagaugacccagaccaccagcagccugagcgccagccugggcgacagagugaccaucagcugcagaaccagccaggacaucggcaacuaccugaacugguaccagcagaagcccgacggcaccgugaagcugcugaucuacuacaccagcagacugcacagcggcgugcccagcagauucagcggcagcggcagcggcaccgacuucagccugaccaucaacaacguggagcaggaggacguggccaccuacuucugccagcacuacaacaccgugccccccaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30890 - RNA, 1335 nt, Artificial Sequence
  derived and/or modified sequence opt4 from Galcanezumab_HeavyChain1
caggugcagcuggugcagagcggcgccgaggugaagaagcccggcagcagcgugaaggugagcugcaaggccagcggcuacaccuucggcaacuacuggaugcagugggugagacaggcccccggccagggccuggaguggaugggcgccaucuacgagggcaccggcaagaccguguacauccagaaguucgccgacagagugaccaucaccgccgacaagagcaccagcaccgccuacauggagcugagcagccugagaagcgaggacaccgccguguacuacugcgccagacugagcgacuacgugagcggcuucggcuacuggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaggccgccggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggc

SEQ ID NO: 30891 - RNA, 642 nt, Artificial Sequence
  derived and/or modified sequence opt4 from Galcanezumab_LightChain1
gacauccagaugacccagagccccagcagccugagcgccagcgugggcgacagagugaccaucaccugcagagccagcaaggacaucagcaaguaccugaacugguaccagcagaagcccggcaaggcccccaagcugcugaucuacuacaccagcggcuaccacagcggcgugcccagcagauucagcggcagcggcagcggcaccgacuucacccugaccaucagcagccugcagcccgaggacuucgccaccuacuacugccagcagggcgacgcccugccccccaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30892 - RNA, 1371 nt, Artificial Sequence
  derived and/or modified sequence opt4 from Galiximab_HeavyChain1
caggugcagcugcaggagagcggccccggccuggugaagcccagcgagacccugagccugaccugcgccgugagcggcggcagcaucagcggcggcuacggcuggggcuggaucagacagccccccggcaagggccuggaguggaucggcagcuucuacagcagcagcggcaacaccuacuacaaccccagccugaagagccaggugaccaucagcaccgacaccagcaagaaccaguucagccugaagcugaacagcaugaccgccgccgacaccgccguguacuacugcgugagagacagacuguucagcguggugggcaugguguacaacaacugguucgacguguggggccccggcgugcuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggccgagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30893 - RNA, 648 nt, Artificial Sequence
  derived and/or modified sequence opt4 from Galiximab_LightChain1
gagagcgcccugacccagccccccagcgugagcggcgcccccggccagaaggugaccaucagcugcaccggcagcaccagcaacaucggcggcuacgaccugcacugguaccagcagcugcccggcaccgcccccaagcugcugaucuacgacaucaacaagagacccagcggcaucagcgacagauucagcggcagcaagagcggcaccgccgccagccuggccaucaccggccugcagaccgaggacgaggccgacuacuacugccagagcuacgacagcagccugaacgcccagguguucggcggcggcaccagacugaccgugcugggccagcccaaggccgcccccaccgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 30894 - RNA, 1347 nt, Artificial Sequence
  derived and/or modified sequence opt4 from Ganitumab_HeavyChain1
caggugcagcugcaggagagcggccccggccuggugaagcccagcggcacccugagccugaccugcgccgugagcggcggcagcaucagcagcagcaacugguggagcugggugagacagccccccggcaagggccuggaguggaucggcgagaucuaccacagcggcagcaccaacuacaaccccagccugaagagcagagugaccaucagcguggacaagagcaagaaccaguucagccugaagcugagcagcgugaccgccgccgacaccgccguguacuacugcgccagauggaccggcagaaccgacgccuucgacaucuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30895 - RNA, 657 nt, Artificial Sequence
  derived and/or modified sequence opt4 from Ganitumab_LightChain1
gacguggugaugacccagagcccccugagccugcccgugacccccggcgagcccgccagcaucagcugcagaagcagccagagccugcugcacagcaacggcuacaacuaccuggacugguaccugcagaagcccggccagagcccccagcugcugaucuaccugggcagcaacagagccagcggcgugcccgacagauucagcggcagcggcagcggcaccgacuucacccugaagaucagcagaguggaggccgaggacgugggcguguacuacugcaugcagggcacccacuggccccugaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30896 - RNA, 1368 nt, Artificial Sequence
  derived and/or modified sequence opt4 from Gantenerumab_HeavyChain1
cagguggagcugguggagagcggcggcggccuggugcagcccggcggcagccugagacugagcugcgccgccagcggcuucaccuucagcagcuacgccaugagcugggugagacaggcccccggcaagggccuggagugggugagcgccaucaacgccagcggcaccagaaccuacuacgccgacagcgugaagggcagauucaccaucagcagagacaacagcaagaacacccuguaccugcagaugaacagccugagagccgaggacaccgccguguacuacugcgccagaggcaagggcaacacccacaagcccuacggcuacgugagauacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30897 - RNA, 645 nt, Artificial Sequence
  derived and/or modified sequence opt4 from Gantenerumab_LightChain1
gacaucgugcugacccagagccccgccacccugagccugagccccggcgagagagccacccugagcugcagagccagccagagcgugagcagcagcuaccuggccugguaccagcagaagcccggccaggcccccagacugcugaucuacggcgccagcagcagagccaccggcgugcccgccagauucagcggcagcggcagcggcaccgacuucacccugaccaucagcagccuggagcccgaggacuucgccaccuacuacugccugcagaucuacaacaugcccaucaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30898 - RNA, 348 nt, Artificial Sequence
  derived and/or modified sequence opt4 from Gemtuzumab_HeavyChain1
caggugcagcugcagcagagcggcgccgagcuggccaagcccggcgccagcgugaagaugagcugcaaggccagcggcuacaccuucaccagcuacagaaugcacugggugaagcagagacccggccagggccuggaguggaucggcuacaucaaccccagcaccggcuacaccgaguacaaccagaaguucaaggacaaggccacccugaccgccgacaagagcagcagcaccgccuacaugcagcugagcagccugaccuucgaggacagcgccguguacuacugcgccagaggcggcggcguguucgacuacuggggccagggcaccacccugaccgugagcagc

SEQ ID NO: 30899 - RNA, 351 nt, Artificial Sequence
  derived and/or modified sequence opt4 from Gemtuzumab_HeavyChain2
caggugcagcuggugcagagcggcgccgaggugaagaagcccggcagcagcgugaaggugagcugcaaggccagcggcggcaccuucagcagaagcgccaucaucugggugagacaggcccccggccagggccuggaguggaugggcggcaucgugcccauguucggcccccccaacuacgcccagaaguuccagggcagagugaccaucaccgccgacgagagcaccaacaccgccuacauggagcugagcagccugagaagcgaggacaccgccuucuacuucugcgccggcggcuacggcaucuacagccccgaggaguacaacggcggccuggugaccgugagcagc

SEQ ID NO: 30900 - RNA, 321 nt, Artificial Sequence
  derived and/or modified sequence opt4 from Gemtuzumab_LightChain2
gacauccagaugacccagagccccagcacccugagcgccagcgugggcgacagagugaccaucaccugcagagccagccagagcaucaacaccuggcuggccugguaccagcagaagcccggcaaggcccccaagcugcugauguacaaggccagcagccuggagagcggcgugcccagcagauucaucggcagcggcagcggcaccgaguucacccugaccaucagcagccugcagcccgacgacuucgccaccuacuacugccagcaguacaacagcgacagcaagauguucggccagggcaccaagguggaggugaag

SEQ ID NO: 30901 - RNA, 318 nt, Artificial Sequence
  derived and/or modified sequence opt4 from Gemtuzumab_ozogamicin_LightChain1
cagaucgugcugacccagagccccgccaucaugagcgccagccccggcgagaaggugaccaucaccugcagcgccagcagcagcaucagcuacaugcacugguuccagcagaagcccggcaccagccccaagcuguggaucuacaccaccagcaaccuggccagcggcgugcccgccagauucagcggcagcggcagcggcaccagcuacagccugaccaucagcagaauggaggccgaggacgccgccaccuacuacugccaccagagaagcaccuacccccugaccuucggcagcggcaccaagcuggagcugaag

SEQ ID NO: 30902 - RNA, 1335 nt, Artificial Sequence
  derived and/or modified sequence opt4 from Gevokizumab_HeavyChain1
caggugcagcugcaggagagcggccccggccuggugaagcccagccagacccugagccugaccugcagcuucagcggcuucagccugagcaccagcggcaugggcgugggcuggaucagacagcccagcggcaagggccuggaguggcuggcccacaucuggugggacggcgacgagagcuacaaccccagccugaagagcagacugaccaucagcaaggacaccagcaagaaccaggugagccugaagaucaccagcgugaccgccgccgacaccgccguguacuucugcgccagaaacagauacgacccccccugguucguggacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugaccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcauggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30903 - RNA, 642 nt, Artificial Sequence
  derived and/or modified sequence opt4 from Gevokizumab_LightChain1
gacauccagaugacccagagcaccagcagccugagcgccagcgugggcgacagagugaccaucaccugcagagccagccaggacaucagcaacuaccugagcugguaccagcagaagcccggcaaggccgugaagcugcugaucuacuacaccagcaagcugcacagcggcgugcccagcagauucagcggcagcggcagcggcaccgacuacacccugaccaucagcagccugcagcaggaggacuucgccaccuacuucugccugcagggcaagaugcugcccuggaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30904 - RNA, 1347 nt, Artificial Sequence
  derived and/or modified sequence opt4 from Girentuximab_HeavyChain1
gacgugaagcugguggagagcggcggcggccuggugaagcugggcggcagccugaagcugagcugcgccgccagcggcuucaccuucagcaacuacuacaugagcugggugagacagacccccgagaagagacuggagcugguggccgccaucaacagcgacggcggcaucaccuacuaccuggacaccgugaagggcagauucaccaucagcagagacaacgccaagaacacccuguaccugcagaugagcagccugaagagcgaggacaccgcccuguucuacugcgccagacacagaagcggcuacuucagcauggacuacuggggccagggcaccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30905 - RNA, 642 nt, Artificial Sequence
  derived and/or modified sequence opt4 from Girentuximab_LightChain1
gacaucgugaugacccagagccagagauucaugagcaccaccgugggcgacagagugagcaucaccugcaaggccagccagaacguggugagcgccguggccugguaccagcagaagcccggccagagccccaagcugcugaucuacagcgccagcaacagauacaccggcgugcccgacagauucaccggcagcggcagcggcaccgacuucacccugaccaucagcaacaugcagagcgaggaccuggccgacuucuucugccagcaguacagcaacuaccccuggaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30906 - RNA, 1335 nt, Artificial Sequence
  derived and/or modified sequence opt4 from Glembatumumab_HeavyChain1
caggugcagcugcaggagagcggccccggccuggugaagcccagccagacccugagccugaccugcaccgugagcggcggcagcaucagcagcuucaacuacuacuggagcuggaucagacaccaccccggcaagggccuggaguggaucggcuacaucuacuacagcggcagcaccuacagcaaccccagccugaagagcagagugaccaucagcguggacaccagcaagaaccaguucagccugacccugagcagcgugaccgccgccgacaccgccguguacuacugcgccagaggcuacaacuggaacuacuucgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 30907 - RNA, 645 nt, Artificial Sequence
  derived and/or modified sequence opt4 from Glembatumumab_LightChain1
gagaucgugaugacccagagccccgccacccugagcgugagccccggcgagagagccacccugagcugcagagccagccagagcguggacaacaaccuggugugguaccagcagaagcccggccaggcccccagacugcugaucuacggcgccagcaccagagccaccggcauccccgccagauucagcggcagcggcagcggcaccgaguucacccugaccaucagcagccugcagagcgaggacuucgccguguacuacugccagcaguacaacaacuggccccccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30908 - RNA, 1332 nt, Artificial Sequence
  derived and/or modified sequence opt4 from Goilixiab_HeavyChain1
gaggugcagcugguggagagcggcggcggccuggccaagcccggcggcagccugagacugagcugcgccgccagcggcuucagauucaccuucaacaacuacuacgacugggugagacaggcccccggccagggccuggagugggugagcagaaucagcagcagcggcgaccccaccugguacgccgacagcgugaagggcagauucaccaucagcagagagaacgccaagaacacccuguuccugcagaacagccugagagccgaggacaccgccguguacuacugcgccagccugaccaccggcagcgacagcuggggccagggcgugcuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggcaag

SEQ ID NO: 30909 - RNA, 639 nt, Artificial Sequence
  derived and/or modified sequence opt4 from Goilixiab_LightChain1
gacauccagacccagagccccagcagccugagcgccagcgugggcgacagagugaccaucaccugcagagccagccaggacaucagauacuaccugaacugguaccagcagaagcccggcaaggcccccaagcugcugaucuacguggccagcagccugcagagcggcgugcccagcagauucagcggcagcggcagcggcaccgaguucacccugaccgugagcagccugcagcccgaggacuucgccaccuacuacugccugcagguguacagcacccccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 30910 - RNA, 1338 nt, Artificial Sequence
  derived and/or modified sequence opt4 from Guselkumab_HeavyChain1
gaggugcagcuggugcagagcggcgccgaggugaagaagcccggcgagagccugaagaucagcugcaagggcagcggcuacagcuucagcaacuacuggaucggcugggugagacagaugcccggcaagggccuggaguggaugggcaucaucgaccccagcaacagcuacaccagauacagccccagcuuccagggccaggugaccaucagcgccgacaagagcaucagcaccgccuaccugcaguggagcagccugaaggccagcgacaccgccauguacuacugcgccagaugguacuacaagcccuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 30911 - RNA, 651 nt, Artificial Sequence
  derived and/or modified sequence opt4 from Guselkumab_LightChain1
cagagcgugcugacccagccccccagcgugagcggcgcccccggccagagagugaccaucagcugcaccggcagcagcagcaacaucggcagcggcuacgacgugcacugguaccagcagcugcccggcaccgcccccaagcugcugaucuacggcaacagcaagagacccagcggcgugcccgacagauucagcggcagcaagagcggcaccagcgccagccuggccaucaccggccugcagagcgaggacgaggccgacuacuacugcgccagcuggaccgacggccugagccuggugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 30912 - RNA, 360 nt, Artificial Sequence
  derived and/or modified sequence opt4 from HuMab-001_HeavyChain_VDJ-Region
caggugcagcugcagcaguggggcgccggccugcugaagcccagcgagacccugagccugaccugcgccguguacggcggcagcuucagcggcuacuacuggaacuggaucagacagccccccggcaagggccuggaguggaucggcgagaucaaccacagcggcagcaccaacuacaaccccagccugaagagcagagugaccaucagcguggacaccagcaagaaccaguucagccugaagcugagcagcgugaccgccgccgacaccgccguguacuacugcgccagaggcaacuacggcagcggcuacuacuacuucgaccuguggggcagaggcacccaggugaccgugagcagc

SEQ ID NO: 30913 - RNA, 321 nt, Artificial Sequence
  derived and/or modified sequence opt4 from HuMab-001_LightChain_VJ-Region
gacauccagaugacccagagccccagcagccugagcgccagcgugggcgacagagugaccaucaccugcagagccagccagggcaucagcagcuggcuggccugguaccagcagaagcccgagaaggcccccaagagccugaucuucgccgccagcagccugcagagcggcgugcccagcagauucagcggcagcggcagcggcaccgacuucacccugaccaucagcagccugcagcccgaggacuucgccaccuacuacugccagcaguacaucagcuuccccaucaccuucggccagggcaccagacuggagaucaag

SEQ ID NO: 30914 - RNA, 366 nt, Artificial Sequence
  derived and/or modified sequence opt4 from HuMab-005_HeavyChain_gamma-Chain_VDJ-Region
gaggugcagcuggugcagagcggcgccgaggugaagaagcccggcgagagccugaagaucagcugcaaggccagcggcuacagcuuccacuucuacuggaucggcugggugagacagaugcccggcaagggccuggaguggaugggcagcaucuaccccggcgacagcgacaccagauacagacccagcuuccagggccaggugaccaucagcgccgacaagagcaucagcaccgccuaccugcaguggaccagccugaaggccagcgacaccgccaucuacuacugcgccagacagagaggcgacuacuacuacuucuacggcauggacguguggggccagggcaccaccgugaccgugagcagc

SEQ ID NO: 30915 - RNA, 321 nt, Artificial Sequence
  derived and/or modified sequence opt4 from HuMab-005_LightChain_VJ-Region
gagaucgugcugacccagagccccggcacccugagccugagccccggcgagagagccacccugagcugcagagccagccagagcgugagcagcagcuaccuggccugguaccagcagaagcccggccaggugcccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagccugaccuucggcggcggcaccaagguggagaucaag

SEQ ID NO: 30916 - RNA, 357 nt, Artificial Sequence
  derived and/or modified sequence opt4 from HuMab-006_HeavyChain_VDJ-Region
gaggugcagcugcuggagagcggcggcggccuggugcagcccggcggcagccugagacugagcugcgccgccagcggcuucaccuucagcaacuacgcccugaucugggugagacaggcccccggcaagggccuggagugggugagcaucaucagaggcggcgccggcagcaccuacuacgccgacagcgugaagggcagauucaccaucagcagagacaacagcaagaacacccuguaccugcagaugaacagccugagagccgaggacaccgccguguacuacugcgccaaggccagaaucuggggcccccuguucgacuacuggggccagggcacccuggugaccgugagcagc

SEQ ID NO: 30917 - RNA, 324 nt, Artificial Sequence
  derived and/or modified sequence opt4 from HuMab-006_LightChain_VJ-Region
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggcccccccugaccuucggcggcggcaccaagguggagaucaag

SEQ ID NO: 30918 - RNA, 360 nt, Artificial Sequence
  derived and/or modified sequence opt4 from HuMab-019_HeavyChain_VDJ-Region
caggugcagcugcagcaguggggcgccggccugcugaagcccagcgagacccugagccugaccugcgccguguacggcggcagcuucagcgacuacuacuggaacuggaucagacagccccccggcaagggccuggaguggaucggcgagauccaccacgugggcagcaccaacuacaaccccagccugaagagcagagugaccaucagcguggacaccagcaagagccaguucagccugaagcugagcagcgugaccgccgccgacaccgccguguacuacugcgccagaggcuacuacgacagcggcguguacuacuucgacuacugggcccagggcacccuggugaccgugagcagc

SEQ ID NO: 30919 - RNA, 360 nt, Artificial Sequence
  derived and/or modified sequence opt4 from HuMab-021_HeavyChain_VDJ-Region
caggugcagcugcagcaguggggcgccggccugcugaagcccagcgagacccugagccugaccugcgccguguacggcggcagcuucagcgacuacuacuggaacuggaucagacagccccccggcaagggccuggaguggaucggcgagauccaccacagcggcagcaccaacuacaaccccagccugaagagcagagugaccaucagcguggacaccagcaagaaccaguucagccugaagcugagcagcgugaccgccgccgacaccgccguguacuacugcgccagaggcuacuacgccagcggcguguacuacuucgacuacuggggccagggcacccuggugaccgugagcagc

SEQ ID NO: 30920 - RNA, 321 nt, Artificial Sequence
  derived and/or modified sequence opt4 from HuMab-021_LightChain_VJ-Region
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuaccccaucaccuucggccagggcaccagacuggagaucaag

SEQ ID NO: 30921 - RNA, 360 nt, Artificial Sequence
  derived and/or modified sequence opt4 from HuMab-025_HeavyChain_VDJ-Region
caggugcagcugcagcaguggggcgccggccugcugaagcccagcgagacccugagccugaccugcgccguguacggcggcagcuucagcgacuacuacuggaacuggaucagacagccccccggcaagggccuggaguggaucggcgagauccaccacagcggcagcaccaacuacaaccccagccugaagagcagagugaccaucagcguggacaccagcaagaaccaguucagccugaagcugagcagcgugaccgccgccgacaccgccguguacuacugcgccagaggcuacuacgacagcggcguguacuacuucgacuacugggcccagggcacccuggugaccgugagcagc

SEQ ID NO: 30922 - RNA, 321 nt, Artificial Sequence
  derived and/or modified sequence opt4 from HuMab-025_LightChain_VJ-Region
gacauccagaugacccagagccccagcagccugagcgccagcgugggcgacagagugaccaucaccugcagagccagccagggcaucagcagauggcuggccugguaccagcagaagcccgagaaggcccccaagagccugaucuacgccgccagcagccugagaagcggcgugcccagcagauucagcggcagcggcagcggcaccgacuucacccugaccaucagcagccugcagcccgaggacuucgccaccuacuacugccagcaguacaacagcuaccccaucaccuucggccagggcaccagacuggagaucaag

SEQ ID NO: 30923 - RNA, 360 nt, Artificial Sequence
  derived and/or modified sequence opt4 from HuMab-027_HeavyChain_VDJ-Region
caggugcagcugcagcaguggggcgccggccugcugaagcccagcgagacccugagccugaccugcgccguguacggcggcagcuucagcgacuacuucuggaacuggaucagacagccccccggcaagggccuggaguggaucggcgagauccaccacagcggcagcaccaacuacaaccccagccugaagagcagagugaccaucagcguggacaccagcaagaaccaguucagccugaaccugagcagcgugaccgccgccgacaccgccguguacuacugcgccagaggccugaucggcagcggcuacuacuacuucgacuacugggaccagggcacccuggugaccgugagcagc

SEQ ID NO: 30924 - RNA, 360 nt, Artificial Sequence
  derived and/or modified sequence opt4 from HuMab-032_HeavyChain_VDJ-Region
caggugcagcugcagcaguggggcgccggccugcugaagcccagcgagacccugagccugaccugcgccguguacggcggcagcuucagcggcuacuacuggagcuggaucagacagccccccggcaagggccuggaguggaucggcgagaucaaccacagcggcgacaccaacuacaaccccagccugaccagcagagugaccaucagcguggacaccagcaagaaccaguucagccugaagcugagcagcgugaccgccgccgacaccgccguguacuacugcgccagacuguucuacggcagcggcaucuacuacuucgacuacuggggccagggcacccuggugaccgugagcagc

SEQ ID NO: 30925 - RNA, 321 nt, Artificial Sequence
  derived and/or modified sequence opt4 from HuMab-032_LightChain_VJ-Region
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccaccuucagacugcagagcggcgugcccagcagauucagcggcagcggcagcggcaccgacuucacccugaccaucagcagccugcagcccgaggacuucgccaccuacuacugccagcaguacaacagcuucccccccaccuucggccagggcaccaagguggagaucaag

SEQ ID NO: 30926 - RNA, 363 nt, Artificial Sequence
  derived and/or modified sequence opt4 from HuMab-033_HeavyChain_VDJ-Region
caggugcagcugguggagagcggcggcggcguggugcagaccggcagaagccugagacugagcugcgccgccagcggcuucaccuucagcagccacgccaugcacugggugagacaggcccccggcaagggccuggaguggguggccgccaucagcuacgacggcagcaacaaguacuacgccgacagcgugaagggcagauucaccaucagcagagacaacagcaagaacacccuguaccugcagaugaacagccugagagccgaggacaccgccguguacuacugcgccagaggcgacuacaucagcagcagcggcguguucgacuacuggggccagggcacccuggugaccgugagcagc

SEQ ID NO: 30927 - RNA, 360 nt, Artificial Sequence
  derived and/or modified sequence opt4 from HuMab-035_HeavyChain_VDJ-Region
caggugcagcugcagcaguggggcgccggccugcugaagcccagcgagacccugagccugaccugcgccaucuacggcggcagcuucagcggcuacuacuggagcuggaucagacagccccccggcaagggccuggaguggaucggcgagaucaaccacagcggcgacaccaacuacaaccccagccugaccagcagagugaccaucagcguggacaccagcaagaaccaguucagccugaagcugagcagcgugaccgccgccgacaccgccguguacuacugcgccagacuguucuacggcagcggcaucuacuacuucgacuacuggggccagggcacccuggugaccgugagcagc

SEQ ID NO: 30928 - RNA, 360 nt, Artificial Sequence
  derived and/or modified sequence opt4 from HuMab-036_HeavyChain_VDJ-Region
caggugcagcugcagcaguggggcgccggccugcugaagcccagcgagacccugagccugaccugcgccguguacggcggcagcuucagcgacuacuacuggagcuggaucagacagccccccggcaagggccuggaguggaucggcgagaucaaccacagcggcagcaccaacuacaaccccagccugaagagcagagugaccaucagcguggacaccagcaagaaccaguucagccugaagcugagcagcgugaccgccgccgacaccgccguguacuacugcgccagacuguacuacggcagcggcaccuacuacuucgacuacuggggccagggcacccuggugaccgugagcagc

SEQ ID NO: 30929 - RNA, 321 nt, Artificial Sequence
  derived and/or modified sequence opt4 from HuMab-036_LightChain_VJ-Region
gacauccagaugacccagagccccagcagccugagcgccagcgugggcgacagagugaccaucaccugcagagccagccagggcaucagcagcuggcugaccugguaccagcagaagcccgagaaggcccccaagagccugaucuacgccgccagcagacugcagagcggcgugcccagcagauucagcggcagcggcagcggcaccgacuucacccugaccaucagcagccugcagcccgaggacuucgccaccuacuacugccagcaguacaacagcuucccccccaccuucggccagggcaccaagguggagaucaag

SEQ ID NO: 30930 - RNA, 366 nt, Artificial Sequence
  derived and/or modified sequence opt4 from HuMab-041_HeavyChain_VDJ-Region
gaggugcagcuggugcagagcggcgccgaggugaagaagcccggcgagagccugaagaucagcugcaagggcagcggcuacagcuucaccagcuacuggaucggcugggugagacagaugcccggcaagggccuggaguggaugggcagcaucuaccccggcgacagccacaccagauacagacccagcuuccagggccaggugaccaucagcgccgacaagagcaucagcaccgccuaccugcaguggagcagccugaaggccagcgacaccgccauguacuacugcgccagacagaagggcgacuucuacuacuucuucggccuggacguguggggccagggcaccgccaucaccgugagcagc

SEQ ID NO: 30931 - RNA, 366 nt, Artificial Sequence
  derived and/or modified sequence opt4 from HuMab-044_HeavyChain_VDJ-Region
gaggugcagcuggugcagagcggcgccgaggugaagaagcccggcgagagccugaagaucagcugcaagggcagcggcuacagauucagcagcuacuggaucggcugggugagacagaugcccggcaagggccuggaguggaugggcagcaucuuccccggcgacagcgacaccagauacagccccagcuuccagggccaggugaccaucagcgccgacaagagcaucaccaccgccuaccugcaguggagcagccugaaggccagcgacaccgccauguacuacugcgccagacaggccggcgacuacuacuacuacaacggcauggacguguggggccagggcaccaccgugaccgugagcagc

SEQ ID NO: 30932 - RNA, 357 nt, Artificial Sequence
  derived and/or modified sequence opt4 from HuMab-049_HeavyChain_VDJ-Region
gaggugcagcugcuggagagcggcggcgaccuggugcagcccggcggcagccugagacugagcugcgccgccagcggcuucaccuucagcagcuacgccaugagcugggugagacaggcccccggcaagggccuggagugggugagcgccaucagcggcagaggcggcaccaccuacuacgccgacagcgugaagggcagauucaccaucagcagagacaacagcaagagcacccugugccugcagaugaacagccugagagccgaggacaccgccguguacuacugcgccaaggccagagccaacugggacuacuucgacuacuggggccagggcacccuggugaccgugagcagc

SEQ ID NO: 30933 - RNA, 321 nt, Artificial Sequence
  derived and/or modified sequence opt4 from HuMab-049_LightChain_VJ-Region
gacauccagaugacccagagccccagcagcgugagcgccagcgugggcgacagagugaccaucaccugcagagccagccagggcaucagcagcuggcuggccugguaccagcacaagcccggcaaggcccccaagcugcugaucuacgccgccagcauccugcagagcggcgugcccagcagauucagcggcagcggcagcggcaccgacuucacccugaccaucagcagccugagacccgaggacuucgccaccuacuacugccagcaggccaacagcuuccccaucaccuucggccagggcaccagacuggagaucaag

SEQ ID NO: 30934 - RNA, 357 nt, Artificial Sequence
  derived and/or modified sequence opt4 from HuMab-050_HeavyChain_VDJ-Region
gaggugcagcugcuggagagcggcggcggccuggugcagcccggcggcagccugagacugagcugcgccgccagcggcuucaccuucagcagcuacgccaugaacugggugagacaggcccccggcaagggccuggagugggugagcgccaucagcggcagaggcggcaccaccuacuacgccgacagcgugaagggcagauucaccaucagcagagacaacagcaagaacacccuguaccugcagaugagcagccugagagccgaggacaccgccguguacuacugcgccaaggccagagccaacugggacuacuucgacuacuggggccagggcacccuggugaccgugagcagc

SEQ ID NO: 30935 - RNA, 321 nt, Artificial Sequence
  derived and/or modified sequence opt4 from HuMab-050_LightChain_VJ-Region
gacauccagaugacccagagccccagcagcgugagcgccagcgugggcgacagagugaccaucaccugcagagccagccagggcaucagcagcuggcuggccugguaccagcacaagcccggcaaggcccccaagcugcugaucuacgccgccagcauccugcagagcggcgugcccagcagauucagcggcagcggcagcggcaccgacuucacccugaccaucagcagccugcagcccgaggacuucgccaccuacuacugccagcaggccaacagcuuccccaucaccuucggccagggcaccagacuggagaucaag

SEQ ID NO: 30936 - RNA, 360 nt, Artificial Sequence
  derived and/or modified sequence opt4 from HuMab-054_HeavyChain_VDJ-Region
caggugcagcugcagcaguggggcgccggccugcugaagcccagcgagacccugagccugaccugcgccguguacggcggcagcuucagcggcuacuacuggagcuggaucagacagccccccggcaagggccuggaguggaucggcgagauccaccacagcggcagcaccaacuacaaccccagccugaagagcagagugaccaucagcguggacaccagcaagaaccaguucagccugaagcugagcagcgugaccgccgccgacaccgccguguacuacugcgccagacugugguacggcagcggcagcuacuacuucgacuacuggggccagggcacccuggugaccgugagcagc

SEQ ID NO: 30937 - RNA, 321 nt, Artificial Sequence
  derived and/or modified sequence opt4 from HuMab-054_LightChain_VJ-Region
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuucccccccaccuucggcggcggcaccaagguggagaucaag

SEQ ID NO: 30938 - RNA, 357 nt, Artificial Sequence
  derived and/or modified sequence opt4 from HuMab-055_HeavyChain_VDJ-Region
gaggugcagcugcuggagagcggcggcggccuggugcagcccggcggcagccugagacugagcugcgccgccagcggcuucaccuucagcagcuacgccaugaacugggugagacaggcccccggcaagggccuggagugggugagcgccaucagcggcagaggcggcaccaccuacuacgccgacagcgugaagggcagauucaccaucagcagagacaacagcaagagcacccugugccugcagaugaacagccugagagccgaggacaccgccguguacuacugcgccaaggccagagccaacugggacuacuucgacuacuggggccagggcacccuggugaccgugagcagc

SEQ ID NO: 30939 - RNA, 366 nt, Artificial Sequence
  derived and/or modified sequence opt4 from HuMab-059_HeavyChain_VDJ-Region
caggugcagcuggugcagagcggcgccgaggugaagaagcccggcgccagcgugagagugcccugcaaggccagcggcuacaccuucaccagauacggcaucagcugggugagacaggcccccggccagggccuggaguggaugggcuggaucagcgccuacaacggcaagaccuacuacgcccagaagcugcagggcagagugaccaugaccaccgacaccagcaccagcaccgccuacauggagcugagaagccugagaagcgacgacaccgccguguacuacugcgccagaagcccccugcugugguucgaggagcuguacuucgacuacuggggccagggcacccuggugaccgugagcagc

SEQ ID NO: 30940 - RNA, 324 nt, Artificial Sequence
  derived and/or modified sequence opt4 from HuMab-059_LightChain_VJ-Region
gagaucgugcugacccagagccccggcacccugagccugagccccggcgagagagccacccugagcugcagagccagccagagcgugagcagcaccuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcaccagccuguucaccuucggccccggcaccaagguggacaucaag

SEQ ID NO: 30941 - RNA, 366 nt, Artificial Sequence
  derived and/or modified sequence opt4 from HuMab-060_HeavyChain_VDJ-Region
gaggugcagcuggugcagagcggcgccgaggugaagaagcccggcgagagccugaagaucagcugcaagggcagcggcuacagauucaccagcuacuggaucggcugggugagacagaugcccggcaagggccuggaguggaugggcagcaucuaccccggcgacagcuacaccagaaacagccccagcuuccagggccaggugaccaucagcgccgacaagagcaucgccaccgccuaccugcaguggaacagccugaaggccagcgacaccgccauguacuacugcgccagacacgccggcgacuucuacuacuucgacggccuggacguguggggccagggcaccaccgugaccgugagcagc

SEQ ID NO: 30942 - RNA, 327 nt, Artificial Sequence
  derived and/or modified sequence opt4 from HuMab-060_LightChain_VJ-Region
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagcccccccaucaccuucggccagggcaccagacuggagaucaag

SEQ ID NO: 30943 - RNA, 366 nt, Artificial Sequence
  derived and/or modified sequence opt4 from HuMab-067_HeavyChain_VDJ-Region
gaggugcagcuggugcagagcggcgccgaggugaagaagcccggcgagagccugaagaucagcugcaagggcagcggcuacagcuucaccagcuacuggaucggcugggugagacagaugcccggcaagggccuggaguggaugggcaucaucuaccccggcgacagcgacaccagauacagccccagcuuccagggccaggugaccaucagcguggacaagagcaucagcaccgccuaccugcaguggagcagccugaaggccagcgacaccgccauguacuacugcgccagacagaagggcgacuacuacuaccacuacggccuggacguguggggccagggcaccaccgugaccgugagcagc

SEQ ID NO: 30944 - RNA, 366 nt, Artificial Sequence
  derived and/or modified sequence opt4 from HuMab-072_HeavyChain_VDJ-Region
gaggugcagcuggugcagagcggcgccgaggugaagaagcccggcgagagccugaagaucagcugcaagggcagcggcuacagcuucaccagcuacuggaucggcugggugagacagaugcccggcaagggccuggaguggaugggcaucaucuaccccggcgacagcgacaccagauacagccccagcuuccagggccaggugaccaucagcgccgacaagagcaucagcaccgccuaccugcaguggagcagccugaaggccagcgacaccgccauguacuacugcgccagacagaagggcgacuacuacuacuucaacggccuggacguguggggccagggcaccaccgugaccgugagcagc

SEQ ID NO: 30945 - RNA, 327 nt, Artificial Sequence
  derived and/or modified sequence opt4 from HuMab-072_LightChain_VJ-Region
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagccccagacugaccuucggcggcggcaccaagguggagaucaag

SEQ ID NO: 30946 - RNA, 363 nt, Artificial Sequence
  derived and/or modified sequence opt4 from HuMab-084_HeavyChain_VDJ-Region
caggugcagcuggugcagagcggcgccgaggugaagaagcccggcagcagcgugaaggugagcugcaaggccagcggcggcaccuucagaaccuacgccaucaacugggugagacaggcccccggccagggccuggaguggaugggcagaaucaacaccgugcugggcaucgugaaccacgcccagaaguuccagggcagagugaccaucaccgccgacaagagcaccaacaccgccuacauggagcugaacagccugagaagcgaggacaccgccguguacuacugcgccagagagaagggcguggacuacuacuacggcaucgagguguggggccagggcaccaccgugaccgugagcagc

SEQ ID NO: 30947 - RNA, 321 nt, Artificial Sequence
  derived and/or modified sequence opt4 from HuMab-084_LightChain_VJ-Region
gacauccagaugacccagagccccagcagcgugagcgccagcgugggcgacagagugaccaucaccugcagagccagccagggcaucagcagcuggcuggccugguaccagcacaagcccggcaaggcccccaagcugcugaucuacguggccagcacccugcagagcggcgugcccagcagauucagcggcagcggcagcggcaccgacuucacccugaccaucagcagccugcagcccgaggacuucgccaccuacuacugccagcaggccaacagcuucccccugaccuucggcggcggcaccaagguggagaucaag

SEQ ID NO: 30948 - RNA, 360 nt, Artificial Sequence
  derived and/or modified sequence opt4 from HuMab-091_HeavyChain_VDJ-Region
caggugcagcugcagcaguggggcgccggccugcugaagcccagcgagacccugagccugaccugcgccgugagcggcggcagcuucagcggcuacuacuggaccuggaucagacagccccccggcaagggccuggaguggaucggcgagaucuaccacagcggcgacaccaacuacaaccccagccugaagagcagagugaccaucagcguggacaccagcaagaaccaguucagccugaagcuguacagcgugaccgccgccgacaccgccguguacuacugcgccagacuguacuucggcagcggcaucuacuaccuggacuacuggggccagggcacccuggugaccgugagcagc

SEQ ID NO: 30949 - RNA, 321 nt, Artificial Sequence
  derived and/or modified sequence opt4 from HuMab-091_LightChain_VJ-Region
gacauccagaugacccagagccccagcagccugagcgccagcgugggcgacagagugaccaucaccugcagagccagccagggcaucagcagcuggcuggugugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuucccccccaccuucggccagggcaccaagguggagaucaag

SEQ ID NO: 30950 - RNA, 366 nt, Artificial Sequence
  derived and/or modified sequence opt4 from HuMab-093_HeavyChain_VDJ-Region
gaggugcagcuggugcagagcggcgccgaggugaagaagcccggcgagagccugaagaucagcugcaagggcagcggcuacagcuucaccagcuacuggaucggcugggugagacagaugcccggcaagggccuggaguggaugggcagaaucuaccccggcgacagcgacaccagauacagccccagcuuccagggccaggugaccaucagcgccgacaagagcaucaccaccgccuaccugcaguggagcagccugagagccagcgacaccgccauguacuacugcgccagacagagaggcgacuacuacuacuucuucggccuggacaucuggggccagggcaccaccgugaccgugagccug

SEQ ID NO: 30951 - RNA, 372 nt, Artificial Sequence
  derived and/or modified sequence opt4 from HuMab-098_HeavyChain_VDJ-Region
gaggugcagcugcuggagagcggcggcggccuggugcagcccggcggcagccugagacugagcugcgccgccagcggcuucaccuucagcaacuacggcaugagcugggugagacaggcccccggcaagggccuggagugggugagcgccaucagcggcagcgccuacagcaccuacuacgccgacagcgugaagggcagauucaccaucagcagagacaacagcaagaacacccuguggcugcagaugaacagccugagagccgaggacaccgccguguacuacugcgccaaggcccacuaccacggcagcggcagcuacuacacccuguucgacuacuggggccagggcacccuggugaccgugagcagc

SEQ ID NO: 30952 - RNA, 321 nt, Artificial Sequence
  derived and/or modified sequence opt4 from HuMab-098_LightChain_VJ-Region
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuaccccuacaccuucggccagggcaccaagcuggagaucaag

SEQ ID NO: 30953 - RNA, 372 nt, Artificial Sequence
  derived and/or modified sequence opt4 from HuMab-100_HeavyChain_VDJ-Region
gaggugcagcugcuggagagcggcggcggccuggugcagcccggcggcagccugagacugagcugcgccgccagcggcuucaccuucaacaacuacggcaugaacugggugagacaggcccccggcaagggccuggagugggugagcgccaucagcggcaccggcuacagcaccuacuacgccgacagcgugaagggcagauucaccaucagcagagacaacagcaagaacacccuguaccugcagaugaacagccugagagccgaggacaccgccguguacuacugcgccaaggcccacuacuucggcagcggcagcuacuacacccuguucgacuacuggggccagggcacccuggugaccgugagcagc

SEQ ID NO: 30954 - RNA, 372 nt, Artificial Sequence
  derived and/or modified sequence opt4 from HuMab-106_HeavyChain_VDJ-Region
gaggugcagcuggugcagagcggcgccgaggugaagaagcccggcgagagccugaagaucagcugcaagggcagcggcuacagcuucaccagauacuggaucggcugggugagacagaugcccggcaagggccuggaguggaugggcaucaucuaccccggcgacagcgacaccagauacagccccagcuuccagggccaggugaccaucagcgccgacaagagcaucagcaccgccuaccugcaguggagcagccugaaggccagcgacaccgccauguacuacugcgccagacugaccggcgacagaggcuucgacuacuacagcggcauggacguguggggccagggcaccaccgugaccgugagcagc

SEQ ID NO: 30955 - RNA, 321 nt, Artificial Sequence
  derived and/or modified sequence opt4 from HuMab-106_LightChain_VJ-Region
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagcuucaccuucggccccggcaccaagguggacaucaag

SEQ ID NO: 30956 - RNA, 351 nt, Artificial Sequence
  derived and/or modified sequence opt4 from HuMab_10F8_HeavyChain_V-Region
caggugcagcugguggagagcggcggcggcguggugcagcccggcagaagccugagacugagcugcaccgccagcggcuucaccuucagccacuacggcauguacugggugagacaggcccccggcaagggccuggaguggguggccgugaucugguacgacggcagcuacgaguacaacgaggacagcgugaagggcagauucaccaucagcagagacaacagcaagaacacccuguaccugcagaugaacagccugagagccgaggacaccgccguguacuacugcgccagagacagagugggccuguucgacuacuggggccagggcacccuggugaccgugagcagc

SEQ ID NO: 30957 - RNA, 408 nt, Artificial Sequence
  derived and/or modified sequence opt4 from HuMab_10F8_HeavyChain_V-Region_Precursor
auggaguucggccugagcuggguguuccugguggcccugcugagaggcgugcagugccaggugcagcugguggagagcggcggcggcguggugcagcccggcagaagccugagacugagcugcaccgccagcggcuucaccuucagccacuacggcauguacugggugagacaggcccccggcaagggccuggaguggguggccgugaucugguacgacggcagcuacgaguacaacgccgacagcgugaagggcagauucaccaucagcagagacaacagcaagaacacccuguaccugcagaugaacagccugagagccgaggacaccgccguguacuacugcgccagagacagagugggccuguucgacuacuggggccagggcacccuggugaccgugagcagc

SEQ ID NO: 30958 - RNA, 321 nt, Artificial Sequence
  derived and/or modified sequence opt4 from HuMab_10F8_LightChain_V-Region
gagaucgugcugacccagagccccggcacccugagccugagccccggcgagagagccacccugagcugcagagccagccagagcaucagcagcagcuaccuggccugguaccagcagaagcccggccaggcccccagacugcugaucuacggccccagcagcagagccaccggcauccccgacagauucagcggcagcggcagcggcaccgacuucacccugaccaucagcagacuggagcccgaggacuucgccguguacuacugccagcaguacgccggcagccugaccuucggccccggcaccaagguggacaucaag

SEQ ID NO: 30959 - RNA, 381 nt, Artificial Sequence
  derived and/or modified sequence opt4 from HuMab_10F8_LightChain_V-Region_Precursor
auggagacccccgcccagcugcuguuccugcugcugcuguggcugcccgacaccaccggcgagaucgugcugacccagagccccggcacccugagccugagccccggcgagagagccacccugagcugcagagccagccagagcaucagcagcagcuaccuggccugguaccagcagaagcccggccaggcccccagacugcugaucuacggccccagcagcagagccaccggcauccccgacagauucagcggcagcggcagcggcaccgacuucacccugaccaucagcagacuggagcccgaggacuucgccguguacuacugccagcaguacgccggcagccugaccuucggccccggcaccaagguggacaucaag

SEQ ID NO: 30960 - RNA, 357 nt, Artificial Sequence
  derived and/or modified sequence opt4 from HuMab-111_HeavyChain_VDJ-Region
caggugcagcuggugcagagcggcgccgaggugaagaagcccggcagcagcgugaaggugagcugcaaggccagcggcggcaccuucagcagcuacggcaucagcugggugagacaggcccccggccccggccuggaguggaugggcagaaucauccccauccugggcaucgccaacuacgcccagaaguuccagggcagagugaccaucaccgccgacaagagcaccaacaccgccuacauggagcugagcagccugagaagcgaggacaccgccguguacuacugcgccagagaccaggaguacagcagcaacugguacuacuggggccagggcacccuggugaccgugagcagc

SEQ ID NO: 30961 - RNA, 321 nt, Artificial Sequence
  derived and/or modified sequence opt4 from HuMab-111_LightChain_VJ-Region
gagaucgugcugacccagagccccggcacccugagccugagccccggcgagagagccacccugagcugcagagccagccagagcgugagaagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcuguacggcagcagccccaccuucggccccggcaccaagguggacaucaag

SEQ ID NO: 30962 - RNA, 363 nt, Artificial Sequence
  derived and/or modified sequence opt4 from HuMab-123_HeavyChain_VDJ-Region
caggugcagcuggugcagagcggcgccgaggugaagaagcccggcgccagcgugaaggugagcugcaaggccgccggcuacaccuucaccaacuacggcaucagcugggugagacaggcccccggccaggcccuggaguggaugggcuggaucaccaccuacagcagcaacaccaucuacgcccagaagcugcagggcagagugaccaugaccaccgacaccagcaccagcaccgccuacauggagcugagaagccugagaagcgacgacaccgccguguacuacugcgccagagacagagugguggugagacccgacuacuucgacuacuggggccagggcacccuggugaccgugagcagc

SEQ ID NO: 30963 - RNA, 321 nt, Artificial Sequence
  derived and/or modified sequence opt4 from HuMab-123_LightChain_VJ-Region
gagaucgugcugacccagagccccgccacccugagccugagccccggcgagagagccacccugagcugcagagccagccagagcgugagcagcuaccuggccugguaccagcagaagcccggccaggcccccagacugcugaucuacgacaccagcaacagagccaccggcauccccgccagauucagcggcagcggcagcggcaccgacuucacccugaccaucagcagccuggagcccgaggacuucgccguguacuacugccagcagagaagccacuggcccagaaccuucggccagggcaccaagguggagaucaag

SEQ ID NO: 30964 - RNA, 363 nt, Artificial Sequence
  derived and/or modified sequence opt4 from HuMab-124_HeavyChain_VDJ-Region
caggugcagcuggugcagagcggcgccgaggugaagaagcccggcgccagcgugaaggugagcugcaaggccgccggcuacaccuucaccaacuacggcaucagcugggugagacaggcccccggccagggccuggaguggaugggcuggaucaucaccuacaacggcaacaccaucuacgcccagagauuccaggacagagugaccaugaccaccgacaccagcaccagcaccgccuacauggagcugagaagccugagaagcgacgacaccgccguguacuacugcgccagagacagaaucaucgugagacccgacuacuucgacuacuggggccagggcacccuggugaccgugagcagc

SEQ ID NO: 30965 - RNA, 372 nt, Artificial Sequence
  derived and/or modified sequence opt4 from HuMab-125_HeavyChain_VDJ-Region
gaggugcagcugcuggagagcggcggcggccuggugcagcccggcggcagccugagacugagcugcgccgccagcggcuucaccuucaccgacuacgccaugaacugggugagacaggcccccggcaagggccuggagugggugagcaccaucagcggcagcggcuacgccaccuacuacgccgacagcgugaagggcagauucaccaucagcagagacaacagcaagaccacccuguaccugcagaugaacagccugagagccgaggacaccgccguguacuacugcgccaagggccacacccugggcagcggcagcuacuacacccuguucgacuacuggggccagggcacccuggugaccgugagcagc

SEQ ID NO: 30966 - RNA, 321 nt, Artificial Sequence
  derived and/or modified sequence opt4 from HuMab-125_LightChain_VJ-Region
gacauccagaugacccagagccccagcagccugagcgccagcgugggcgacagagugaccaucaccugcagagccagccagggcaucaacagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuaccccuacaccuucggccagggcaccaagcuggagaucaag

SEQ ID NO: 30967 - RNA, 369 nt, Artificial Sequence
  derived and/or modified sequence opt4 from HuMab-127_HeavyChain_VDJ-Region
gaggugcagcuggugcagagcggcgccgaggugaagaagcccggcgagagccugaccaucagcugcaagggcagcggcuacagcuucagcaucuacuggaucggcugggugagacagaugcccggcaagggccuggaguggaugggcaucaucuuccccggcgacagcgacaucagauacagccccagcuuccagggccaggugaccaucagcgccgacaagagcaucagcaccgccuaccugcaguggagcagccugaaggccagcgacaccgccauguacuacugcgccagacagcccggcgacuggagccccagacacugguacuucgaccuguggggcagaggcacccuggugaccgugagcagc

SEQ ID NO: 30968 - RNA, 321 nt, Artificial Sequence
  derived and/or modified sequence opt4 from HuMab-127_LightChain_VJ-Region
gugaucuggaugacccagagccccagccugcugagcgccagcaccggcgacagagugaccaucagcugcagaaugagccagggcaucagcagcuaccuggccugguaccagcagaagcccggcaaggcccccgagcugcugaucuacgccgccagcacccugcagagcggcgugcccagcagauucagcggcagcggcagcggcaccgacuucacccugaccaucagcuaccugcagagcgaggacuucgccaccuacuacugccagcaguacuacagcuucccccugaccuucggcggcggcaccaagguggagaucaag

SEQ ID NO: 30969 - RNA, 357 nt, Artificial Sequence
  derived and/or modified sequence opt4 from HuMab-129_HeavyChain_VDJ-Region
caggugcagcugguggagagcggcggcggcguggugcagcccggcagaagccugagacugagcugcgccgccagcggcuucaccuucagcaccuucgccauccacugggugagacaggcccccggcaagggccuggaguggguggccgugaucagcuacgacggcggccacaaguucuacgccgacagcgugaagggcagauucaccaucagcagagacaacagcaagaacacccuguaccugcagaugaacagccugagagccgaggacaccgccauguacuacugcgccagaggccugggcguguggggcgccuucgacuacuggggccagggcacccuggugaccgugagcagc

SEQ ID NO: 30970 - RNA, 318 nt, Artificial Sequence
  derived and/or modified sequence opt4 from HuMab-129_LightChain_VJ-Region
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacugguggaccuucggccagggcaccaagguggagaucaag

SEQ ID NO: 30971 - RNA, 375 nt, Artificial Sequence
  derived and/or modified sequence opt4 from HuMab-132_HeavyChain_VDJ-Region
caggugcagcuggugcagagcggcgccgaggugaagaagcccggcgccagcgugaaggugagcugcaaggccagcggcuacaccuucaccagcuacggcaucagcugggugagacaggcccccggccagggccuggaguggaugggcuggaucagcgccuacaacggcaacagcaacuacgugcagaaguuccagggcagagugaccaugaccaccgacaccaccaccagcaccgccuacauggagcugagaagccugaccagcgacgacaccgccguguacuacugcgccagagaguacagcuacgacagcggcaccuacuucuacuacggcauggacguguggggccagggcaccaccgugaccgugagcagc

SEQ ID NO: 30972 - RNA, 324 nt, Artificial Sequence
  derived and/or modified sequence opt4 from HuMab-132_LightChain_VJ-Region
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggcccauguacaccuucggccagggcaccaagcuggagaucaag

SEQ ID NO: 30973 - RNA, 360 nt, Artificial Sequence
  derived and/or modified sequence opt4 from HuMab-143_HeavyChain_VDJ-Region
caggugcagcugcagcaguggggcgccggccugcugaagcccagcgagacccugagccugaccugcgccguguacggcggcagcuucagcggcuacuacuggaacuggaucagacagccccccggcaagggccuggaguggaucggcgagauccaccacagcggcagcgccaacuacaaccccagccugaugagcagagugaccaucagcguggacaccagcaagaaccaguucagccugcagcugagcagcgugaccgccgccgacaccgccguguacuacugcgccagaggcuacuacggcagcggcuacuacuacuucgacuacuggggccagggcacccuggugaccgugagcagc

SEQ ID NO: 30974 - RNA, 321 nt, Artificial Sequence
  derived and/or modified sequence opt4 from HuMab-143_LightChain_VJ-Region
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccgccagcagacugcagagcggcgugcccagcagauucagcggcagcggcagcggcaccgacuucacccugaccaucagcagccugcagcccgaggacuucgccaccuacuacugccagcaguacaacagcuaccccaucaccuucggccagggcaccagacuggagaucaag

SEQ ID NO: 30975 - RNA, 366 nt, Artificial Sequence
  derived and/or modified sequence opt4 from HuMab-150_HeavyChain_VDJ-Region
gaggugcagcuggugcagagcggcgccgaggugaagaagcccggcgagagccugaagaucagcugcaagggcagcggcuacagcuucaccagcuacuggaucggcugggugagacagaugcccggcaagggccuggaguggaugggcagcaucuaccccggcgacagccacaccagauacagacccagcuuccagggccaggugaccaucagcgccgacaagagcaucagcaccgccuaccugcaguggagcagccugaaggccagcgacaccgccauguacuacugcgccagacaggccggcgacuacuacuacuacaacggcauggacguguggggccagggcaccaccgugaccgugagcagc

SEQ ID NO: 30976 - RNA, 321 nt, Artificial Sequence
  derived and/or modified sequence opt4 from HuMab-150_LightChain_VJ-Region
gagaucgugcugacccagagccccggcacccugagccugagccccggcgagagagccacccugagcugcagagccagccagagcgugagcagcagcuaccugaccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagccugaccuucggcggcggcaccaagguggagaucaag

SEQ ID NO: 30977 - RNA, 363 nt, Artificial Sequence
  derived and/or modified sequence opt4 from HuMab-152_HeavyChain_VDJ-Region
caggugcaggugguggagagcggcggcggcguggugcagcccggcagaagccugagacugagcugcgccgccagcggcuucaccuucagcagcuacgccaugcacugggugagacaggcccccggcaagggccuggaguggguggccgugaucagcuacgacggcagcuacaaguacuacgccgacagcgugaagggcagauucaccaucagcagagacaacagcaagaacacccuguaccugcagaugaacagccugagagccgaggacaccgccguguacuacugcgccagaggcagcaucaccggcagcaccggcguguucgacuacuggggccagggcacccuggugaccgugagcagc

SEQ ID NO: 30978 - RNA, 321 nt, Artificial Sequence
  derived and/or modified sequence opt4 from HuMab-152_LightChain_VJ-Region
gacauccagaugacccagagccccagcagccugagcgccagcgugggcgacagagugaccaucaccugcagagccagccagggcaucaacagcuggcuggccugguaccagcagaagcccgagaaggcccccaagagccugaucuacgacgccagcagccugcagagcggcgugcccagcagauucagcggcagcggcagcggcaccgacuucacccugaccaucagcagccugcagcccgagaacuucgccaccuacuacugccagcaguacaacagcuaccccaucaccuucggccagggcaccagacuggagaucaag

SEQ ID NO: 30979 - RNA, 363 nt, Artificial Sequence
  derived and/or modified sequence opt4 from HuMab-153_HeavyChain_VDJ-Region
caggugcagcugguggagagcggcggcggcguggugcagcccggcagaagccugagacugagcugcgccgccagcggcuucaccuucagcgacuacgugauccacugggugagacaggcccccggcaagggccuggagugggugaccgugaucagcuacgacggcagcaacaaguacuacgccgacagcgugaagggcagauucaccaucagcagagacaacagcaagaacacccuguaccugcagaugaacagccugagcgccgaggacaccgccauguacuacugcgccagaggcggcaucaccggcaccaccggcguguucgacuacuggggccagggcacccuggugaccgugagcagc

SEQ ID NO: 30980 - RNA, 321 nt, Artificial Sequence
  derived and/or modified sequence opt4 from HuMab-153_LightChain_VJ-Region
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgacgccagcagccugcagagcggcgugcccagcagauucagcggcagcggcuacggcaccgacuucagccugaccaucagcagccugcagcccgaggacuucgccaucuacuacugccagcaguacaagagcuaccccaucaccuucggccagggcaccagacuggagaucaag

SEQ ID NO: 30981 - RNA, 378 nt, Artificial Sequence
  derived and/or modified sequence opt4 from HuMab-159_HeavyChain_VDJ-Region
gaggugcagcuggugcagagcggcgccgaggugaagaagcccggcgagagccugaagaucagcugcaagggcagcggcuacaacuucaccagcuacuggaucggcugggugagacagaugcccggcaagggccuggaguggaugggcaucaucuaccccggcgacagcgacaccagauacagccccagcuuccagggccaggugaccaucagcgccgacaagagcaucagcaccgccuaccugcaguggagcagccugaaggccagcgacaccgccauguacuacugcgccagauggggcaccuacuacgacauccugaccggcuacuucaacugguucgaccccuggggccagggcacccuggugaccgugagcagc

SEQ ID NO: 30982 - RNA, 321 nt, Artificial Sequence
  derived and/or modified sequence opt4 from HuMab-159_LightChain_VJ-Region
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacuacaucuaccccuggaccuucggccagggcaccaagguggagaucaag

SEQ ID NO: 30983 - RNA, 363 nt, Artificial Sequence
  derived and/or modified sequence opt4 from HuMab-160_HeavyChain_VDJ-Region
caggugcagcugguggagagcggcggcggcguggugcagcccggcagaagccugagacugagcugcgccgccagcggcuucaccuucagcagccacgccaugcacugggugagacaggcccccggcaagggccuggaguggguggccgccaucagcuacgacggcagcaacaaguacuacgccgacagcgugaagggcagauucaccaucagcagagacaacagcaagaacaccauguaccugcagaugaacagccugagagccgaggacaccgccaugugcuacugcgccagaggcagcaucaccggcagcaccggcguguucgacuacuggggccagggcacccuggugaccgugagcagc

SEQ ID NO: 30984 - RNA, 321 nt, Artificial Sequence
  derived and/or modified sequence opt4 from HuMab-160_LightChain_VJ-Region
gacauccagaugacccagagccccagcagccugagcgccagcgugggcgacagagugaccaucaccugcagagccagccaggacaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuaccccaucaccuucggccagggcaccagacuggagaucaag

SEQ ID NO: 30985 - RNA, 372 nt, Artificial Sequence
  derived and/or modified sequence opt4 from HuMab-162_HeavyChain_VDJ-Region
gaggugcagcugugggagagcggcggcggcagcgugcagcccggcggcagccugagacugagcugcgccgccagcggcuucaccuucagcagcuacggcaugagcugggugagacaggcccccggcaagggccuggagugggugagcggcaucagcggcagcggcuacagcaccuacuacgccgacagcgugaagggcagauucaccaucagcagagacaacagcaagaacacccuguaccugcagaugaacagccugagagccgaggacaccgccguguacuacugcgccaagggcuacuaccacggcagcggcagcuacuacaccagcuucgacuacuggggccagggcacccuggugaccgugagcagc

SEQ ID NO: 30986 - RNA, 321 nt, Artificial Sequence
  derived and/or modified sequence opt4 from HuMab-162_LightChain_VJ-Region
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuacccccugaccuucggcggcggcaccaagguggagaucaag

SEQ ID NO: 30987 - RNA, 366 nt, Artificial Sequence
  derived and/or modified sequence opt4 from HuMab-163_HeavyChain_VDJ-Region
gaggugcagcuggugcagagcggcgccgaggugaagaagcccggcgagagccugaagaucagcugccagggcagcggcuacagauucaucagcuacuggaucggcugggugagacagaugcccggcaagggccuggaguggaugggcagaaucuaccccggcgacagcgacaccagauacagccccagcuuccagggccaggugaccaucagcguggacaagagcaucagcaccgccuaccugcaguggagcagccugaaggccagcgacaccgccauguacuacugcgccagacagagaggcgacuacuacuacuucaacggccuggacguguggggccagggcaccaccgugaccgugagcagc

SEQ ID NO: 30988 - RNA, 321 nt, Artificial Sequence
  derived and/or modified sequence opt4 from HuMab-163_LightChain_VJ-Region
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagccugaccuucggcggcggcaccaagguggagaucaag

SEQ ID NO: 30989 - RNA, 363 nt, Artificial Sequence
  derived and/or modified sequence opt4 from HuMab-166_HeavyChain_VDJ-Region
caggugcagcugguggagagcggcggcggcguggugcagcccggcagaagccugagacugagcugcgccgccagcggcuucaccuucagcagcuacgccaugcacugggugagacaggcccccggcaagggccuggaguggguggccgugaucagcuacgacggcagcaacgaguacuacgccgacagcgugaagggcagauucaccaucagcagagacaacagcaagaacacccuguaccugcagaugaacagccugagagccgaggacaccgccguguacuacugcgccagaggcagcaucaucggcagcaccggcguguucgacuacuggggccagggcacccuggugaccgugagcagc

SEQ ID NO: 30990 - RNA, 321 nt, Artificial Sequence
  derived and/or modified sequence opt4 from HuMab-166_LightChain_VJ-Region
gacauccagaugacccagagccccagcagccugagcgccagcgugggcgacagagugaccaucaccugcagagccagccagggcaucagcaacuggcuggccugguaccagcagaagcccgagaaggcccccaagagccugaucuacgacgccagcagccugcagagcggcgugcccagcagauucagcggcagcggcagcggcaccgacuucacccugaccaucagcagccugcagcccgaggacuucgccaccuacuacugccagcaguacaacagcuaccccaucaccuucggccagggcaccagacuggagaucaag

SEQ ID NO: 30991 - RNA, 363 nt, Artificial Sequence
  derived and/or modified sequence opt4 from HuMab-167_HeavyChain_VDJ-Region
caggugcagcugguggagagcggcggcggcguggugcagcccggcagaagccugagacugagcugcgccgccagcggcuucaccuucagcagcuacgccauccacugggugagacaggcccccggcaagggccuggaguggguggccgugaucagcuacgacggcagcaacaaguacuacgccgacagcgugaagggcagauucaccaucagcagagacaacagcaagaacacccuguaccugcagaugaacagccugagagccgaggacaccgccguguacuacugcgccagaggcagcaucaccggcagcaccggcguguucgacuacuggggccagggcacccuggugaccgugagcagc

SEQ ID NO: 30992 - RNA, 363 nt, Artificial Sequence
  derived and/or modified sequence opt4 from HuMab-169_HeavyChain_VDJ-Region
caggugcagcuggugcagagcggcgccgaggugaagaagcccggcgccagcgugaaggugagcugcaaggccagcggcuacaccuucaccaacuacggcaucagcugggugagacaggcccccggccagggccuggaguggaugggcuggcugagcgccuacagcggcaacaccaucuacgcccagaagcugcagggcagagugaccaugaccaccgacaccagcaccaccaccgccuacauggagcugagaagccugagaagcgacgacaccgccguguacuacugcgccagagacagaaucguggugagacccgacuacuucgacuacuggggccagggcacccuggugaccgugagcagc

SEQ ID NO: 30993 - RNA, 321 nt, Artificial Sequence
  derived and/or modified sequence opt4 from HuMab-169_LightChain_VJ-Region
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggcccagaaccuucggccagggcaccaagguggagaucaag

SEQ ID NO: 30994 - RNA, 366 nt, Artificial Sequence
  derived and/or modified sequence opt4 from HuMab-7D8_HeavyChain_VH-Region
gaggugcagcugguggagagcggcggcggccuggugcagcccgacagaagccugagacugagcugcgccgccagcggcuucaccuuccacgacuacgccaugcacugggugagacaggcccccggcaagggccuggagugggugagcaccaucagcuggaacagcggcaccaucggcuacgccgacagcgugaagggcagauucaccaucagcagagacaacgccaagaacagccuguaccugcagaugaacagccugagagccgaggacaccgcccuguacuacugcgccaaggacauccaguacggcaacuacuacuacggcauggacguguggggccagggcaccaccgugaccgugagcagc

SEQ ID NO: 30995 - RNA, 366 nt, Artificial Sequence; identical to SEQ ID NO: 30994
  derived and/or modified sequence opt4 from HuMab-7D8_HeavyChain_V-Region

SEQ ID NO: 30996 - RNA, 321 nt, Artificial Sequence
  derived and/or modified sequence opt4 from HuMab-7D8_LightChain_VL-Region
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggcccaucaccuucggccagggcaccagacuggagaucaag

SEQ ID NO: 30997 - RNA, 321 nt, Artificial Sequence; identical to SEQ ID NO: 30996
  derived and/or modified sequence opt4 from HuMab-7D8_LightChain_V-Region

SEQ ID NO: 30998 - RNA, 324 nt, Artificial Sequence
  derived and/or modified sequence opt4 from huMAb-anti-MSP10.1_LightChain_VJ-Region
gagaucgugcugacccagagccccgacauccugagccugagccccggcgagagagccacccugagcugcagagccagccaggcccugaccgccaaguaccuggccugguaccagcagaagcccggccaggugcccagacugcugaucuacggcagcagcaccagagccaccggcauccccgacagauucagaggcagcggcagcggcaccgacuucacccugaccaucagcagacuggagcccgccgacagcgccguguacuacugccagcaguacgaggacagccccuggaccuucggccagggcaccaagcuggagaucaag

SEQ ID NO: 30999 - RNA, 324 nt, Artificial Sequence
  derived and/or modified sequence opt4 from huMAb-anti-MSP10.2_LightChain_VJ-Region
gagaucgugcugacccagagccccgacacccugagccugagccccggcgagaccgccacccugagcugcagagccagccagaccgugagaagaaacagccuggccugguaccagcagaagcccggccaggcccccagacugcugaucuacggcgccagcgacagagccaccggcauccccgacagauucagcggcagcggcuucggcaccgacuucacccugaccgugagcggccuggagcccgaggacuucgccguguacuacugccagcaguacggcaccagccccagaaccuucggccagggcaccaagcuggagaucaag

SEQ ID NO: 31000 - RNA, 324 nt, Artificial Sequence
  derived and/or modified sequence opt4 from HUMAB-Clone_18_VJ-Region
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaagagagccaccggcauccccgccagauucagcggcagcggcagcggcaccgacuucacccugaccaucagcagccuggagcccgaggacuucgccguguacuacugccagcagagaagcaaguggccccccuggaccuucggccagggcaccaagguggagagcaag

SEQ ID NO: 31001 - RNA, 324 nt, Artificial Sequence
  derived and/or modified sequence opt4 from HUMAB-Clone_22_VJ-Region
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaaguggccccccuggaccuucggccagggcaccaagguggagaucaag

SEQ ID NO: 31002 - RNA, 432 nt, Artificial Sequence
  derived and/or modified sequence opt4 from HuMab-L612_Chain_VDJ-Region_Precursor
auggaguucggccugaccuggcuguuccugguggccaaccugaagggcgugcagugcgaggugcagcugcuggacagcggcggcggccuggugcagcccggcggcugccugagacugagcugcgccgccagcggcuucaccuucagcagcugcgccaugagcugggugagacaggcccccggcaagggccuggagugggugagcgccaucagcggcagcggcggcagcaccuacuacgccgacagcgugaagggcagauucaccaucagcagagacaagagcaagaacacccuguaccugcagaugaacagccugagagccgaggacaccgccguguacuacugcgccaagggcggcaacgacauccugaccggcuacuacgccuggggccagggcacccuggugaccgugagcagcggcagcgccagcgcc

SEQ ID NO: 31003 - RNA, 321 nt, Artificial Sequence
  derived and/or modified sequence opt4 from HuMab_LC5002-002_LightChain_V-Region
gacauccagaugacccagagccccagcagccugagcgccagcgugggcgacagagugaccaucaccugcagagccagccagggcaucagcagauggguggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuaccccuggaccuucggccagggcaccaagguggagaucaag

SEQ ID NO: 31004 - RNA, 357 nt, Artificial Sequence
  derived and/or modified sequence opt4 from HuMab_LC5002-002_gamma1-Chain_V-Region
gaggugcagcugcuggagagcggcggcggccuggugcagcccggcggcagccugagacugagcugcgccgccagcggcuucaccuucaacaucuacgccaugaacugggugagacaggcccccggcaagggccuggagugggugagcgugaucagcggcagaggcaucaccaccuacuacgccgacagcgugaagggcagauucaccaucagcagagacaacagcaagaacacccuguaccugcagaugaacagccugagagccgacgacaccgccguguacuacugcgccaagggcagcagcagcuggaccgacuucgacuacuggggccagggcacccuggugaccgugagcagc

SEQ ID NO: 31005 - RNA, 321 nt, Artificial Sequence
  derived and/or modified sequence opt4 from HuMab_LC5002-003_LightChain_V-Region
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuaccccuggaccuucggccagggcaccaagguggagaucaag

SEQ ID NO: 31006 - RNA, 357 nt, Artificial Sequence
  derived and/or modified sequence opt4 from HuMab_LC5002-003_gamma1-Chain_V-Region
gaggugcagcugcuggagagcggcggcgaccugauccagcccggcggcagccugagacugagcugcgccgccagcggcuucaccuucaacaucuacgccaugaacugggugagacaggcccccggcaagggccuggagugggugagcgugaucagcggcagaggcaucaccaccuacuacgccgacagcgugaagggcagauucaccaucagcagagacaacagcaagaacacccuguaccugcagauggacagccugagagccgaggacaccgccguguacuacugcgccaagggcagcagcuacuggaccgacuucgacuacuggggccagggcacccuggugaccgugagcagc

SEQ ID NO: 31007 - RNA, 321 nt, Artificial Sequence
  derived and/or modified sequence opt4 from HuMab_LC5002-005_LightChain_V-Region
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagccacccccccaccuucggccagggcaccaagcuggagaucaag

SEQ ID NO: 31008 - RNA, 354 nt, Artificial Sequence
  derived and/or modified sequence opt4 from HuMab_LC5002-005_gamma1-Chain_V-Region
gaggugcaggugcuggacagcggcggcggccuggugcagcccggcggcagccugagacugagcugcaccgccagcggcuucaccuucagacuguacaccaugagcugggugagacagacccccggcagaggccuggagugggugagcggcaucagcggcagcggccugagcaccuacuucgccgacagcgugaagggcagauucaccaucagcagagacaacagcaagaacaccguguaccugcagaugaacagccugagagccgaggacaccgccguguacuacugcgccaaggagggcgacuggaucuacuucgacagcuggggccagggcacccuggugaucgugagcagc

SEQ ID NO: 31009 - RNA, 321 nt, Artificial Sequence
  derived and/or modified sequence opt4 from HuMab_LC5002-007_LightChain_V-Region
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaucggcauccccgacagauucagcggcagcggcagcggcaccgacuucacccugaccaucagcagacuggagcccgaggacuucgccguguacuacugccagcacuacggcagcagccugaccuucggcggcggcaccaagguggagaucaag

SEQ ID NO: 31010 - RNA, 369 nt, Artificial Sequence
  derived and/or modified sequence opt4 from HuMab_LC5002-007__gamma1-Chain_V-Region
caggugcagcuggugcagagcggcgccgaggugaagaagcccggcagcagcgugaaggugagcugcaaggugagcggcggcaccuucagcagcuacgccuucagcugggugagacaggcccccggccagggccuggaguggaugggcagaaucauccccauccugggcagaaccaacuacgcccagaaguuccagggcagagugaccaucaccgccgacaagagcaccagcaccgccuacauggaggugagcagccugagaagcgaggacaccgccguguacuacugcgccagagagggcgagacccuggacuacuucuacuacggcauggacguguggggccagggcaccaccgugaccgugagcagc

SEQ ID NO: 31011 - RNA, 357 nt, Artificial Sequence
  derived and/or modified sequence opt4 from HuMab_LC5002-018_gamma1-Chain_V-Region
gaggugcagcugcuggagagcggcggcggccuggugcagcccggcggcagccugagacugagcugcgccgccagcggcuucaccuucaacaucuacgccaugaacugggugagacaggcccccggcaagggccuggagugggugagcgugaucagcggcagcggcgugaccaccuacuacgccgacagcgugaagggcagauucaccaucagcagagacaacagcaagaacacccuguaccugcagaugaacagccugagagccgaggacaccgccguguacuacugcgccaagggcagcagcugguacguggacuucgacuacuggggccagggcacccuggugaccgugagcagc

SEQ ID NO: 31012 - RNA, 1347 nt, Artificial Sequence
  derived and/or modified sequence opt4 from Ibalizumab_HeavyChain1
caggugcagcugcagcagagcggccccgagguggugaagcccggcgccagcgugaagaugagcugcaaggccagcggcuacaccuucaccagcuacgugauccacugggugagacagaagcccggccagggccuggacuggaucggcuacaucaaccccuacaacgacggcaccgacuacgacgagaaguucaagggcaaggccacccugaccagcgacaccagcaccagcaccgccuacauggagcugagcagccugagaagcgaggacaccgccguguacuacugcgccagagagaaggacaacuacgccaccggcgccugguucgccuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugccccagcugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31013 - RNA, 657 nt, Artificial Sequence
  derived and/or modified sequence opt4 from Ibalizumab_LightChain1
gacaucgugaugacccagagccccgacagccuggccgugagccugggcgagagagugaccaugaacugcaagagcagccagagccugcuguacagcaccaaccagaagaacuaccuggccugguaccagcagaagcccggccagagccccaagcugcugaucuacugggccagcaccagagagagcggcgugcccgacagauucagcggcagcggcagcggcaccgacuucacccugaccaucagcagcgugcaggccgaggacguggccguguacuacugccagcaguacuacagcuacagaaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31014 - RNA, 1329 nt, Artificial Sequence
  derived and/or modified sequence opt4 from Ibritumomab_tiuxetan_HeavyChain
caggccuaccugcagcagagcggcgccgagcuggugagacccggcgccagcgugaagaugagcugcaaggccagcggcuacaccuucaccagcuacaacaugcacugggugaagcagacccccagacagggccuggaguggaucggcgccaucuaccccggcaacggcgacaccagcuacaaccagaaguucaagggcaaggccacccugaccguggacaagagcagcagcaccgccuacaugcagcugagcagccugaccagcgaggacagcgccguguacuucugcgccagagugguguacuacagcaacagcuacugguacuucgacguguggggcaccggcaccaccgugaccgugagcgcccccagcguguacccccuggcccccgugugcggcgacaccaccggcagcagcgugacccugggcugccuggugaagggcuacuuccccgagcccgugacccugaccuggaacagcggcagccugagcagcggcgugcacaccuuccccgccgugcugcagagcgaccuguacacccugagcagcagcgugaccgugaccagcagcaccuggcccagccagagcaucaccugcaacguggcccaccccgccagcagcaccaagguggacaagaagaucgagcccagaggccccaccaucaagcccugcccccccugcaagugccccgcccccaaccugcugggcggccccagcguguucaucuucccccccaagaucaaggacgugcugaugaucagccugagccccaucgugaccugcguggugguggacgugagcgaggacgaccccgacgugcagaucagcugguucgugaacaacguggaggugcacaccgcccagacccagacccacagagaggacuacaacagcacccugagaguggugagcgcccugcccauccagcaccaggacuggaugagcggcaaggaguucaagugcaaggugaacaacaaggaccugcccgcccccaucgagagaaccaucagcaagcccaagggcagcgugagagccccccagguguacgugcugcccccccccgaggaggagaugaccaagaagcaggugacccugaccugcauggugaccgacuucaugcccgaggacaucuacguggaguggaccaacaacggcaagaccgagcugaacuacaagaacaccgagcccgugcuggacagcgacggcagcuacuucauguacagcaagcugagaguggagaagaagaacuggguggagagaaacagcuacagcugcagcguggugcacgagggccugcacaaccaccacaccaccaagagcuucagcaga

SEQ ID NO: 31015 - RNA, 627 nt, Artificial Sequence
  derived and/or modified sequence opt4 from Ibritumomab_tiuxetan_LightChain
cagaucgugcugagccagagccccgccauccugagcgccagccccggcgagaaggugaccaugaccugcagagccagcagcagcgugagcuacaugcacugguaccagcagaagcccggcagcagccccaagcccuggaucuacgcccccagcaaccuggccagcggcgugcccgccagauucagcggcagcggcagcggcaccagcuacagccugaccaucagcagaguggaggccgaggacgccgccaccuacuacugccagcaguggagcuucaacccccccaccuucggcgccggcaccaagcuggagcugaagagagccgacgccgcccccaccguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaac

SEQ ID NO: 31016 - RNA, 1368 nt, Artificial Sequence
  derived and/or modified sequence opt4 from Icrucumab_HeavyChain1
caggcccaggugguggagagcggcggcggcguggugcagagcggcagaagccugagacugagcugcgccgccagcggcuucgccuucagcagcuacggcaugcacugggugagacaggcccccggcaagggccuggaguggguggccgugaucugguacgacggcagcaacaaguacuacgccgacagcgugagaggcagauucaccaucagcagagacaacagcgagaacacccuguaccugcagaugaacagccugagagccgaggacaccgccguguacuacugcgccagagaccacuacggcagcggcgugcaccacuacuucuacuacggccuggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31017 - RNA, 645 nt, Artificial Sequence
  derived and/or modified sequence opt4 from Icrucumab_LightChain1
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagcccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31018 - RNA, 675 nt, Artificial Sequence
  derived and/or modified sequence opt4 from Idarucizumab_HeavyChain1
caggugcagcugcaggagagcggccccggccuggugaagcccagcgagacccugagccugaccugcaccgugagcggcuucagccugaccagcuacaucguggacuggaucagacagccccccggcaagggccuggaguggaucggcgugaucugggccggcggcagcaccggcuacaacagcgcccugagaagcagagugagcaucaccaaggacaccagcaagaaccaguucagccugaagcugagcagcgugaccgccgccgacaccgccguguacuacugcgccagcgccgccuacuacagcuacuacaacuacgacggcuucgccuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugc

SEQ ID NO: 31019 - RNA, 657 nt, Artificial Sequence
  derived and/or modified sequence opt4 from Idarucizumab_LightChain1
gacguggugaugacccagagcccccugagccugcccgugacccugggccagcccgccagcaucagcugcaagagcagccagagccugcuguacaccgacggcaagaccuaccuguacugguuccugcagagacccggccagagccccagaagacugaucuaccuggugagcaagcuggacagcggcgugcccgacagauucagcggcagcggcagcggcaccgacuucacccugaagaucagcagaguggaggccgaggacgugggcguguacuacugccugcagagcacccacuucccccacaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31020 - RNA, 1332 nt, Artificial Sequence
  derived and/or modified sequence opt4 from Igatuzuab_HeavyChain1
caggugcagcuggugcagagcggcgccgaggugaagaagcccggcagcagcgugaaggugagcugcaaggccagcggcuucaccuucaccgacuacaagauccacugggugagacaggcccccggccagggccuggaguggggcuacuucaaccccaacagcggcuacagcaccuacgcccagaaguuccagggcagagugaccaucaccgccgacaagagcaccagcaccgccuacgagcugagcagccugagaagcgaggacaccgccguguacuacugcgccagacugagccccggcggcuacuacguggacgccuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggc

SEQ ID NO: 31021 - RNA, 636 nt, Artificial Sequence
  derived and/or modified sequence opt4 from Igatuzuab_LightChain1
gacauccagacccagagccccagcagccugagcgccagcgugggcgacagagugaccaucaccugcagagccagccagggcaucaacaacuaccugaacugguaccagcagaagcccggcaaggcccccaagagacugaucuacaacaccaacaaccugcagaccggcgugcccagcagauucagcggcagcggcagcggcaccgaguucacccugaccaucagcagccugcagcccgaggacuucgccaccuacuacugccugcagcacaacagcuuccccaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31022 - RNA, 357 nt, Artificial Sequence
  derived and/or modified sequence opt4 from IGF-IR_HUMAB-1A_HeavyChain
gaggugcagcuggugcagagcggcggcggccuggugcaccccggcggcagccugagacugagcugcgccggcagcggcuucaccuucagaaacuacgccauguacugggugagacaggcccccggcaagggccuggagugggugagcgccaucggcagcggcggcggcaccuacuacgccgacagcgugaagggcagauucaccaucagcagagacaacgccaagaacagccuguaccugcagaugaacagccugagagccgaggacauggccguguacuacugcgccagagcccccaacuggggcagcgacgccuucgacaucuggggccagggcaccauggugaccgugagcagc

SEQ ID NO: 31023 - RNA, 357 nt, Artificial Sequence
  derived and/or modified sequence opt4 from IGF-IR_HUMAB-23_HeavyChain
gaggugcagcuggugcagagcggcggcggccuggugcaccccggcggcagccugagacugagcugcgccggcagcggcuucaccuucagcaacuacgccauguacugggugagacaggcccccggcaagggccuggagugggugagcgccaucggcagcggcggcggcaccuacuacgccgacagcgugaagggcagauucaccaucagcagagacaacgccaagaacagccuguaccugcagaugaacagccugagagccgaggacauggccguguaccacugcgccagagcccccaacuggggcagcgaggccuucgacaucuggggccagggcaccauggugaccgugagcagc

SEQ ID NO: 31024 - RNA, 321 nt, Artificial Sequence; identical to SEQ ID NO: 30920
  derived and/or modified sequence opt4 from IGF-IR_HUMAB-23_LightChain

SEQ ID NO: 31025 - RNA, 357 nt, Artificial Sequence
  derived and/or modified sequence opt4 from IGF-IR_HUMAB-8_HeavyChain
gaggugcagcuggugcagagcggcggcggccuggugcaccccggcggcagccugagacugagcugcgccggcagcggcuucaccuucagaagcuacgccauguacugggugagacaggcccccggcaagggccuggagugggugagcgccaucggcagcggcggcggcaccuacuacgccgacagcgugaagggcagauucaccaucagcagagacaacgccaagaacagccuguaccugcagaugaacagccugagagccgaggacauggccguguacuacugcgccagagcccccaacuggggcagcgacgccuucgacaucuggggccagggcaccauggugaccgugagcagc

SEQ ID NO: 31026 - RNA, 321 nt, Artificial Sequence
  derived and/or modified sequence opt4 from IGF-IR_HUMAB-8_LightChain
gacauccagaugacccagagccccagcagccugagcgccagcgugggcgacagagugaccaucaccugcagagccagccagggcaucagcagcuggcuggccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacaacagcuacccccccaccuucggccccggcaccaagguggacaucaag

SEQ ID NO: 31027 - RNA, 708 nt, Artificial Sequence
  derived and/or modified sequence opt4 from ImAb1_LightChain
auggacaugagagcccccgcccaguucuucggcauccugcugcugugguuccccggcaucagaugcgacaucaagaugacccagagccccagcagcauguacgccagccugggcgagagagugaccaucaccugcaaggccagccaggacaucaagagcuaccugagcugguaccagcagaagcccuggaagagccccaagauccugaucuacuacgccaccagccuggccgacggcgugcccagcagaaucagcggcagcggcagcggccaggacuacagccugaccaucagcagccuggagagcgacgacaccgccaccuacuacugccugcagcacggcgagagccccuacaccuucggcggcggcaccaagcuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagugc

SEQ ID NO: 31028 - RNA, 681 nt, Artificial Sequence
  derived and/or modified sequence opt4 from ImAb1_gamma1-Chain
augaacuucggcuucagccugaucuuccuggugcuggugcugaagggcgugcagugcgaggugaagcugguggagagcggcggcggccuggugaagcccggcggcagccugaagcugagcugcgccgccagcggcuucaccuucagcaacuacgccaugagcugggugagacagacccccgagaagagacuggaguggguggccagcaucagcagcgacggcgacaccuacuuccccgacaacgugaagggcagauucaccaucagcagagagaacgccggcaacauccuguuccugcagaugagcagccugagaagcgaggacaccgccauguacuacugcgccagaggcuucaugaucaccuucuggggccagggcacccuggugaccgugagcgccgccaagaccaccccccccagcguguacccccuggcccccggcugcggcgacaccaccggcagcagcgugacccugggcugccuggugaagggcuacuuccccgagagcgugaccgugaccuggaacagcggcagccugagcagcagcgugcacaccuuccccgcccugcugcagagcggccuguacaccaugagcagcagcgugaccgugcccagcagcaccuggcccagccagaccgugaccugcagcguggcccaccccgccagcagcaccaccguggac

SEQ ID NO: 31029 - RNA, 1344 nt, Artificial Sequence
  derived and/or modified sequence opt4 from Imalumab_HeavyChain1
gaggugcagcugcuggagagcggcggcggccuggugcagcccggcggcagccugagacugagcugcgccgccagcggcuucaccuucagcaucuacagcaugaacugggugagacaggcccccggcaagggccuggagugggugagcagcaucggcagcagcggcggcaccaccuacuacgccgacagcgugaagggcagauucaccaucagcagagacaacagcaagaacacccuguaccugcagaugaacagccugagagccgaggacaccgccguguacuacugcgccggcagccaguggcuguacggcauggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31030 - RNA, 642 nt, Artificial Sequence
  derived and/or modified sequence opt4 from Imalumab_LightChain1
gacauccagaugacccagagccccagcagccugagcgccagcgugggcgacagagugaccaucaccugcagaagcagccagagaaucaugaccuaccugaacugguaccagcagaagcccggcaaggcccccaagcugcugaucuucguggccagccacagccagagcggcgugcccagcagauucagaggcagcggcagcgagaccgacuucacccugaccaucagcggccugcagcccgaggacagcgccaccuacuacugccagcagagcuucuggaccccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31031 - RNA, 1347 nt, Artificial Sequence
  derived and/or modified sequence opt4 from Imgatuzumab_HeavyChain1
caggugcagcuggugcagagcggcgccgaggugaagaagcccggcagcagcgugaaggugagcugcaaggccagcggcuucaccuucaccgacuacaagauccacugggugagacaggcccccggccagggccuggaguggaugggcuacuucaaccccaacagcggcuacagcaccuacgcccagaaguuccagggcagagugaccaucaccgccgacaagagcaccagcaccgccuacauggagcugagcagccugagaagcgaggacaccgccguguacuacugcgccagacugagccccggcggcuacuacgugauggacgccuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31032 - RNA, 639 nt, Artificial Sequence
  derived and/or modified sequence opt4 from Imgatuzumab_LightChain1
gacauccagaugacccagagccccagcagccugagcgccagcgugggcgacagagugaccaucaccugcagagccagccagggcaucaacaacuaccugaacugguaccagcagaagcccggcaaggcccccaagagacugaucuacaacaccaacaaccugcagaccggcgugcccagcagauucagcggcagcggcagcggcaccgaguucacccugaccaucagcagccugcagcccgaggacuucgccaccuacuacugccugcagcacaacagcuuccccaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31033 - RNA, 1353 nt, Artificial Sequence
  derived and/or modified sequence opt4 from Inclacumab_HeavyChain1
gaggugcagcugguggagagcggcggcggccuggugagacccggcggcagccugagacugagcugcgccgccagcggcuucaccuucagcaacuacgacaugcacugggugagacaggccaccggcaagggccuggagugggugagcgccaucaccgccgccggcgacaucuacuaccccggcagcgugaagggcagauucaccaucagcagagagaacgccaagaacagccuguaccugcagaugaacagccugagagccggcgacaccgccguguacuacugcgccagaggcagauacagcggcagcggcagcuacuacaacgacugguucgaccccuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguucgagggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31034 - RNA, 642 nt, Artificial Sequence
  derived and/or modified sequence opt4 from Inclacumab_LightChain1
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31035 - RNA, 1347 nt, Artificial Sequence
  derived and/or modified sequence opt4 from Indatuximab_ravtansine_HeavyChain1
caggugcagcugcagcagagcggcagcgagcugaugaugcccggcgccagcgugaagaucagcugcaaggccaccggcuacaccuucagcaacuacuggaucgagugggugaagcagagacccggccacggccuggaguggaucggcgagauccugcccggcaccggcagaaccaucuacaacgagaaguucaagggcaaggccaccuucaccgccgacaucagcagcaacaccgugcagaugcagcugagcagccugaccagcgaggacagcgccguguacuacugcgccagaagagacuacuacggcaacuucuacuacgccauggacuacuggggccagggcaccagcgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugccccagcugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31036 - RNA, 642 nt, Artificial Sequence
  derived and/or modified sequence opt4 from Indatuximab_ravtansine_LightChain1
gacauccagaugacccagagcaccagcagccugagcgccagccugggcgacagagugaccaucagcugcagcgccagccagggcaucaacaacuaccugaacugguaccagcagaagcccgacggcaccguggagcugcugaucuacuacaccagcacccugcagagcggcgugcccagcagauucagcggcagcggcagcggcaccgacuacagccugaccaucagcaaccuggagcccgaggacaucggcaccuacuacugccagcaguacagcaagcugcccagaaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31037 - RNA, 1347 nt, Artificial Sequence
  derived and/or modified sequence opt4 from Indusatumab_vedotin_HeavyChain1
caggugcagcugcagcaguggggcgccggccugcugaagcccagcgagacccugagccugaccugcgccguguucggcggcagcuucagcggcuacuacuggagcuggaucagacagccccccggcaagggccuggaguggaucggcgagaucaaccacagaggcaacaccaacgacaaccccagccugaagagcagagugaccaucagcguggacaccagcaagaaccaguucgcccugaagcugagcagcgugaccgccgccgacaccgccguguacuacugcgccagagagagaggcuacaccuacggcaacuucgaccacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31038 - RNA, 642 nt, Artificial Sequence
  derived and/or modified sequence opt4 from Indusatumab_vedotin_LightChain1
gagaucgugaugacccagagccccgccacccugagcgugagccccggcgagagagccacccugagcugcagagccagccagagcgugagcagaaaccuggccugguaccagcagaagcccggccaggcccccagacugcugaucuacggcgccagcaccagagccaccggcauccccgccagauucagcggcagcggcagcggcaccgaguucacccugaccaucggcagccugcagagcgaggacuucgccguguacuacugccagcaguacaagaccuggcccagaaccuucggccagggcaccaacguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31039 - RNA, 1353 nt, Artificial Sequence
  derived and/or modified sequence opt4 from Inebilizumab_HeavyChain1
gaggugcagcugguggagagcggcggcggccuggugcagcccggcggcagccugagacugagcugcgccgccagcggcuucaccuucagcagcagcuggaugaacugggugagacaggcccccggcaagggccuggagugggugggcagaaucuaccccggcgacggcgacaccaacuacaacgugaaguucaagggcagauucaccaucagcagagacgacagcaagaacagccuguaccugcagaugaacagccugaagaccgaggacaccgccguguacuacugcgccagaagcggcuucaucaccaccgugagagacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31040 - RNA, 654 nt, Artificial Sequence
  derived and/or modified sequence opt4 from Inebilizumab_LightChain1
gagaucgugcugacccagagccccgacuuccagagcgugacccccaaggagaaggugaccaucaccugcagagccagcgagagcguggacaccuucggcaucagcuucaugaacugguuccagcagaagcccgaccagagccccaagcugcugauccacgaggccagcaaccagggcagcggcgugcccagcagauucagcggcagcggcagcggcaccgacuucacccugaccaucaacagccuggaggccgaggacgccgccaccuacuacugccagcagagcaaggaggugcccuucaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31041 - RNA, 90 nt, Artificial Sequence
  derived and/or modified sequence opt4 from Insulin_peglispro_Fragment1
uucgugaaccagcaccugugcggcagccaccugguggaggcccuguaccuggugugcggcgagagaggcuucuucuacaccaagcccacc

SEQ ID NO: 31042 - RNA, 63 nt, Artificial Sequence
  derived and/or modified sequence opt4 from Insulin_peglispro_Fragment2
ggcaucguggagcagugcugcaccagcaucugcagccuguaccagcuggagaacuacugcaac

SEQ ID NO: 31043 - RNA, 495 nt, Artificial Sequence
  derived and/or modified sequence opt4 from Interferon_beta-1b_chain1
agcuacaaccugcugggcuuccugcagagaagcagcaacuuccagagccagaagcugcuguggcagcugaacggcagacuggaguacugccugaaggacagaaugaacuucgacauccccgaggagaucaagcagcugcagcaguuccagaaggaggacgccgcccugaccaucuacgagaugcugcagaacaucuucgccaucuucagacaggacagcagcagcaccggcuggaacgagaccaucguggagaaccugcuggccaacguguaccaccagaucaaccaccugaagaccgugcuggaggagaagcuggagaaggaggacuucaccagaggcaagcugaugagcagccugcaccugaagagauacuacggcagaauccugcacuaccugaaggccaaggaguacagccacugcgccuggaccaucgugagaguggagauccugagaaacuucuacuucaucaacagacugaccggcuaccugagaaac

SEQ ID NO: 31044 - RNA, 1347 nt, Artificial Sequence
  derived and/or modified sequence opt4 from Intetumumab_HeavyChain1
caggugcagcugguggagagcggcggcggcguggugcagcccggcagaagcagaagacugagcugcgccgccagcggcuucaccuucagcagauacaccaugcacugggugagacaggcccccggcaagggccuggaguggguggccgugaucagcuucgacggcagcaacaaguacuacguggacagcgugaagggcagauucaccaucagcagagacaacagcgagaacacccuguaccugcaggugaacauccugagagccgaggacaccgccguguacuacugcgccagagaggccagaggcagcuacgccuucgacaucuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31045 - RNA, 645 nt, Artificial Sequence
  derived and/or modified sequence opt4 from Intetumumab_LightChain1
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggccccccuucaccuucggccccggcaccaagguggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31046 - RNA, 1347 nt, Artificial Sequence; identical to SEQ ID NO: 30904
  derived and/or modified sequence opt4 from Iodine_(124I)_Girentuximab_HeavyChain1

SEQ ID NO: 31047 - RNA, 642 nt, Artificial Sequence; identical to SEQ ID NO: 30905
  derived and/or modified sequence opt4 from Iodine_(124I)_Girentuximab_LightChain1

SEQ ID NO: 31048 - RNA, 1335 nt, Artificial Sequence
  derived and/or modified sequence opt4 from Iodine_(131I)_derlotuxiab_biotin_HeavyChain1
caggugcagcugaaggagagcggccccggccugguggcccccagccagagccugagcaucaccugcaccgugagcggcuucagccugaccgacuacggcgugagauggaucagacagccccccggcaagggccuggaguggcugggcgugaucuggggcggcggcagcaccuacuacaacagcgcccugaagagcagacugagcaucagcaaggacaacagcaagagccagguguuccugaagaacagccugcagaccgacgacaccgccuacuacugcgccaaggagaagagaagaggcuacuacuacgccgacuacuggggccagggcaccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggccgagcccaagagcugcgacaagacccacaccugcccccccugccccgcccccgagcugcugggcggccccagcguguuccuguucccccccaagcccaaggacacccugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugcacgaggcccugcacaaccacuacacccagaagagccugagccugagccccggcaag

SEQ ID NO: 31049 - RNA, 639 nt, Artificial Sequence
  derived and/or modified sequence opt4 from Iodine_(131I)_derlotuxiab_biotin_LightChain1
gagaacgugcugacccagagccccgccaucagcgccagccccggcgagaaggugaccaccugcagagccagcagcagcgugagcagcagcuaccugcacugguaccagcagaagagcggcgccagccccaagcuguggaucuacagcaccagcaaccuggccagcggcgugcccgccagauucagcggcagcggcagcggcaccagcuacagccugaccaucagcagcguggaggccgaggacgccgccaccuacuacugccagcaguacagcggcuacccccugaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31050 - RNA, 1350 nt, Artificial Sequence
  derived and/or modified sequence opt4 from Iodine_(131I)_Derlotuximab_biotin_HeavyChain1
caggugcagcugaaggagagcggccccggccugguggcccccagccagagccugagcaucaccugcaccgugagcggcuucagccugaccgacuacggcgugagauggaucagacagccccccggcaagggccuggaguggcugggcgugaucuggggcggcggcagcaccuacuacaacagcgcccugaagagcagacugagcaucagcaaggacaacagcaagagccagguguuccugaagaugaacagccugcagaccgacgacaccgccauguacuacugcgccaaggagaagagaagaggcuacuacuacgccauggacuacuggggccagggcaccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaaggccgagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31051 - RNA, 645 nt, Artificial Sequence
  derived and/or modified sequence opt4 from Iodine_(131I)_Derlotuximab_biotin_LightChain1
gagaacgugcugacccagagccccgccaucaugagcgccagccccggcgagaaggugaccaugaccugcagagccagcagcagcgugagcagcagcuaccugcacugguaccagcagaagagcggcgccagccccaagcuguggaucuacagcaccagcaaccuggccagcggcgugcccgccagauucagcggcagcggcagcggcaccagcuacagccugaccaucagcagcguggaggccgaggacgccgccaccuacuacugccagcaguacagcggcuacccccugaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31052 - RNA, 1344 nt, Artificial Sequence
  derived and/or modified sequence opt4 from Ipilimumab_HeavyChain
caggugcagcugguggagagcggcggcggcguggugcagcccggcagaagccugagacugagcugcgccgccagcggcuucaccuucagcagcuacaccaugcacugggugagacaggcccccggcaagggccuggagugggugaccuucaucagcuacgacggcaacaacaaguacuacgccgacagcgugaagggcagauucaccaucagcagagacaacagcaagaacacccuguaccugcagaugaacagccugagagccgaggacaccgccaucuacuacugcgccagaaccggcuggcugggccccuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31053 - RNA, 645 nt, Artificial Sequence
  derived and/or modified sequence opt4 from Ipilimumab_LightChain
gagaucgugcugacccagagccccggcacccugagccugagccccggcgagagagccacccugagcugcagagccagccagagcgugggcagcagcuaccuggccugguaccagcagaagcccggccaggcccccagacugcugaucuacggcgccuucagcagagccaccggcauccccgacagauucagcggcagcggcagcggcaccgacuucacccugaccaucagcagacuggagcccgaggacuucgccguguacuacugccagcaguacggcagcagccccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31054 - RNA, 186 nt, Artificial Sequence
  derived and/or modified sequence opt4 from Iratumumab_HeavyChain1
caggugcagcugcagcaguggggcgccggccugcugaagcccagcgagacccugagccugaccugcgccguguacggcggcagcuucagcgccuacuacuggagcuggaucagacagccccccggcaagggccuggaguggaucggcgacuacuggggccagggcagccuggugaccgugagcagc

SEQ ID NO: 31055 - RNA, 321 nt, Artificial Sequence
  derived and/or modified sequence opt4 from Iratumumab_LightChain1
gacauccagaugacccagagccccaccagccugagcgccagcgugggcgacagagugaccaucaccugcagagccagccagggcaucagcagcuggcugaccugguaccagcagaagcccgagaaggcccccaagagccugaucuacgccgccagcagccugcagagcggcgugcccagcagauucagcggcagcggcagcggcaccgacuucacccugaccaucagcagccugcagcccgaggacuucgccaccuacuacugccagcaguacgacagcuaccccaucaccuucggccagggcaccagacuggagaucaag

SEQ ID NO: 31056 - RNA, 1350 nt, Artificial Sequence
  derived and/or modified sequence opt4 from Isatuximab_HeavyChain1
caggugcagcuggugcagagcggcgccgagguggccaagcccggcaccagcgugaagcugagcugcaaggccagcggcuacaccuucaccgacuacuggaugcagugggugaagcagagacccggccagggccuggaguggaucggcaccaucuaccccggcgacggcgacaccggcuacgcccagaaguuccagggcaaggccacccugaccgccgacaagagcagcaagaccguguacaugcaccugagcagccuggccagcgaggacagcgccguguacuacugcgccagaggcgacuacuacggcagcaacagccuggacuacuggggccagggcaccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31057 - RNA, 642 nt, Artificial Sequence
  derived and/or modified sequence opt4 from Isatuximab_LightChain1
gacaucgugaugacccagagccaccugagcaugagcaccagccugggcgaccccgugagcaucaccugcaaggccagccaggacgugagcaccgugguggccugguaccagcagaagcccggccagagccccagaagacugaucuacagcgccagcuacagauacaucggcgugcccgacagauucaccggcagcggcgccggcaccgacuucaccuucaccaucagcagcgugcaggccgaggaccuggccguguacuacugccagcagcacuacagcccccccuacaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31058 - RNA, 1347 nt, Artificial Sequence
  derived and/or modified sequence opt4 from Itolizumab_HeavyChain1
gaggugcagcugguggagagcggcggcggccuggugaagcccggcggcagccugaagcugagcugcgccgccagcggcuucaaguucagcagauacgccaugagcugggugagacaggcccccggcaagagacuggaguggguggccaccaucagcagcggcggcagcuacaucuacuaccccgacagcgugaagggcagauucaccaucagcagagacaacgugaagaacacccuguaccugcagaugagcagccugagaagcgaggacaccgccauguacuacugcgccagaagagacuacgaccuggacuacuucgacagcuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31059 - RNA, 642 nt, Artificial Sequence
  derived and/or modified sequence opt4 from Itolizumab_LightChain1
gacauccagaugacccagagccccagcagccugagcgccagcgugggcgacagagugaccaucaccugcaaggccagcagagacaucagaagcuaccugaccugguaccagcagaagcccggcaaggcccccaagacccugaucuacuacgccaccagccuggccgacggcgugcccagcagauucagcggcagcggcagcggccaggacuacagccugaccaucagcagccuggagagcgacgacaccgccaccuacuacugccugcagcacggcgagagccccuucacccugggcagcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31060 - RNA, 1335 nt, Artificial Sequence
  derived and/or modified sequence opt4 from Ixekizumab_HeavyChain1
caggugcagcuggugcagagcggcgccgaggugaagaagcccggcagcagcgugaaggugagcugcaaggccagcggcuacagcuucaccgacuaccacauccacugggugagacaggcccccggccagggccuggaguggaugggcgugaucaaccccauguacggcaccaccgacuacaaccagagauucaagggcagagugaccaucaccgccgacgagagcaccagcaccgccuacauggagcugagcagccugagaagcgaggacaccgccguguacuacugcgccagauacgacuacuucaccggcaccggcguguacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggc

SEQ ID NO: 31061 - RNA, 657 nt, Artificial Sequence
  derived and/or modified sequence opt4 from Ixekizumab_LightChain1
gacaucgugaugacccagaccccccugagccugagcgugacccccggccagcccgccagcaucagcugcagaagcagcagaagccuggugcacagcagaggcaacaccuaccugcacugguaccugcagaagcccggccagagcccccagcugcugaucuacaaggugagcaacagauucaucggcgugcccgacagauucagcggcagcggcagcggcaccgacuucacccugaagaucagcagaguggaggccgaggacgugggcguguacuacugcagccagagcacccaccugcccuucaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31062 - RNA, 1347 nt, Artificial Sequence
  derived and/or modified sequence opt4 from Labetuzumab_govitecan_HeavyChain1
gaggugcagcugguggagagcggcggcggcguggugcagcccggcagaagccugagacugagcugcagcgccagcggcuucgacuucaccaccuacuggaugagcugggugagacaggcccccggcaagggccuggaguggaucggcgagauccaccccgacagcagcaccaucaacuacgcccccagccugaaggacagauucaccaucagcagagacaacgccaagaacacccuguuccugcagauggacagccugagacccgaggacaccggcguguacuucugcgccagccuguacuucggcuuccccugguucgccuacuggggccagggcacccccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31063 - RNA, 639 nt, Artificial Sequence
  derived and/or modified sequence opt4 from Labetuzumab_govitecan_LightChain1
gacauccagcugacccagagccccagcagccugagcgccagcgugggcgacagagugaccaucaccugcaaggccagccaggacgugggcaccagcguggccugguaccagcagaagcccggcaaggcccccaagcugcugaucuacuggaccagcaccagacacaccggcgugcccagcagauucagcggcagcggcagcggcaccgacuucaccuucaccaucagcagccugcagcccgaggacaucgccaccuacuacugccagcaguacagccuguacagaagcuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31064 - RNA, 1341 nt, Artificial Sequence
  derived and/or modified sequence opt4 from Lambrolizumab_HeavyChain1
caggugcagcuggugcagagcggcguggaggugaagaagcccggcgccagcgugaaggugagcugcaaggccagcggcuacaccuucaccaacuacuacauguacugggugagacaggcccccggccagggccuggaguggaugggcggcaucaaccccagcaacggcggcaccaacuucaacgagaaguucaagaacagagugacccugaccaccgacagcagcaccaccaccgccuacauggagcugaagagccugcaguucgacgacaccgccguguacuacugcgccagaagagacuacagauucgacaugggcuucgacuacuggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31065 - RNA, 654 nt, Artificial Sequence
  derived and/or modified sequence opt4 from Lambrolizumab_LightChain1
gagaucgugcugacccagagccccgccacccugagccugagccccggcgagagagccacccugagcugcagagccagcaagggcgugagcaccagcggcuacagcuaccugcacugguaccagcagaagcccggccaggcccccagacugcugaucuaccuggccagcuaccuggagagcggcgugcccgccagauucagcggcagcggcagcggcaccgacuucacccugaccaucagcagccuggagcccgaggacuucgccguguacuacugccagcacagcagagaccugccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31066 - RNA, 669 nt, Artificial Sequence
  derived and/or modified sequence opt4 from Lampalizumab_HeavyChain1
gaggugcagcuggugcagagcggccccgagcugaagaagcccggcgccagcgugaaggugagcugcaaggccagcggcuacaccuucaccaacuacggcaugaacugggugagacaggcccccggccagggccuggaguggaugggcuggaucaacaccuacaccggcgagaccaccuacgccgacgacuucaagggcagauucguguucagccuggacaccagcgugagcaccgccuaccugcagaucagcagccugaaggccgaggacaccgccguguacuacugcgagagagagggcggcgugaacaacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacacc

SEQ ID NO: 31067 - RNA, 642 nt, Artificial Sequence
  derived and/or modified sequence opt4 from Lampalizumab_LightChain1
gacauccaggugacccagagccccagcagccugagcgccagcgugggcgacagagugaccaucaccugcaucaccagcaccgacaucgacgacgacaugaacugguaccagcagaagcccggcaaggugcccaagcugcugaucagcggcggcaacacccugagacccggcgugcccagcagauucagcggcagcggcagcggcaccgacuucacccugaccaucagcagccugcagcccgaggacguggccaccuacuacugccugcagagcgacagccugcccuacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31068 - RNA, 1353 nt, Artificial Sequence
  derived and/or modified sequence opt4 from Lanadelumab_HeavyChain1
gaggugcagcugcuggagagcggcggcggccuggugcagcccggcggcagccugagacugagcugcgccgccagcggcuucaccuucagccacuacaucaugaugugggugagacaggcccccggcaagggccuggagugggugagcggcaucuacagcagcggcggcaucaccguguacgccgacagcgugaagggcagauucaccaucagcagagacaacagcaagaacacccuguaccugcagaugaacagccugagagccgaggacaccgccguguacuacugcgccuacagaagaaucggcgugcccagaagagacgaguucgacaucuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31069 - RNA, 639 nt, Artificial Sequence
  derived and/or modified sequence opt4 from Lanadelumab_LightChain1
gacauccagaugacccagagccccagcacccugagcgccagcgugggcgacagagugaccaucaccugcagagccagccagagcaucagcagcuggcuggccugguaccagcagaagcccggcaaggcccccaagcugcugaucuacaaggccagcacccuggagagcggcgugcccagcagauucagcggcagcggcagcggcaccgaguucacccugaccaucagcagccugcagcccgacgacuucgccaccuacuacugccagcaguacaacaccuacuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31070 - RNA, 1317 nt, Artificial Sequence
  derived and/or modified sequence opt4 from Landogrozumab_HeavyChain1
gaggugcagcugguggagagcggcggcggccuggugcagcccggcggcagccugagacugagcugcgccgccagcggccugaccuucagcagauaccccaugagcugggugagacaggcccccggcaagggccuggugugggugagcgccaucaccagcagcggcggcagcaccuacuacagcgacaccgugaagggcagauucaccaucagcagagacaacgccaagaacacccuguaccugcagaugaacagccugagagccgaggacaccgccguguacuacugcgccagacugcccgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggc

SEQ ID NO: 31071 - RNA, 645 nt, Artificial Sequence
  derived and/or modified sequence opt4 from Landogrozumab_LightChain1
gagaucgugcugacccagagccccggcacccugagccugagccccggcgagagagccacccugagcugcagagccagcagcagcgugagcagcagcuaccugcacugguaccagcagaagcccggccaggcccccagacugcugaucuacagcaccagcaaccugguggccggcauccccgacagauucagcggcagcggcagcggcaccgacuucacccugaccaucagcagacuggagcccgaggacuucgccguguacuacugccagcaccacagcggcuaccacuucaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31072 - RNA, 1344 nt, Artificial Sequence
  derived and/or modified sequence opt4 from Laprituximab_emtansine_HeavyChain1
caggugcagcuggugcagagcggcgccgagguggccaagcccggcgccagcgugaagcugagcugcaaggccagcggcuacaccuucaccagcuacuggaugcagugggugaagcagagacccggccagggccuggagugcaucggcaccaucuaccccggcgacggcgacaccaccuacacccagaaguuccagggcaaggccacccugaccgccgacaagagcagcagcaccgccuacaugcagcugagcagccugagaagcgaggacagcgccguguacuacugcgccagauacgacgcccccggcuacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31073 - RNA, 642 nt, Artificial Sequence
  derived and/or modified sequence opt4 from Laprituximab_emtansine_LightChain1
gacauccagaugacccagagccccagcagccugagcgccagcgugggcgacagagugaccaucaccugcagagccagccaggacaucaacaacuaccuggccugguaccagcacaagcccggcaagggccccaagcugcugauccacuacaccagcacccugcaccccggcauccccagcagauucagcggcagcggcagcggcagagacuacagcuucagcaucagcagccuggagcccgaggacaucgccaccuacuacugccugcaguacgacaaccugcuguacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31074 - RNA, 1314 nt, Artificial Sequence
  derived and/or modified sequence opt4 from Lealesoab_HeavyChain1
caggugcagcugcaggagagcggccccgagcugaagaagcccggcgagaccgugaagaucagcugcaaggccagcggcuacaccuucagaaacuacggcaacugggugaagcaggcccccggcaagggccugaaguggggcuggaucaacaccuacaccggcgagcccaccuacgccgacgacuucaagggcagauucgccuucagccuggagaccagcgccagcaccgccuaccugcagaucaacaacgugaagaacgaggacaccgccaccuacuucugcgccagaaagggcugggacuucaacggcagcagccuggacuacuggggccagggcaccaccgugaccgugagcagcgccaagaccaccccccccagcguguacccccuggcccccggcagcgccgcccagaccaacagcgugacccugggcugccuggugaagggcuacuuccccgagcccgugaccgugaccuggaacagcggcagccugagcagcggcgugcacaccuuccccgccgugcugcagagcgaccuguacacccugagcagcagcgugaccgugcccagcagccccagacccagcgagaccgugaccugcaacguggcccaccccgccagcagcaccaagguggacaagaagaucgugcccagagacugcggcugcaagcccugcaucugcaccgugcccgaggugagcagcguguucaucuucccccccaagcccaaggacgugcugaccaucacccugacccccaaggugaccugcguggugguggacaucagcaaggacgaccccgaggugcaguucagcugguucguggacgacguggaggugcacaccgcccagacccagcccagagaggagcaguucaacagcaccuucagaagcgugagcgagcugcccauccaccaggacuggcugaacggcaaggaguucaagugcagagugaacagcgccgccuuccccgcccccaucgagaagaccaucagcaagaccaagggcagacccaaggccccccagguguacaccauccccccccccaaggagcaggccaaggacaaggugagccugaccugcaucaccgacuucuuccccgaggacaucaccguggaguggcaguggaacggccagcccgccgagaacuacaagaacacccagcccaucaacaccaacggcagcuacuucguguacagcaagcugaacgugcagaagagcaacugggaggccggcaacaccuucaccugcagcgugcugcacgagggccugcacaaccaccacaccgagaagagccugagccacagccccggcaag

SEQ ID NO: 31075 - RNA, 654 nt, Artificial Sequence
  derived and/or modified sequence opt4 from Lealesoab_LightChain1
gacauccagcugacccagaccccccugagccugcccgugagccugggcgaccaggccagcaucagcugcagaagcagccagagcaucgugcacagcaacggcaacaccuaccuggagugguaccugcagaagcccggccagagccccaaccugcugaucuacaaggugagcaacagauucagcggcgugcccgacagauucagcggcagcggcagcggcaccgacuucacccugaagaucagcagaguggaggccgaggaccugggcguguacuacugcuuccagggcagccacgugccccccaccuucggcggcggcaccaagcuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcagcagcacccugacccugaccaaggacgaguacgagagacacaacagcuacaccugcgaggccacccacaagaccagcaccagccccaucgugaagagcuucaacagaaacgagugc

SEQ ID NO: 31076 - RNA, 1335 nt, Artificial Sequence
  derived and/or modified sequence opt4 from Lebrikizumab_HeavyChain1
caggugacccugagagagagcggccccgcccuggugaagcccacccagacccugacccugaccugcaccgugagcggcuucagccugagcgccuacagcgugaacuggaucagacagccccccggcaaggcccuggaguggcuggccaugaucuggggcgacggcaagaucguguacaacagcgcccugaagagcagacugaccaucagcaaggacaccagcaagaaccagguggugcugaccaugaccaacauggaccccguggacaccgccaccuacuacugcgccggcgacggcuacuaccccuacgccauggacaacuggggccagggcagccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31077 - RNA, 654 nt, Artificial Sequence
  derived and/or modified sequence opt4 from Lebrikizumab_LightChain1
gacaucgugaugacccagagccccgacagccugagcgugagccugggcgagagagccaccaucaacugcagagccagcaagagcguggacagcuacggcaacagcuucaugcacugguaccagcagaagcccggccagccccccaagcugcugaucuaccuggccagcaaccuggagagcggcgugcccgacagauucagcggcagcggcagcggcaccgacuucacccugaccaucagcagccugcaggccgaggacguggccguguacuacugccagcagaacaacgaggaccccagaaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31078 - RNA, 1227 nt, Artificial Sequence
  derived and/or modified sequence opt4 from Lenercept_chain1
cuggugccccaccugggcgacagagagaagagagacagcgugugcccccagggcaaguacauccacccccagaacaacagcaucugcugcaccaagugccacaagggcaccuaccuguacaacgacugccccggccccggccaggacaccgacugcagagagugcgagagcggcagcuucaccgccagcgagaaccaccugagacacugccugagcugcagcaagugcagaaaggagaugggccagguggagaucagcagcugcaccguggacagagacaccgugugcggcugcagaaagaaccaguacagacacuacuggagcgagaaccuguuccagugcuucaacugcagccugugccugaacggcaccgugcaccugagcugccaggagaagcagaacaccgugugcaccugccacgccggcuucuuccugagagagaacgagugcgugagcugcagcaacugcaagaagagccuggagugcaccaagcugugccugccccagaucgagaacgugaagggcaccgaggacagcggcaccaccgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31079 - RNA, 1347 nt, Artificial Sequence
  derived and/or modified sequence opt4 from Lenzilumab_HeavyChain1
caggugcagcuggugcagagcggcgccgaggugaagaagcccggcgccagcgugaaggugagcugcaaggccagcggcuacagcuucaccaacuacuacauccacugggugagacaggcccccggccagagacuggaguggaugggcuggaucaacgccggcaacggcaacaccaaguacagccagaaguuccagggcagagugaccaucaccagagacaccagcgccagcaccgccuacauggagcugagcagccugagaagcgaggacaccgccguguacuacugcgugagaagacagagauuccccuacuacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31080 - RNA, 642 nt, Artificial Sequence
  derived and/or modified sequence opt4 from Lenzilumab_LightChain1
gagaucgugcugacccagagccccgccacccugagcgugagccccggcgagagagccacccugagcugcagagccagccagagcgugggcaccaacguggccugguaccagcagaagcccggccaggcccccagagugcugaucuacagcaccagcagcagagccaccggcaucaccgacagauucagcggcagcggcagcggcaccgacuucacccugaccaucagcagacuggagcccgaggacuucgccguguacuacugccagcaguucaacaagagcccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31081 - RNA, 1326 nt, Artificial Sequence
  derived and/or modified sequence opt4 from Lerdelimumab_HeavyChain1
gaggugcagcugguggagagcggcggcggcguggugcagcccggcagaagccugagacugagcugcgccgccagcggcuucaccuucagcagcuacggcaugcacugggugagacaggcccccggcaagggccuggaguggguggccgugaucugguacgacggcagcaacaaguacuacgccgacagcgugaagggcagauucaccaucagcagagacaacagcaagaacacccuguaccugcagauggacagccugagagccgaggacaccgccguguacuacugcggcagaacccuggagagcagccuguggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugccccagcugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31082 - RNA, 645 nt, Artificial Sequence
  derived and/or modified sequence opt4 from Lerdelimumab_LightChain1
agcagcgagcugacccaggaccccgccgugagcguggcccugggccagaccgugagaaucaccugccagggcgacagccugagaagcuacuacgccagcugguaccagcagaagcccggccaggcccccgugcuggugaucuacggcaagaacaacagacccagcggcauccccgacagauucagcggcagcagcagcggcaacaccgccagccugaccaucaccggcgcccaggccgaggacgaggccgacuacuacugcaacagcagagacagcagcagcacccacagaggcguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31083 - RNA, 1353 nt, Artificial Sequence
  derived and/or modified sequence opt4 from Lexatumumab_HeavyChain1
gaggugcagcuggugcagagcggcggcggcguggagagacccggcggcagccugagacugagcugcgccgccagcggcuucaccuucgacgacuacggcaugagcugggugagacaggcccccggcaagggccuggagugggugagcggcaucaacuggaacggcggcagcaccggcuacgccgacagcgugaagggcagagugaccaucagcagagacaacgccaagaacagccuguaccugcagaugaacagccugagagccgaggacaccgccguguacuacugcgccaagauccugggcgccggcagaggcugguacuucgaccuguggggcaagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31084 - RNA, 1353 nt, Artificial Sequence; identical to SEQ ID NO: 31083
  derived and/or modified sequence opt4 from Lexatumumab_HeavyChain

SEQ ID NO: 31085 - RNA, 642 nt, Artificial Sequence
  derived and/or modified sequence opt4 from Lexatumumab_LightChain1
agcagcgagcugacccaggaccccgccgugagcguggcccugggccagaccgugagaaucaccugccagggcgacagccugagaagcuacuacgccagcugguaccagcagaagcccggccaggcccccgugcuggugaucuacggcaagaacaacagacccagcggcauccccgacagauucagcggcagcagcagcggcaacaccgccagccugaccaucaccggcgcccaggccgaggacgaggccgacuacuacugcaacagcagagacagcagcggcaaccacgugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31086 - RNA, 642 nt, Artificial Sequence; identical to SEQ ID NO: 31085
  derived and/or modified sequence opt4 from Lexatumumab_LightChain

SEQ ID NO: 31087 - RNA, 1377 nt, Artificial Sequence
  derived and/or modified sequence opt4 from Libivirumab_HeavyChain1
caggugcagcugguggagagcggcggcggcguggugagacccggcagaagccugagacugagcugcgccgccagcggcuucgccuucagcgacuacagcaucaacugggugagacaggcccccggcaagggccuggaguggguggccaucaucagcuacgacggcagaaucaccuacuacagagacagcgugaagggcagauucaccaucagcagagacgacagcaagaacacccuguaccugcagaugaacagccugagaaccgaggacaccgccguguacuacugcgccagacaguacuacgacuucuggagcggcagcagcgugggcagaaacuacgacggcauggacguguggggccugggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31088 - RNA, 657 nt, Artificial Sequence
  derived and/or modified sequence opt4 from Libivirumab_LightChain1
gacaucgugaugacccagagcccccugagccugagcgugacccccggcgagcccgccagcaucagcugcagaagcagccagagccugcugcacagaagcggcaacaacuaccuggacugguaccugcagaagcccggccacagcccccagcugcugaucuacgugggcagcaacagagccagcggcgugcccgacagauucagcggcagcggcagcggcaccgaguacacccugaagaucagcagaguggaggccgaggacgugggcguguacuacugcaugcaggcccugcagacccccagaaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31089 - RNA, 1350 nt, Artificial Sequence
  derived and/or modified sequence opt4 from Lifastuzumab_HeavyChain
gaggugcagcugguggagagcggcggcggccuggugcagcccggcggcagccugagacugagcugcgccgccagcggcuucagcuucagcgacuucgccaugagcugggugagacaggcccccggcaagggccuggaguggguggccaccaucggcagaguggccuuccacaccuacuaccccgacagcaugaagggcagauucaccaucagcagagacaacagcaagaacacccuguaccugcagaugaacagccugagagccgaggacaccgccguguacuacugcgccagacacagaggcuucgacgugggccacuucgacuucuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31090 - RNA, 657 nt, Artificial Sequence
  derived and/or modified sequence opt4 from Lifastuzumab_LightChain
gacauccagaugacccagagccccagcagccugagcgccagcgugggcgacagagugaccaucaccugcagaagcagcgagacccuggugcacagcagcggcaacaccuaccuggagugguaccagcagaagcccggcaaggcccccaagcugcugaucuacagagugagcaacagauucagcggcgugcccagcagauucagcggcagcggcagcggcaccgacuucacccugaccaucagcagccugcagcccgaggacuucgccaccuacuacugcuuccagggcagcuucaacccccugaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31091 - RNA, 1347 nt, Artificial Sequence
  derived and/or modified sequence opt4 from Lifastuzumab_vedotin_HeavyChain1
gugcagcugguggagagcggcggcggccuggugcagcccggcggcagccugagacugagcugcgccgccagcggcuucagcuucagcgacuucgccaugagcugggugagacaggcccccggcaagggccuggaguggguggccaccaucggcagaguggccuuccacaccuacuaccccgacagcaugaagggcagauucaccaucagcagagacaacagcaagaacacccuguaccugcagaugaacagccugagagccgaggacaccgccguguacuacugcgccagacacagaggcuucgacgugggccacuucgacuucuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31092 - RNA, 657 nt, Artificial Sequence; identical to SEQ ID NO: 31090
  derived and/or modified sequence opt4 from Lifastuzumab_vedotin_LightChain1

SEQ ID NO: 31093 - RNA, 1359 nt, Artificial Sequence
  derived and/or modified sequence opt4 from Ligelizumab_HeavyChain1
caggugcagcuggugcagagcggcgccgaggugaugaagcccggcagcagcgugaaggugagcugcaaggccagcggcuacaccuucagcugguacuggcuggagugggugagacaggcccccggccacggccuggaguggaugggcgagaucgaccccggcaccuucaccaccaacuacaacgagaaguucaaggccagagugaccuucaccgccgacaccagcaccagcaccgccuacauggagcugagcagccugagaagcgaggacaccgccguguacuacugcgccagauucagccacuucagcggcagcaacuacgacuacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31094 - RNA, 642 nt, Artificial Sequence
  derived and/or modified sequence opt4 from Ligelizumab_LightChain1
gagaucgugaugacccagagccccgccacccugagcgugagccccggcgagagagccacccugagcugcagagccagccagagcaucggcaccaacauccacugguaccagcagaagcccggccaggcccccagacugcugaucuacuacgccagcgagagcaucagcggcauccccgccagauucagcggcagcggcagcggcaccgaguucacccugaccaucagcagccugcagagcgaggacuucgccguguacuacugccagcagagcuggagcuggcccaccaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31095 - RNA, 1329 nt, Artificial Sequence; identical to SEQ ID NO: 30643
  derived and/or modified sequence opt4 from Lilotomab_HeavyChain1

SEQ ID NO: 31096 - RNA, 642 nt, Artificial Sequence; identical to SEQ ID NO: 30644
  derived and/or modified sequence opt4 from Lilotomab_LightChain1

SEQ ID NO: 31097 - RNA, 1338 nt, Artificial Sequence
  derived and/or modified sequence opt4 from Lintuzumab_HeavyChain1
caggugcagcuggugcagagcggcgccgaggugaagaagcccggcagcagcgugaaggugagcugcaaggccagcggcuacaccuucaccgacuacaacaugcacugggugagacaggcccccggccagggccuggaguggaucggcuacaucuaccccuacaacggcggcaccggcuacaaccagaaguucaagagcaaggccaccaucaccgccgacgagagcaccaacaccgccuacauggagcugagcagccugagaagcgaggacaccgccguguacuacugcgccagaggcagacccgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31098 - RNA, 654 nt, Artificial Sequence
  derived and/or modified sequence opt4 from Lintuzumab_LightChain1
gacauccagaugacccagagccccagcagccugagcgccagcgugggcgacagagugaccaucaccugcagagccagcgagagcguggacaacuacggcaucagcuucaugaacugguuccagcagaagcccggcaaggcccccaagcugcugaucuacgccgccagcaaccagggcagcggcgugcccagcagauucagcggcagcggcagcggcaccgacuucacccugaccaucagcagccugcagcccgacgacuucgccaccuacuacugccagcagagcaaggaggugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31099 - RNA, 1350 nt, Artificial Sequence
  derived and/or modified sequence opt4 from Lirilumab_HeavyChain1
caggugcagcuggugcagagcggcgccgaggugaagaagcccggcagcagcgugaaggugagcugcaaggccagcggcggcaccuucagcuucuacgccaucagcugggugagacaggcccccggccagggccuggaguggaugggcggcuucauccccaucuucggcgccgccaacuacgcccagaaguuccagggcagagugaccaucaccgccgacgagagcaccagcaccgccuacauggagcugagcagccugagaagcgacgacaccgccguguacuacugcgccagaauccccagcggcagcuacuacuacgacuacgacauggacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31100 - RNA, 642 nt, Artificial Sequence
  derived and/or modified sequence opt4 from Lirilumab_LightChain1
gagaucgugcugacccagagccccgugacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggauguacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31101 - RNA, 1344 nt, Artificial Sequence
  derived and/or modified sequence opt4 from Lodelcizumab_HeavyChain1
caggugcagcuggugcagagcggcgccgaggugaagaagcccggcgccagcgugaaggugagcugcaaggccagcggcuacaccuucagcaccauguacaugagcugggugagacaggcccccggccagggccuggaguggaugggcagaaucgaccccgccaacgagcacaccaacuacgcccagaaguuccagggcagagugaccaugaccagagacaccagcaucagcaccgccuacauggagcugagcagacugaccagcgacgacaccgccguguacuacugcgccagaagcuacuacuacuacaacauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgaggccgccggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31102 - RNA, 639 nt, Artificial Sequence
  derived and/or modified sequence opt4 from Lodelcizumab_LightChain1
cagaucgugcugacccagagccccgccacccugagcgugagccccggcgagagagccacccugagcugcagagccagccagagcgugagcuacaugcacugguaccagcagaagcccggccaggcccccagacugcugaucuacggcguguucagaagagccaccggcauccccgacagauucagcggcagcggcagcggcaccgacuucacccugaccaucggcagacuggagcccgaggacuucgccguguacuacugccugcaguggagcagcgacccccccaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31103 - RNA, 1356 nt, Artificial Sequence
  derived and/or modified sequence opt4 from Lokivetmab_HeavyChain1
gaggugcagcugguggagagcggcggcgaccuggugaagcccggcggcagccugagacugagcugcguggccagcggcuucaccuucagcaacuacggcaugagcugggugagacaggcccccggcaagggccugcaguggguggccaccaucagcuacggcggcagcuacaccuacuaccccgacaacaucaagggcagauucaccaucagcagagacaacgccaagaacacccuguaccugcagaugaacagccugagagccgaggacaccgccauguacuacugcgugagaggcuacggcuacgacaccauggacuacuggggccagggcacccuggugaccgugagcagcgccagcaccaccgcccccagcguguucccccuggcccccagcugcggcagcaccagcggcagcaccguggcccuggccugccuggugagcggcuacuuccccgagcccgugaccgugagcuggaacagcggcagccugaccagcggcgugcacaccuuccccagcgugcugcagagcagcggccuguacagccugagcagcauggugaccgugcccagcagcagauggcccagcgagaccuucaccugcaacguggcccaccccgccagcaagaccaagguggacaagcccgugcccaagagagagaacggcagagugcccagaccccccgacugccccaagugccccgcccccgagaugcugggcggccccagcguguucaucuucccccccaagcccaaggacacccugcugaucgccagaacccccgaggugaccugcguggugguggaccuggaccccgaggaccccgaggugcagaucagcugguucguggacggcaagcagaugcagaccgccaagacccagcccagagaggagcaguucaacggcaccuacagaguggugagcgugcugcccaucggccaccaggacuggcugaagggcaagcaguucaccugcaaggugaacaacaaggcccugcccagccccaucgagagaaccaucagcaaggccagaggccaggcccaccagcccagcguguacgugcugccccccagcagagaggagcugagcaagaacaccgugagccugaccugccugaucaaggacuucuucccccccgacaucgacguggaguggcagagcaacggccagcaggagcccgagagcaaguacagaaccacccccccccagcuggacgaggacggcagcuacuuccuguacagcaagcugagcguggacaagagcagauggcagagaggcgacaccuucaucugcgccgugaugcacgaggcccugcacaaccacuacacccaggagagccugagccacagccccggc

SEQ ID NO: 31104 - RNA, 651 nt, Artificial Sequence
  derived and/or modified sequence opt4 from Lokivetmab_LightChain1
gagaucgugaugacccagagccccgccagccugagccugagccaggaggagaaggugaccaucaccugcaaggccagccagagcgugagcuucgccggcaccggccugaugcacugguaccagcagaagcccggccaggcccccaagcugcugaucuacagagccagcaaccuggaggccggcgugcccagcagauucagcggcagcggcagcggcaccgacuucagcuucaccaucagcagccuggagcccgaggacguggccguguacuacugccagcagagcagagaguaccccuggaccuucggccagggcaccaagcuggagaucaagagaaacgacgcccagcccgccguguaccuguuccagcccagccccgaccagcugcacaccggcagcgccagcguggugugccugcugaacagcuucuaccccaaggacaucaacgugaaguggaagguggacggcgugauccaggacaccggcauccaggagagcgugaccgagcaggacaaggacagcaccuacagccugagcagcacccugaccaugagcagcaccgaguaccugagccacgagcuguacagcugcgagaucacccacaagagccugcccagcacccugaucaagagcuuccagagaagcgagugc

SEQ ID NO: 31105 - RNA, 1344 nt, Artificial Sequence
  derived and/or modified sequence opt4 from Lorvotuzumab_mertansine_HeavyChain1
caggugcagcugguggagagcggcggcggcguggugcagcccggcagaagccugagacugagcugcgccgccagcggcuucaccuucagcagcuucggcaugcacugggugagacaggcccccggcaagggccuggaguggguggccuacaucagcagcggcagcuucaccaucuacuacgccgacagcgugaagggcagauucaccaucagcagagacaacagcaagaacacccuguaccugcagaugaacagccugagagccgaggacaccgccguguacuacugcgccagaaugagaaagggcuacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31106 - RNA, 657 nt, Artificial Sequence
  derived and/or modified sequence opt4 from Lorvotuzumab_mertansine_LightChain1
gacguggugaugacccagagcccccugagccugcccgugacccugggccagcccgccagcaucagcugcagaagcagccagaucaucauccacagcgacggcaacaccuaccuggagugguuccagcagagacccggccagagccccagaagacugaucuacaaggugagcaacagauucagcggcgugcccgacagauucagcggcagcggcagcggcaccgacuucacccugaagaucagcagaguggaggccgaggacgugggcguguacuacugcuuccagggcagccacgugccccacaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31107 - RNA, 336 nt, Artificial Sequence
  derived and/or modified sequence opt4 from Lpathomab_VL
gacguggugaugacccagaccccccugagccugcccgugagccugggcgaccaggccagcaucagcugcaccagcggccagagccuggugcacaucaacggcaacaccuaccugcacugguaccugcagaagcccggccagagccccaagcugcugaucuacaaggugagcaaccuguucagcggcgugcccgacagauucagcggcagcggcagcggcaccgacuucacccugaagaucagcagaguggaggccgaggaccugggcguguacuucugcagccagagcacccacuuccccuucaccuucggcaccggcaccaagcuggagaucaag

SEQ ID NO: 31108 - RNA, 366 nt, Artificial Sequence
  derived and/or modified sequence opt4 from Lpathomab_gamma1-Chain_VDJ-Region
caggugcagcugcagcagagcggcgccgagcuggugagacccggcaccagcgugaaggugagcugcaaggccagcggcuacggcuucaucaacuaccugaucgaguggaucaagcagagacccggccagggccuggaguggaucggccugaucaaccccggcagcgacuacaccaacuacaacgagaacuucaagggcaaggccacccugaccgccgacaagagcagcagcaccgccuacaugcaccugagcagccugaccagcgaggacagcgccguguacuucugcgccagaagauucggcuacuacggcagcggcaacuacuucgacuacuggggccagggcaccacccugaccgugagcagc

SEQ ID NO: 31109 - RNA, 1350 nt, Artificial Sequence
  derived and/or modified sequence opt4 from Lucatumumab_HeavyChain1
caggugcagcugguggagagcggcggcggcguggugcagcccggcagaagccugagacugagcugcgccgccagcggcuucaccuucagcagcuacggcaugcacugggugagacaggcccccggcaagggccuggaguggguggccgugaucagcuacgaggagagcaacagauaccacgccgacagcgugaagggcagauucaccaucagcagagacaacagcaagaucacccuguaccugcagaugaacagccugagaaccgaggacaccgccguguacuacugcgccagagacggcggcaucgccgcccccggccccgacuacuggggccagggcacccuggugaccgugagcagcgccagcaccaagggccccagcguguucccccuggcccccgccagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31110 - RNA, 657 nt, Artificial Sequence
  derived and/or modified sequence opt4 from Lucatumumab_LightChain1
gacaucgugaugacccagagcccccugagccugaccgugacccccggcgagcccgccagcaucagcugcagaagcagccagagccugcuguacagcaacggcuacaacuaccuggacugguaccugcagaagcccggccagagcccccaggugcugaucagccugggcagcaacagagccagcggcgugcccgacagauucagcggcagcggcagcggcaccgacuucacccugaagaucagcagaguggaggccgaggacgugggcguguacuacugcaugcaggccagacagacccccuucaccuucggccccggcaccaagguggacaucagaagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31111 - RNA, 324 nt, Artificial Sequence
  derived and/or modified sequence opt4 from Lulizumab_pegol_LightChain1
gacauccagaugacccagagccccagcagccugagcgccagcgugggcgacagagugaccaucaccugcagagccagcagacccaucuggcccuuccuggagugguaccagcagaagcccggcaaggcccccaagcugcugaucuacuucaccagcagacugagacacggcgugcccagcagauucagcggcagcggcagcggcaccugcuucacccugaccaucagcagccugcagcccgaggacuucgccaccuacuacugccugcagaacguggccaaccccgccaccuucagccagggcaccaagguggagaucaagaga

SEQ ID NO: 31112 - RNA, 324 nt, Artificial Sequence; identical to SEQ ID NO: 31111
  derived and/or modified sequence opt4 from Lulizumab_pegol_LightChain

SEQ ID NO: 31113 - RNA, 1194 nt, Artificial Sequence
  derived and/or modified sequence opt4 from Lumiliximab_HeavyChain1
gaggugcagcugguggagagcggcggcggccuggccaagcccggcggcagccugagacugagcugcgccgccagcggcuucagauucaccuucaacaacuacuacauggacugggugagacaggcccccggccagggccuggagugggugcugaccaccggcagcgacagcuggggccagggcgugcuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31114 - RNA, 642 nt, Artificial Sequence
  derived and/or modified sequence opt4 from Lumiliximab_LightChain1
gacauccagaugacccagagccccagcagccugagcgccagcgugggcgacagagugaccaucaccugcagagccagccaggacaucagauacuaccugaacugguaccagcagaagcccggcaaggcccccaagcugcugaucuacguggccagcagccugcagagcggcgugcccagcagauucagcggcagcggcagcggcaccgaguucacccugaccgugagcagccugcagcccgaggacuucgccaccuacuacugccugcagguguacagcacccccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31115 - RNA, 1347 nt, Artificial Sequence
  derived and/or modified sequence opt4 from Lumretuzumab_HeavyChain1
caggugcagcuggugcagagcggcgccgaggugaagaagcccggcgccagcgugaaggugagcugcaaggccagcggcuacaccuucagaagcagcuacaucagcugggugagacaggcccccggccagggccuggaguggaugggcuggaucuacgccggcaccggcagccccagcuacaaccagaagcugcagggcagagugaccaugaccaccgacaccagcaccagcaccgccuacauggagcugagaagccugagaagcgacgacaccgccguguacuacugcgccagacacagagacuacuacagcaacagccugaccuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31116 - RNA, 660 nt, Artificial Sequence
  derived and/or modified sequence opt4 from Lumretuzumab_LightChain1
gacaucgugaugacccagagccccgacagccuggccgugagccugggcgagagagccaccaucaacugcaagagcagccagagcgugcugaacagcggcaaccagaagaacuaccugaccugguaccagcagaagcccggccagccccccaagcugcugaucuacugggccagcaccagagagagcggcgugcccgacagauucagcggcagcggcagcggcaccgacuucacccugaccaucagcagccugcaggccgaggacguggccguguacuacugccagagcgacuacagcuaccccuacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31117 - RNA, 1329 nt, Artificial Sequence; identical to SEQ ID NO: 30643
  derived and/or modified sequence opt4 from Lutetium_(177Lu)_lilotomab_satetraxetan_HeavyChain1

SEQ ID NO: 31118 - RNA, 642 nt, Artificial Sequence; identical to SEQ ID NO: 30644
  derived and/or modified sequence opt4 from Lutetium_(177Lu)_lilotomab_satetraxetan_LightChain1

SEQ ID NO: 31119 - RNA, 1350 nt, Artificial Sequence
  derived and/or modified sequence opt4 from Margetuximab_HeavyChain1
caggugcagcugcagcagagcggccccgagcuggugaagcccggcgccagccugaagcugagcugcaccgccagcggcuucaacaucaaggacaccuacauccacugggugaagcagagacccgagcagggccuggaguggaucggcagaaucuaccccaccaacggcuacaccagauacgaccccaaguuccaggacaaggccaccaucaccgccgacaccagcagcaacaccgccuaccugcaggugagcagacugaccagcgaggacaccgccguguacuacugcagcagauggggcggcgacggcuucuacgccauggacuacuggggccagggcgccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcuggugggcggccccagcguguuccugcugccccccaagcccaaggacacccugaugaucagcagaacccccgaggugaccugcguggugguggacgugagccacgaggaccccgaggugaaguucaacugguacguggacggcguggaggugcacaacgccaagaccaagccccccgaggagcaguacaacagcacccugagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccuggugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31120 - RNA, 642 nt, Artificial Sequence
  derived and/or modified sequence opt4 from Margetuximab_LightChain1
gacaucgugaugacccagagccacaaguucaugagcaccagcgugggcgacagagugagcaucaccugcaaggccagccaggacgugaacaccgccguggccugguaccagcagaagcccggccacagccccaagcugcugaucuacagcgccagcuucagauacaccggcgugcccgacagauucaccggcagcagaagcggcaccgacuucaccuucaccaucagcagcgugcaggccgaggaccuggccguguacuacugccagcagcacuacaccaccccccccaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31121 - RNA, 762 nt, Artificial Sequence
  derived and/or modified sequence opt4 from Marzeptacog_alfa_HeavyChain1
aucgugggcggcaaggugugccccaagggcgagugccccuggcaggugcugcugcuggugaacggcgcccagcugugcggcggcacccugaucaacaccaucuggguggugagcgccgcccacugcuucgacaagaucaagaacuggagaaaccugaucgccgugcugggcgagcacgaccugagcgagcacgacggcgacgagcagagcagaagaguggcccaggugaucauccccagcaccuacgugcccggcaccaccaaccacgacaucgcccugcugagacugcaccagcccguggugcugaccgaccacguggugccccugugccugcccgagagaaccuucagcgagagaacccuggccuucgugagauucagccuggugagcggcuggggcagacugcuggacagaggcgccaccgcccuggagcugcaggugcugaacgugcccagacugaugacccaggacugccugcagcagagcagaaaggugggcgacagccccaacaucaccgaguacauguucugcgccggcuacagcgacggcagcaaggacagcugcaagggcgacagcggcggcccccacgccacccacuacagaggcaccugguaccugaccggcaucgugagcuggggccagggcugcgccaccgugggccacuucggcguguacaccagagugagccaguacaucgaguggcugcagaagcugaugagaagcgagcccagacccggcgugcugcugagagcccccuucccc

SEQ ID NO: 31122 - RNA, 456 nt, Artificial Sequence
  derived and/or modified sequence opt4 from Marzeptacog_alfa_LightChain1
gccaacgccuuccuggaggagcugagacccggcagccuggagagagagugcaaggaggagcagugcagcuucgaggaggccagagagaucuucaaggacgccgagagaaccaagcuguucuggaucagcuacagcgacggcgaccagugcgccagcagccccugccagaacggcggcagcugcaaggaccagcugcagagcuacaucugcuucugccugcccgccuucgagggcagaaacugcgagacccacaaggacgaccagcugaucugcgugaacgagaacggcggcugcgagcaguacugcagcgaccacaccggcaccaagagaagcugcagaugccacgagggcuacagccugcuggccgacggcgugagcugcaacgccaccguggaguaccccugcggcaagauccccauccuggagaagagaaacgccagcaagccccagggcaga

SEQ ID NO: 31123 - RNA, 669 nt, Artificial Sequence
  derived and/or modified sequence opt4 from Matuzumab_HeavyChain1_variant_3c08_H
caggugcagcuggugcagagcggcgccgaggugaagaagcccggcgccagcgugaaggugagcugcaaggccagcggcuacaccuucaccagccacuggaugcacugggugagacaggcccccggccagggccuggaguggaucggcgaguucaaccccagcaacggcagaaccaacuacaacgagaaguucaagagcaaggccaccaugaccguggacaccagcaccaacaccgccuacauggagcugagcagccugagaagcgaggacaccgccguguacuacugcgccagcagagacuacgacuacgacggcagauacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagc

SEQ ID NO: 31124 - RNA, 669 nt, Artificial Sequence
  derived and/or modified sequence opt4 from Matuzumab_HeavyChain1_variant_3c09_C
caggugcagcuggugcagagcggcgccgaggugaagaagcccggcgccagcgugaaggugagcugcaaggccagcggcuacaccuucaccagccacuggaugcacugggugagacaggcccccggccagggccuggaguggaucggcgaguucaaccccagcaacggcagaaccaacuacaacgagaaguucaagagcaaggccaccaugaccguggacaccagcaccaacaccgccuacauggagcugagcagccugagaagcgaggacaccgccguguacuacugcgccagcagagacuacgacuacgccggcagauacuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagc

SEQ ID NO: 31125 - RNA, 636 nt, Artificial Sequence
  derived and/or modified sequence opt4 from Matuzumab_LightChain1_variant_3c08_L
gacauccagaugacccagagccccagcagccugagcgccagcgugggcgacagagugaccaucaccugcagcgccagcagcagcgugaccuacauguacugguaccagcagaagcccggcaaggcccccaagcugcugaucuacgacaccagcaaccuggccagcggcgugcccagcagauucagcggcagcggcagcggcaccgacuacaccuucaccaucagcagccugcagcccgaggacaucgccaccuacuacugccagcaguggagcagccacaucuucaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgag

SEQ ID NO: 31126 - RNA, 636 nt, Artificial Sequence; identical to SEQ ID NO: 31125
  derived and/or modified sequence opt4 from Matuzumab_LightChain1_variant_3c09_B

SEQ ID NO: 31127 - RNA, 1341 nt, Artificial Sequence
  derived and/or modified sequence opt4 from Mavrilimumab_HeavyChain1
caggugcagcuggugcagagcggcgccgaggugaagaagcccggcgccagcgugaaggugagcugcaaggugagcggcuacacccugaccgagcugagcauccacugggugagacaggcccccggcaagggccuggaguggaugggcggcuucgaccccgaggagaacgagaucguguacgcccagagauuccagggcagagugaccaugaccgaggacaccagcaccgacaccgccuacauggagcugagcagccugagaagcgaggacaccgccguguacuacugcgccaucgugggcagcuucagcccccugacccugggccuguggggccagggcaccauggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugccccagcugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31128 - RNA, 651 nt, Artificial Sequence
  derived and/or modified sequence opt4 from Mavrilimumab_LightChain1
cagagcgugcugacccagccccccagcgugagcggcgcccccggccagagagugaccaucagcugcaccggcagcggcagcaacaucggcgcccccuacgacgugagcugguaccagcagcugcccggcaccgcccccaagcugcugaucuaccacaacaacaagagacccagcggcgugcccgacagauucagcggcagcaagagcggcaccagcgccagccuggccaucaccggccugcaggccgaggacgaggccgacuacuacugcgccaccguggaggccggccugagcggcagcguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 31129 - RNA, 1359 nt, Artificial Sequence
  derived and/or modified sequence opt4 from MDX-1303_HeavyChain1
caggugcagcugguggagagcggcggcggcguggugcagcccggcagaagccugagacugagcugcgccgccagcggcuucaccuucagcuacuacggcaugcacugggugagacaggcccccggcaagggccuggaguggguggccgugaucuggcacgacgagagcaucguguacuacgccgacagcgugaagggcagauucaccaucagcagagacaacagcaagaacacccuguaccugcagaugaacagccugagagccgaggacaccgccguguacuacugcaccagagaccccggcgaccccuacuacuacuacuacggccuggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31130 - RNA, 645 nt, Artificial Sequence
  derived and/or modified sequence opt4 from MDX-1303_LightChain1
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcaguacggcagcagcauguacaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31131 - RNA, 1347 nt, Artificial Sequence
  derived and/or modified sequence opt4 from Mepolizumab_HeavyChain1
caggugacccugagagagagcggccccgcccuggugaagcccacccagacccugacccugaccugcaccgugagcggcuucagccugaccagcuacagcgugcacugggugagacagccccccggcaagggccuggaguggcugggcgugaucugggccagcggcggcaccgacuacaacagcgcccugaugagcagacugagcaucagcaaggacaccagcagaaaccagguggugcugaccaugaccaacauggaccccguggacaccgccaccuacuacugcgccagagacccccccagcagccugcugagacuggacuacuggggcagaggcacccccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31132 - RNA, 660 nt, Artificial Sequence
  derived and/or modified sequence opt4 from Mepolizumab_LightChain1
gacaucgugaugacccagagccccgacagccuggccgugagccugggcgagagagccaccaucaacugcaagagcagccagagccugcugaacagcggcaaccagaagaacuaccuggccugguaccagcagaagcccggccagccccccaagcugcugaucuacggcgccagcaccagagagagcggcgugcccgacagauucagcggcagcggcagcggcaccgacuucacccugaccaucagcagccugcaggccgaggacguggccguguacuacugccagaacgugcacagcuuccccuucaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31133 - RNA, 1350 nt, Artificial Sequence
  derived and/or modified sequence opt4 from Metelimumab_HeavyChain1
gaggugcagcugguggagagcggcggcggcguggugcagcccggcagaagccugagacugagcugcgccgccagcggcuucaccuucagcagcuacggcaugcacugggugagacaggcccccggcaaggagcuggaguggguggccgugaucagcuacgacggcagcaucaaguacuacgccgacagcgugaagggcagauucaccaucagcagagacaacagcaagaacacccuguaccugcagaugaacagccugagagccgaggacaccgccguguacuacugcgccagaaccggcgaguacagcggcuacgacaccgacccccaguacagcuggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugccccagcugccccgcccccgaguuccugggcggccccagcguguuccuguucccccccaagcccaagcccacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31134 - RNA, 639 nt, Artificial Sequence
  derived and/or modified sequence opt4 from Metelimumab_LightChain1
gagaucgugcugacccagagccccagcagccugagcgccagcgugggcgacagagugaccaucaccugcagagccagccagggcaucggcgacgaccugggcugguaccagcagaagcccggcaaggcccccauccugcugaucuacggcaccagcacccugcagagcggcgugcccagcagauucagcggcagcggcagcggcaccgacuucacccugaccaucaacagccugcagcccgaggacuucgccaccuacuacugccugcaggacagcaacuacccccugaccuucggcggcggcaccagacuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagccccgugaccaagagcuucaacagaggcgagugc

SEQ ID NO: 31135 - RNA, 1350 nt, Artificial Sequence
  derived and/or modified sequence opt4 from Milatuzumab_HeavyChain1
caggugcagcugcagcagagcggcagcgagcugaagaagcccggcgccagcgugaaggugagcugcaaggccagcggcuacaccuucaccaacuacggcgugaacuggaucaagcaggcccccggccagggccugcaguggaugggcuggaucaaccccaacaccggcgagcccaccuucgacgacgacuucaagggcagauucgccuucagccuggacaccagcgugagcaccgccuaccugcagaucagcagccugaaggccgacgacaccgccguguacuucugcagcagaagcagaggcaagaacgaggccugguucgccuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31136 - RNA, 657 nt, Artificial Sequence
  derived and/or modified sequence opt4 from Milatuzumab_LightChain1
gacauccagcugacccagagcccccugagccugcccgugacccugggccagcccgccagcaucagcugcagaagcagccagagccuggugcacagaaacggcaacaccuaccugcacugguuccagcagagacccggccagagccccagacugcugaucuacaccgugagcaacagauucagcggcgugcccgacagauucagcggcagcggcagcggcaccgacuucacccugaagaucagcagaguggaggccgaggacgugggcguguacuucugcagccagagcagccacgugccccccaccuucggcgccggcaccagacuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31137 - RNA, 1341 nt, Artificial Sequence
  derived and/or modified sequence opt4 from Mirvetuximab_HeavyChain1
caggugcagcuggugcagagcggcgccgagguggugaagcccggcgccagcgugaagaucagcugcaaggccagcggcuacaccuucaccggcuacuucaugaacugggugaagcagagccccggccagagccuggaguggaucggcagaauccaccccuacgacggcgacaccuucuacaaccagaaguuccagggcaaggccacccugaccguggacaagagcagcaacaccgcccacauggagcugcugagccugaccagcgaggacuucgccguguacuacugcaccagauacgacggcagcagagccauggacuacuggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31138 - RNA, 654 nt, Artificial Sequence
  derived and/or modified sequence opt4 from Mirvetuximab_LightChain1
gacaucgugcugacccagagcccccugagccuggccgugagccugggccagcccgccaucaucagcugcaaggccagccagagcgugagcuucgccggcaccagccugaugcacugguaccaccagaagcccggccagcagcccagacugcugaucuacagagccagcaaccuggaggccggcgugcccgacagauucagcggcagcggcagcaagaccgacuucacccugaccaucagccccguggaggccgaggacgccgccaccuacuacugccagcagagcagagaguaccccuacaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31139 - RNA, 1344 nt, Artificial Sequence
  derived and/or modified sequence opt4 from Modotuximab_HeavyChain1
caggugcagcugcagcagcccggcgccgagcugguggagcccggcggcagcgugaagcugagcugcaaggccagcggcuacaccuucaccagccacuggaugcacugggugaagcagagacccggccagggccuggaguggaucggcgagaucaaccccagcagcggcagaaacaacuacaacgagaaguucaagagcaaggccacccugaccguggacaagagcagcagcaccgccuacaugcaguucagcagccugaccagcgaggacagcgccguguacuacugcgugagauacuacggcuacgacgaggccauggacuacuggggccagggcaccagcgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31140 - RNA, 657 nt, Artificial Sequence
  derived and/or modified sequence opt4 from Modotuximab_LightChain1
gacaucgugaugacccaggccgccuucagcaaccccgugacccugggcaccagcgccagcaucagcugcagaagcagcaagagccugcugcacagcaacggcaucaccuaccuguacugguaccugcagaagcccggccagagcccccagcugcugaucuaccagaugagcaaccuggccagcggcgugcccgacagauucagcagcagcggcagcggcaccgacuucacccugagaaucagcagaguggaggccgaggacgugggcguguacuacugcgcccagaaccuggagcugcccuacaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31141 - RNA, 1347 nt, Artificial Sequence
  derived and/or modified sequence opt4 from Mogamulizumab_HeavyChain1
gaggugcagcugguggagagcggcggcgaccuggugcagcccggcagaagccugagacugagcugcgccgccagcggcuucaucuucagcaacuacggcaugagcugggugagacaggcccccggcaagggccuggaguggguggccaccaucagcagcgccagcaccuacagcuacuaccccgacagcgugaagggcagauucaccaucagcagagacaacgccaagaacagccuguaccugcagaugaacagccugagaguggaggacaccgcccuguacuacugcggcagacacagcgacggcaacuucgccuucggcuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31142 - RNA, 657 nt, Artificial Sequence
  derived and/or modified sequence opt4 from Mogamulizumab_LightChain1
gacgugcugaugacccagagcccccugagccugcccgugacccccggcgagcccgccagcaucagcugcagaagcagcagaaacaucgugcacaucaacggcgacaccuaccuggagugguaccugcagaagcccggccagagcccccagcugcugaucuacaaggugagcaacagauucagcggcgugcccgacagauucagcggcagcggcagcggcaccgacuucacccugaagaucagcagaguggaggccgaggacgugggcguguacuacugcuuccagggcagccugcugcccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31143 - RNA, 1356 nt, Artificial Sequence
  derived and/or modified sequence opt4 from Monalizumab_HeavyChain1
caggugcagcuggugcagagcggcgccgaggugaagaagcccggcgccagcgugaaggugagcugcaaggccagcggcuacaccuucaccagcuacuggaugaacugggugagacaggcccccggccagggccuggaguggaugggcagaaucgaccccuacgacagcgagacccacuacgcccagaagcugcagggcagagugaccaugaccaccgacaccagcaccagcaccgccuacauggagcugagaagccugagaagcgacgacaccgccguguacuacugcgccagaggcggcuacgacuucgacgugggcacccuguacugguucuucgacguguggggccagggcaccaccgugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31144 - RNA, 642 nt, Artificial Sequence
  derived and/or modified sequence opt4 from Monalizumab_LightChain1
gacauccagaugacccagagccccagcagccugagcgccagcgugggcgacagagugaccaucaccugcagagccagcgagaacaucuacagcuaccuggccugguaccagcagaagcccggcaaggcccccaagcugcugaucuacaacgccaagacccuggccgagggcgugcccagcagauucagcggcagcggcagcggcaccgacuucacccugaccaucagcagccugcagcccgaggacuucgccaccuacuacugccagcaccacuacggcacccccagaaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31145 - RNA, 1350 nt, Artificial Sequence
  derived and/or modified sequence opt4 from Motavizumab_HeavyChain
caggugacccugagagagagcggccccgcccuggugaagcccacccagacccugacccugaccugcaccuucagcggcuucagccugagcaccgccggcaugagcgugggcuggaucagacagccccccggcaaggcccuggaguggcuggccgacaucuggugggacgacaagaagcacuacaaccccagccugaaggacagacugaccaucagcaaggacaccagcaagaaccagguggugcugaaggugaccaacauggaccccgccgacaccgccaccuacuacugcgccagagacaugaucuucaacuucuacuucgacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31146 - RNA, 1350 nt, Artificial Sequence; identical to SEQ ID NO: 31145
  derived and/or modified sequence opt4 from Motavizumab_HeavyChain_variant

SEQ ID NO: 31147 - RNA, 639 nt, Artificial Sequence
  derived and/or modified sequence opt4 from Motavizumab_LightChain
gacauccagaugacccagagccccagcacccugagcgccagcgugggcgacagagugaccaucaccugcagcgccagcagcagagugggcuacaugcacugguaccagcagaagcccggcaaggcccccaagcugcugaucuacgacaccagcaagcuggccagcggcgugcccagcagauucagcggcagcggcagcggcaccgaguucacccugaccaucagcagccugcagcccgacgacuucgccaccuacuacugcuuccagggcagcggcuaccccuucaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31148 - RNA, 639 nt, Artificial Sequence; identical to SEQ ID NO: 31147
  derived and/or modified sequence opt4 from Motavizumab_LightChain_variant

SEQ ID NO: 31149 - RNA, 1428 nt, Artificial Sequence
  derived and/or modified sequence opt4 from Moxetumomab_pasudotox_HeavyChain1
auggaggugcagcugguggagagcggcggcggccuggugaagcccggcggcagccugaagcugagcugcgccgccagcggcuucgccuucagcaucuacgacaugagcugggugagacagacccccgagaagugccuggaguggguggccuacaucagcagcggcggcggcaccaccuacuaccccgacaccgugaagggcagauucaccaucagcagagacaacgccaagaacacccuguaccugcagaugagcagccugaagagcgaggacaccgccauguacuacugcgccagacacagcggcuacggcacccacuggggcgugcuguucgccuacuggggccagggcacccuggugaccgugagcgccaaggccagcggcggccccgagggcggcagccuggccgcccugaccgcccaccaggccugccaccugccccuggagaccuucaccagacacagacagcccagaggcugggagcagcuggagcagugcggcuaccccgugcagagacugguggcccuguaccuggccgccagacugagcuggaaccagguggaccaggugaucagaaacgcccuggccagccccggcagcggcggcgaccugggcgaggccaucagagagcagcccgagcaggccagacuggcccugacccuggccgccgccgagagcgagagauucgugagacagggcaccggcaacgacgaggccggcgccgccaacggccccgccgacagcggcgacgcccugcuggagagaaacuaccccaccggcgccgaguuccugggcgacggcggcgacgugagcuucagcaccagaggcacccagaacuggaccguggagagacugcugcaggcccacagacagcuggaggagagaggcuacguguucgugggcuaccacggcaccuuccuggaggccgcccagagcaucguguucggcggcgugagagccagaagccaggaccuggacgccaucuggagaggcuucuacaucgccggcgaccccgcccuggccuacggcuacgcccaggaccaggagcccgacgccagaggcagaaucagaaacggcgcccugcugagaguguacgugcccagaagcagccugcccggcuucuacagaaccagccugacccuggccgcccccgaggccgccggcgagguggagagacugaucggccacccccugccccugagacuggacgccaucaccggccccgaggaggagggcggcagacuggagaccauccugggcuggccccuggccgagagaaccguggugauccccagcgccauccccaccgaccccagaaacgugggcggcgaccuggaccccagcagcauccccgacaaggagcaggccaucagcgcccugcccgacuacgccagccagcccggcaagccccccagagaggaccugaag

SEQ ID NO: 31150 - RNA, 324 nt, Artificial Sequence
  derived and/or modified sequence opt4 from Moxetumomab_pasudotox_LightChain1
auggacauccagaugacccagaccaccagcagccugagcgccagccugggcgacagagugaccaucagcugcagagccagccaggacaucagcaacuaccugaacugguaccagcagaagcccgacggcaccgugaagcugcugaucuacuacaccagcauccugcacagcggcgugcccagcagauucagcggcagcggcagcggcaccgacuacagccugaccaucagcaaccuggagcaggaggacuucgccaccuacuucugccagcagggcaacacccugcccuggaccuucggcugcggcaccaagcuggagaucaag

SEQ ID NO: 31151 - RNA, 1350 nt, Artificial Sequence
  derived and/or modified sequence opt4 from Muromonab-CD3_HeavyChain
caggugcagcugcagcagagcggcgccgagcuggccagacccggcgccagcgugaagaugagcugcaaggccagcggcuacaccuucaccagauacaccaugcacugggugaagcagagacccggccagggccuggaguggaucggcuacaucaaccccagcagaggcuacaccaacuacaaccagaaguucaaggacaaggccacccugaccaccgacaagagcagcagcaccgccuacaugcagcugagcagccugaccagcgaggacagcgccguguacuacugcgccagauacuacgacgaccacuacugccuggacuacuggggccagggcaccacccugaccgugagcagcgccaagaccaccgcccccagcguguacccccuggcccccgugugcggcggcaccaccggcagcagcgugacccugggcugccuggugaagggcuacuuccccgagcccgugacccugaccuggaacagcggcagccugagcagcggcgugcacaccuuccccgccgugcugcagagcgaccuguacacccugagcagcagcgugaccgugaccagcagcaccuggcccagccagagcaucaccugcaacguggcccaccccgccagcagcaccaagguggacaagaagaucgagcccagacccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31152 - RNA, 639 nt, Artificial Sequence
  derived and/or modified sequence opt4 from Muromonab-CD3_LightChain
cagaucgugcugacccagagccccgccaucaugagcgccagccccggcgagaaggugaccaugaccugcagcgccagcagcagcgugagcuacaugaacugguaccagcagaagagcggcaccagccccaagagauggaucuacgacaccagcaagcuggccagcggcgugcccgcccacuucagaggcagcggcagcggcaccagcuacagccugaccaucagcggcauggaggccgaggacgccgccaccuacuacugccagcaguggagcagcaaccccuucaccuucggcagcggcaccaagcuggagaucaacagagccgacaccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagugc

SEQ ID NO: 31153 - RNA, 1347 nt, Artificial Sequence
  derived and/or modified sequence opt4 from Namilumab_HeavyChain1
caggugcagcuggugcagagcggcgccgaggugaagaagcccggcgccagcgugaaggugagcugcaaggccuucggcuaccccuucaccgacuaccugcugcacugggugagacaggcccccggccagggccuggagugggugggcuggcugaaccccuacagcggcgacaccaacuacgcccagaaguuccagggcagagugaccaugaccagagacaccagcaucagcaccgccuacauggagcugagcagacugagaagcgacgacaccgccguguacuacugcaccagaaccacccugaucagcguguacuucgacuacuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31154 - RNA, 642 nt, Artificial Sequence
  derived and/or modified sequence opt4 from Namilumab_LightChain1
gacauccagaugacccagagccccagcagcgugagcgccagcgugggcgacagagugaccaucgccugcagagccagccagaacaucagaaacauccugaacugguaccagcagagacccggcaaggccccccagcugcugaucuacgccgccagcaaccugcagagcggcgugcccagcagauucagcggcagcggcagcggcaccgacuucacccugaccaucaacagccugcagcccgaggacuucgccaccuacuacugccagcagagcuacagcaugcccagaaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31155 - RNA, 1374 nt, Artificial Sequence
  derived and/or modified sequence opt4 from Naptumomab_estafenatox_HeavyChain
gaggugcagcugcagcagagcggccccgaccuggugaagcccggcgccagcgugaagaucagcugcaaggccagcggcuacagcuucaccggcuacuacaugcacugggugaagcagagccccggcaagggccuggaguggaucggcagaaucaaccccaacaacggcgugacccuguacaaccagaaguucaaggacaaggccacccugaccguggacaagagcagcaccaccgccuacauggagcugagaagccugaccagcgaggacagcgccguguacuacugcgccagaagcaccaugaucaccaacuacgugauggacuacuggggccagggcaccagcgugaccgugagcagcgccaagaccaccccccccagcguguacccccuggcccccggcagcgccgcccagaccaacagcauggugacccugggcugccuggugaagggcuacuuccccgagcccgugaccgugaccuggaacagcggcagccugagcagcggcgugcacaccuuccccgccgugcugcagagcgaccuguacacccugagcagcagcgugaccgugcccagcagcaccuggcccagcgagaccgugaccugcaacguggcccaccccgccagcagcaccaagguggacaagaagaucgugcccagagacagcggcggccccagcgagaagagcgaggagaucaacgagaaggaccugagaaagaagagcgagcugcagggcaccgcccugggcaaccugaagcagaucuacuacuacaacagcaaggccaucaccagcagcgagaagagcgccgaccaguuccugaccaacacccugcuguucaagggcuucuucaccggccaccccugguacaacgaccugcugguggaccugggcagcaccgccgccaccagcgaguacgagggcagcagcguggaccuguacggcgccuacuacggcuaccagugcgccggcggcacccccaacaagaccgccugcauguacggcggcgugacccugcacgacaacaacagacugaccgaggagaagaaggugcccaucaaccuguggaucgacggcaagcagaccaccgugcccaucgacaaggugaagaccagcaagaaggaggugaccgugcaggagcuggaccugcaggccagacacuaccugcacggcaaguucggccuguacaacagcgacagcuucggcggcaaggugcagagaggccugaucguguuccacagcagcgagggcagcaccgugagcuacgaccuguucgacgcccagggccaguaccccgacacccugcugagaaucuacagagacaacaccaccaucagcagcaccagccugagcaucagccuguaccuguacaccacc

SEQ ID NO: 31156 - RNA, 642 nt, Artificial Sequence
  derived and/or modified sequence opt4 from Naptumomab_estafenatox_LightChain
agcaucgugaugacccagacccccaccagccugcuggugagcgccggcgacagagugaccaucaccugcaaggccagccagagcgugagcaacgacguggccugguaccagcagaagcccggccagagccccaagcugcugaucagcuacaccagcagcagauacgccggcgugcccgacagauucagcggcagcggcuacggcaccgacuucacccugaccaucagcagcgugcaggccgaggacgccgccguguacuucugccagcaggacuacaacagcccccccaccuucggcggcggcaccaagcuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagagc

SEQ ID NO: 31157 - RNA, 1356 nt, Artificial Sequence
  derived and/or modified sequence opt4 from Narnatumab_HeavyChain1
gaggugcagcugguggagagcggcggcggccuggugcagcccggcggcagccugagacugagcugcgccgccagcggcuucaccuucagcagcuaccugaugaccugggugagacaggcccccggcaagggccuggaguggguggccaacaucaagcaggacggcagcgagaaguacuacguggacagcgugaagggcagauucaccaucagcagagacaacgccaagaacagccugaaccugcagaugaacagccugagagccgaggacaccgccguguacuacugcaccagagacggcuacagcagcggcagacacuacggcauggacguguggggccagggcaccaccgugaucgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31158 - RNA, 642 nt, Artificial Sequence
  derived and/or modified sequence opt4 from Narnatumab_LightChain1
gagaucgugcugacccagagccccgccacccugagccugagccccggcgagagagccacccugagcugcagagccagccagagcgugagcagauaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggcccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31159 - RNA, 1350 nt, Artificial Sequence
  derived and/or modified sequence opt4 from Natalizumab_HeavyChain1
caggugcagcuggugcagagcggcgccgaggugaagaagcccggcgccagcgugaaggugagcugcaaggccagcggcuucaacaucaaggacaccuacauccacugggugagacaggcccccggccagagacuggaguggaugggcagaaucgaccccgccaacggcuacaccaaguacgaccccaaguuccagggcagagugaccaucaccgccgacaccagcgccagcaccgccuacauggagcugagcagccugagaagcgaggacaccgccguguacuacugcgccagagagggcuacuacggcaacuacggcguguacgccauggacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugccccagcugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31160 - RNA, 639 nt, Artificial Sequence
  derived and/or modified sequence opt4 from Natalizumab_LightChain1
gacauccagaugacccagagccccagcagccugagcgccagcgugggcgacagagugaccaucaccugcaagaccagccaggacaucaacaaguacauggccugguaccagcagacccccggcaaggcccccagacugcugauccacuacaccagcgcccugcagcccggcauccccagcagauucagcggcagcggcagcggcagagacuacaccuucaccaucagcagccugcagcccgaggacaucgccaccuacuacugccugcaguacgacaaccuguggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31161 - RNA, 1335 nt, Artificial Sequence
  derived and/or modified sequence opt4 from Navicixizumab_HeavyChain1
caggugcagcuggugcagagcggcgccgaggugaagaagcccggcgccagcgugaagaucagcugcaaggccagcggcuacagcuucaccgccuacuacauccacugggugaagcaggcccccggccagggccuggaguggaucggcuacaucagcaacuacaacagagccaccaacuacaaccagaaguucaagggcagagugaccuucaccaccgacaccagcaccagcaccgccuacauggagcugagaagccugagaagcgacgacaccgccguguacuacugcgccagagacuacgacuacgacgugggcauggacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagaggagaugaccaagaaccaggugagccugaccugccugguggagggcuucuaccccagcgacaucgccguggagugggagagcaacggccagcccgagaacaacuacaagaccaccccccccaugcuggacagcgacggcagcuucuuccuguacagcgagcugaccguggacaagagcagauggcagcagggcaacguguucagcugcagcgugaugcacgaggcccugcacaaccacuacacccagaagagccugagccugagccccggcaag

SEQ ID NO: 31162 - RNA, 1341 nt, Artificial Sequence
  derived and/or modified sequence opt4 from Navicixizumab_HeavyChain2
caggugcagcuggugcagagcggcgccgaggugaagaagcccggcgccagcgugaaggugagcugcaaggccagcggcuacaccuucaccaacuacuggaugcacugggugagacaggcccccggccagggccuggaguggaugggcgacaucaaccccagcaacggcagaaccagcuacaaggagaaguucaagagaagagugacccugagcguggacaagagcagcagcaccgccuacauggagcugagcagccugagaagcgaggacaccgccguguacuucugcaccauccacuacgacgacaaguacuacccccugauggacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagugcugcguggagugcccccccugccccgccccccccguggccggccccagcguguuccuguucccccccaagcccaaggacacccugaugaucagcagaacccccgaggugaccugcguggugguggacgugagccacgaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagcagagagaagaugaccaagaaccaggugagccugaccugccuggugaagggcuucuaccccagcgacaucgccguggagugggagagcaacggccagcccgagaacaacuacaagaccaccccccccaugcugaagagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31163 - RNA, 654 nt, Artificial Sequence; identical to SEQ ID NO: 30767
  derived and/or modified sequence opt4 from Navicixizumab_LightChain1

SEQ ID NO: 31164 - RNA, 1368 nt, Artificial Sequence
  derived and/or modified sequence opt4 from Navivumab_HeavyChain1
caggugcagcuggugcagagcggcgccgaggugaagaagcccggcgccagcgugaaggugagcugcaagaccagcggcuacagcuucagcaccuacggcgugagcugggugagacaggcccccggccagggccccgagugggugggcuggaucagcgccuacaccggcaucaccgacuacgcccagaaguuccagggcagagugacccugaccaccgacgccaccaccgccaccgccuuccuggaccugagaagccugagacccgacgacaccgccaccuacuucugcgccagagacaaggugcagggcagaguggaggugggcagcggcggcagacacgacuacuggggccagggcacccuggugaucgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgagggccugcacaaccacuacacccagaagagccugagccugagccccggcaag

SEQ ID NO: 31165 - RNA, 645 nt, Artificial Sequence
  derived and/or modified sequence opt4 from Navivumab_LightChain1
gagguggugcugacccagagccccggcacccuggcccugccccccggcgagagagccacccugagcugcagagccagccacagagugggcagcaccuacaucgccugguaccagcagaagagcggccaggcccccagaagacugaucuacggcgccagcaacagagccaccgacauccccgacagauucagcggcagcggcagcggcaccgacuucacccugaccaucagaagacuggagcccgaggacagcgccguguacuacugccagcaguucagcgugagccccuggaccuucggccagggcaccagaguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31166 - RNA, 2172 nt, Artificial Sequence
  derived and/or modified sequence opt4 from Ndimab-varB_HeavyChain
caggugcagcugguggagagcggcggcggcguggugcagcccggcagaagccugagacugagcugcgccgccagcggcuucaucuucagcagcuacgccaugcacugggugagacaggcccccggcaacggccuggaguggguggccuucaugagcuacgacggcagcaacaagaaguacgccgacagcgugaagggcagauucaccaucagcagagacaacagcaagaacacccuguaccugcagaugaacagccugagagccgaggacaccgccguguacuacugcgccagagacagaggcaucagcgccggcggcaacuacuacuacuacggcauggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaagggcggcggcggcagcggcggcggcggcagccaggugcagcuggugcagagcggcgccgaggugaagaagcccggcagcagcgugaaggugagcugcaaggccagcggcggcaccuucagcaccuacggcaucagcugggugagacaggcccccggccagugccuggaguggaugggcggcaucauccccaucuucgacaccggcaacagcgcccagagcuuccagggcagagugaccaucaccgccgacgagagcaccagcaccgccuacauggagcugagcagccugagaagcgaggacaccgccguguacuacugcgccagaagcagcagaaucuacgaccugaaccccagccugaccgccuacuacgacauggacguguggggccagggcaccauggugaccgugagcagcggcggcggcggcagcggcggcggcggcagcggcggcggcggcagcggcggcggcggcagccagagcgugcugacccagccccccagcgugagcgccgcccccggccagaaggugaccaucagcugcagcggcagcagcagcaacaucggcaacaacuacgugagcugguaccagcagcugcccggcaccgcccccaagcugcugaucuacgacaacaacaagagacccagcggcauccccgacagauucagcggcagcaagagcggcaccagcgccacccugggcaucaccggccugcagaccggcgacgaggccgacuacuacugcggcaccugggacagcagccugagcgccuggguguucggcugcggcaccaagcugaccgugcug

SEQ ID NO: 31167 - RNA, 645 nt, Artificial Sequence
  derived and/or modified sequence opt4 from Ndimab-varB_LightChain
gagaucgugcugacccagagccccgccacccugagccugagccccggcgagagagccacccugagcugcagagccagccagagcguguacagcuaccuggccugguaccagcagaagcccggccaggcccccagacugcugaucuacgacgccagcaacagagccaucggcauccccgccagauucagcggcagcggcagcggcaccgacuucacccugaccaucagcagccuggagcccgaggacuucgccguguacuacugccagcagagaagcaacuggccccccuucaccuucggccccggcaccaagguggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31168 - RNA, 1353 nt, Artificial Sequence
  derived and/or modified sequence opt4 from Necitumumab_HeavyChain1
caggugcagcugcaggagagcggccccggccuggugaagcccagccagacccugagccugaccugcaccgugagcggcggcagcaucagcagcggcgacuacuacuggagcuggaucagacagccccccggcaagggccuggaguggaucggcuacaucuacuacagcggcagcaccgacuacaaccccagccugaagagcagagugaccaugagcguggacaccagcaagaaccaguucagccugaaggugaacagcgugaccgccgccgacaccgccguguacuacugcgccagagugagcaucuucggcgugggcaccuucgacuacuggggccagggcacccuggugaccgugagcagcgccagcaccaagggccccagcgugcugccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31169 - RNA, 642 nt, Artificial Sequence
  derived and/or modified sequence opt4 from Necitumumab_LightChain1
gagaucgugaugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccaccaguacggcagcaccccccugaccuucggcggcggcaccaaggccgagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31170 - RNA, 396 nt, Artificial Sequence
  derived and/or modified sequence opt4 from Neliximab_HeavyChain_VH-Region
gaggugcagcugcagcagagcggccccgagcuggugaagcccggcgccagcgugaagaugagcugcaaggccagcggcuacaccuucaccaccuacgugaugcacugggugaagcagaagcccggccagggccuggaguggaucggcuacaucaaccccuacaacgacggcaccaacuacaacgagaaguucaagggcaaggccacccugaccagcgacaagagcagcagcaccgccuacauggagcugagcacccugaccagcgaggacagcgccguguacuacugcgccgaguucaucaccaagaccgugggcggcagcaacugguaccuggacguguggggcgccggcaccaccgugaccgugagcagcgccaagaccaccccccccaagcug

SEQ ID NO: 31171 - RNA, 372 nt, Artificial Sequence
  derived and/or modified sequence opt4 from Neliximab_HeavyChain_VH-Region_variant1
caggugcagcugaagcagagcggccccgagcuggugaagcccggcgccagcgugaagaugagcugcaaggccagcggcuacaccuucaccaccuacgugaugcacugggugaagcagaagcccggccagggccuggaguggaucggcuacaucaaccccuacaacgacggcaccaacuacaacgagaaguucaagggcaaggccacccugaccagcgacaagagcagcagcaccgccuacauggagcugagcacccugaccagcgaggacagcgccguguacuacugcgccgaguucaucaccaagaccgugggcggcagcaacugguaccuggacguguggggcgccggcaccaccgugaccgugagcagc

SEQ ID NO: 31172 - RNA, 318 nt, Artificial Sequence
  derived and/or modified sequence opt4 from Neliximab_LightChain_VL-Region
gacaucgugcugacccagagccccgccaucaugagcgccagccccggcgagaaggugaccaugaccugcagcgccagcagcagcaucagcuacauccacugguuccagcagaagcccggcaccagccccaagagauggaucuacgacaccagcaagcugcccagcggcgugcccgccagauucagcggcagcggcagcggcaccagcuacagccugaccaucagcagcauggaggccgaggacgccgccaccuacuacugccaccagagaagcagcuacaccuggaccuucggcggcggcaccaagcuggagaucaag

SEQ ID NO: 31173 - RNA, 354 nt, Artificial Sequence
  derived and/or modified sequence opt4 from Neliximab_LightChain_VL-Region_variant1
cagaucgugcugacccagagccccgccaucaugagcgccagccccggcgagaaggugaccaugaccugcagcgccagcagcagcaucagcuacauccacugguuccagcagaagcccggcaccagccccaagagauggaucuacgacaccagcaagcugcccagcggcgugcccgccagauucagcggcagcggcagcggcaccagcuacagccugaccaucagcagcauggaggccgaggacgccgccaccuacuacugccaccagagaagcagcuacaccuggaccuucggcggcggcaccaagcuggagaucaagagagccgacgccgcccccaccgugagcgccgccgcc

SEQ ID NO: 31174 - RNA, 1335 nt, Artificial Sequence
  derived and/or modified sequence opt4 from Nemolizumab_HeavyChain1
caggugcagcuggugcagagcggcgccgaggugaagaagcccggcgccagcgugaaggugagcugcaaggccagcggcuacaccuucaccggcuacaucaugaacugggugagacaggcccccggccagggccuggaguggaugggccugaucaaccccuacaacggcggcaccgacuacaacccccaguuccaggacagagugaccaucaccgccgacaagagcaccagcaccgccuacauggagcugagcagccugagaagcgaggacaccgccguguacuacugcgccagagacggcuacgacgacggccccuacacccuggagaccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcaacuucggcacccagaccuacaccugcaacguggaccacaagcccagcaacaccaagguggacaagaccguggagagaaagagcugcguggagugcccccccugccccgccccccccguggccggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuucagaguggugagcgugcugaccguggugcaccaggacuggcugaacggcaaggaguacaagugcaaggugagcaacaagggccugcccgcccccaucgagaagaccaucagcaagaccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccaugcuggacagcgacggcagcuucuuccuguacagcaagcugaccguggacaagagcagauggcaggagggcaacguguucagcugcagcgugaugcacgaggcccugcacaaccacuacacccagaagagccugagccugagcccc

SEQ ID NO: 31175 - RNA, 642 nt, Artificial Sequence
  derived and/or modified sequence opt4 from Nemolizumab_LightChain1
gacauccagaugacccagagccccagcagccugagcgccagcgugggcgacagagugaccaucaccugccaggccagcgaggacaucuacagcuucguggccugguaccagcagaagcccggcaaggcccccaagcugcugaucuacaacgcccagaccgaggcccagggcgugcccagcagauucagcggcagcggcagcggcaccgacuucacccugaccaucagcagccugcagcccgaggacuucgccaccuacuacugccagcaccacuacgacagcccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31176 - RNA, 1356 nt, Artificial Sequence
  derived and/or modified sequence opt4 from Nesvacumab_HeavyChain1
gaggugcagcugguggagagcggcggcggccuggugcagcccggcggcagccugagacugagcugcgccgccagcggcuucaccuucagcagcuacgacauccacugggugagacaggccaccggcaagggccuggagugggugagcgccaucggccccgccggcgacaccuacuaccccggcagcgugaagggcagauucaccaucagcagagagaacgccaagaacagccuguaccugcagaugaacagccugagagccggcgacaccgccguguacuacugcgccagaggccugaucaccuucggcggccugaucgcccccuucgacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31177 - RNA, 642 nt, Artificial Sequence
  derived and/or modified sequence opt4 from Nesvacumab_LightChain1
gagaucgugcugacccagagccccggcacccugagccugagccccggcgagagagccacccugagcugcagagccagccagagcgugagcagcaccuaccuggccugguaccagcagaagcccggccaggcccccagacugcugaucuacggcgccagcagcagagccaccggcauccccgacagauucagcggcagcggcagcggcaccgacuucacccugaccaucagcagacuggagcccgaggacuucgccguguacuacugccagcacuacgacaacagccagaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31178 - RNA, 1362 nt, Artificial Sequence
  derived and/or modified sequence opt4 from Neuradiab_HeavyChain1
gaggugcagcugcagcagagcggccccgagcuggugaagcccggcgccagcgugaagaugagcugcaaggccagcggcuacaccuucaccagcuacguggugcacugggugaagcagaaccccggccagggccuggaguggaucggcuacaucaaccccuucaacgacggcaccaaguacaacgagaacuucaagugcaaggccacccugaccagcgacagaagcagcagcaccgccuacauggagcugagcagccugaccagcgaggagagcgccguguacuucugcgccagagacaugggcagagagggcuucgccuacuggggccagggcacccuggugaccgugagcgccgccaagaccaccccccccagcguguacccccuggcccccggcugcggcgacaccaccggcagcagcgugacccugggcugccuggugaagggcuacuuccccgagagcgugaccgugaccuggaacagcggcagccugagcagcagcgugcacaccuuccccgcccugcugcagagcggccuguacaccaugagcagcagcgugaccgugcccagcagcaccuggcccagccagaucgugaucugcagcguggcccaccccgccagcagcaccaccguggacaagaagcuggagcccagcggccccaucagcaccaucaaccccugcccccccugcaaggagugccacaagugccccgcccccaaccuggagggcggccccagcguguucaucuucccccccaacaucaaggacgugcugaugaucagccugacccccaaggugaccugcguggugguggacgugagcgaggacgaccccgacgugcagaucagcugguucgugaacaacguggaggugcacaccgcccagacccagacccacagagaggacuacaacagcaccaucagaguggugagcacccugcccauccagcaccaggacuggaugagcggcaaggaguucaagugcaaggugaacaacaaggaccugcccagccccaucgagagaaccaucagcaagaucaagggccuggugagagccccccagguguacauccugcccccccccgccgagcagcugagcagaaaggacgugagccugaccugccugguggugggcuucaaccccggcgacaucagcguggaguggaccagcaacggccacaccgaggagaacuacaaggacaccgcccccgugcuggacagcgacggcagcuacuucaucuacagcaagcugaacaugaagaccagcaagugggagaagaccgacagcuucagcugcaacgugagacacgagggccugaagaacuacuaccugaagaagaccaucagcagaagccccggcaag

SEQ ID NO: 31179 - RNA, 657 nt, Artificial Sequence
  derived and/or modified sequence opt4 from Neuradiab_LightChain1
gacaucgugaugacccaggccgccuucagcaaccccgugacccugggcaccagcgccagcaucagcugcagaagcagcaagagccugcugcacagcaacggcaucaccuaccuguacugguaccugcagaagcccggccagagcccccagcugcugaucuaccagaugagcaaccuggccagcggcgugcccgacagauucagcagcagcggcagcggcaccgacuucacccugagaaucagcagaguggaggccgaggacgugggcguguacuacugcgcccagaaccuggagcugcccagaaccuucggcggcggcaccaagcuggagaucaagagagccgacgccgcccccaccgugagcaucuucccccccagcagcgagcagcugaccagcggcggcgccagcguggugugcuuccugaacaacuucuaccccaaggacaucaacgugaaguggaagaucgacggcagcgagagacagaacggcgugcugaacagcuggaccgaccaggacagcaaggacagcaccuacagcaugagcagcacccugacccugaccaaggacgaguacgagagacacaacagcuacaccugcgaggccacccacaagaccagcaccagccccaucgugaagagcuucaacagaaacgagugc

SEQ ID NO: 31180 - RNA, 369 nt, Artificial Sequence
  derived and/or modified sequence opt4 from Nimotuzumab_HeavyChain1
caggugcagcugcagcagagcggcgccgaggugaagaagcccggcagcagcgugaaggugagcugcaaggccagcggcuacaccuucaccaacuacuacaucuacugggugagacaggcccccggccagggccuggaguggaucggcggcaucaaccccaccagcggcggcagcaacuucaacgagaaguucaagaccagagugaccaucaccguggacgagagcaccaacaccgccuacauggagcugagcagccugagaagcgaggacaccgccuucuacuucugcgccagacagggccugugguucgacagcgacggcagaggcuucgacuucuggggccagggcagcaccgugaccgugagcagc

SEQ ID NO: 31181 - RNA, 342 nt, Artificial Sequence
  derived and/or modified sequence opt4 from Nimotuzumab_LightChain1
gacauccagaugacccagagccccagcagccugagcgccagcgugggcgacagagugaccaucaccugcagaagcagccagaacaucgugcacagcaacggcaacaccuaccuggacugguaccagcagacccccggcaaggcccccaagcugcugaucuacaaggugagcaacagauucagcggcgugcccagcagauucagcggcagcggcagcggcaccgacuucaccuucaccaucagcagccugcagcccgaggacaucgccaccuacuacugcuuccaguacagccacgugcccuggaccuucggccagggcaccaagcugcagaucaccagagag

SEQ ID NO: 31182 - RNA, 1320 nt, Artificial Sequence
  derived and/or modified sequence opt4 from Nivolumab_HeavyChain1
caggugcagcugguggagagcggcggcggcguggugcagcccggcagaagccugagacuggacugcaaggccagcggcaucaccuucagcaacagcggcaugcacugggugagacaggcccccggcaagggccuggaguggguggccgugaucugguacgacggcagcaagagauacuacgccgacagcgugaagggcagauucaccaucagcagagacaacagcaagaacacccuguuccugcagaugaacagccugagagccgaggacaccgccguguacuacugcgccaccaacgacgacuacuggggccagggcacccuggugaccgugagcagcgccagcaccaagggccccagcguguucccccuggcccccugcagcagaagcaccagcgagagcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcaccaagaccuacaccugcaacguggaccacaagcccagcaacaccaagguggacaagagaguggagagcaaguacggcccccccugcccccccugccccgcccccgaguuccugggcggccccagcguguuccuguucccccccaagcccaaggacacccugaugaucagcagaacccccgaggugaccugcguggugguggacgugagccaggaggaccccgaggugcaguucaacugguacguggacggcguggaggugcacaacgccaagaccaagcccagagaggagcaguucaacagcaccuacagaguggugagcgugcugaccgugcugcaccaggacuggcugaacggcaaggaguacaagugcaaggugagcaacaagggccugcccagcagcaucgagaagaccaucagcaaggccaagggccagcccagagagccccagguguacacccugccccccagccaggaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcagacugaccguggacaagagcagauggcaggagggcaacguguucagcugcagcgugaugcacgaggcccugcacaaccacuacacccagaagagccugagccugagccugggcaag

SEQ ID NO: 31183 - RNA, 642 nt, Artificial Sequence
  derived and/or modified sequence opt4 from Nivolumab_LightChain1
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagcagcaacuggcccagaaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31184 - RNA, 1347 nt, Artificial Sequence
  derived and/or modified sequence opt4 from Obiltoxaximab_HeavyChain1
caggugcagcugcagcagagcggccccgagcugaagaagcccggcgccagcgugaaggugagcugcaaggacagcggcuacgccuucagcagcagcuggaugaacugggugagacaggcccccggccagggccuggaguggaucggcagaaucuaccccggcgacggcgacaccaacuacaacggcaaguuccagggcagagugaccaucaccgccgacaagagcagcagcaccgccuacauggagcugagcagccugagaagcgaggacaccgccguguacuucugcgccagaagcggccugcugagauacgccauggacuacuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31185 - RNA, 642 nt, Artificial Sequence
  derived and/or modified sequence opt4 from Obiltoxaximab_LightChain1
gacauccagaugacccagagccccagcagccugagcgccagcgugggcgacagagugaccaucaccugcagagccagccaggacaucagaaacuaccugaacugguaccagcagaagcccggcaaggccgugaagcugcugaucuacuacaccagcagacugcugcccggcgugcccagcagauucagcggcagcggcagcggcaccgacuacagccugaccaucagcagccaggagcaggaggacaucggcaccuacuucugccagcagggcaacacccugcccuggaccuucggccagggcaccaagguggagaucagaagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31186 - RNA, 1347 nt, Artificial Sequence; identical to SEQ ID NO: 30590
  derived and/or modified sequence opt4 from Obinutuzumab_HeavyChain1

SEQ ID NO: 31187 - RNA, 657 nt, Artificial Sequence; identical to SEQ ID NO: 30591
  derived and/or modified sequence opt4 from Obinutuzumab_LightChain1

SEQ ID NO: 31188 - RNA, 1350 nt, Artificial Sequence
  derived and/or modified sequence opt4 from Ocaratuzumab_HeavyChain1
gaggugcagcuggugcagagcggcgccgaggugaagaagcccggcgagagccugaagaucagcugcaagggcagcggcagaaccuucaccagcuacaacaugcacugggugagacagaugcccggcaagggccuggaguggaugggcgccaucuacccccugaccggcgacaccagcuacaaccagaagagcaagcugcaggugaccaucagcgccgacaagagcaucagcaccgccuaccugcaguggagcagccugaaggccagcgacaccgccauguacuacugcgccagaagcaccuacgugggcggcgacuggcaguucgacguguggggcaagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagaucaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaagcagaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggc

SEQ ID NO: 31189 - RNA, 639 nt, Artificial Sequence
  derived and/or modified sequence opt4 from Ocaratuzumab_LightChain1
gagaucgugcugacccagagccccggcacccugagccugagccccggcgagagagccacccugagcugcagagccagcagcagcgugcccuacauccacugguaccagcagaagcccggccaggcccccagacugcugaucuacgccaccagcgcccuggccagcggcauccccgacagauucagcggcagcggcagcggcaccgacuucacccugaccaucagcagacuggagcccgaggacuucgccguguacuacugccagcaguggcugagcaacccccccaccuucggccagggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31190 - RNA, 1356 nt, Artificial Sequence
  derived and/or modified sequence opt4 from Ocrelizumab_HeavyChain1
gaggugcagcugguggagagcggcggcggccuggugcagcccggcggcagccugagacugagcugcgccgccagcggcuacaccuucaccagcuacaacaugcacugggugagacaggcccccggcaagggccuggagugggugggcgccaucuaccccggcaacggcgacaccagcuacaaccagaaguucaagggcagauucaccaucagcguggacaagagcaagaacacccuguaccugcagaugaacagccugagagccgaggacaccgccguguacuacugcgccagagugguguacuacagcaacagcuacugguacuucgacguguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31191 - RNA, 639 nt, Artificial Sequence
  derived and/or modified sequence opt4 from Ocrelizumab_LightChain1
gacauccagaugacccagagccccagcagccugagcgccagcgugggcgacagagugaccaucaccugcagagccagcagcagcgugagcuacaugcacugguaccagcagaagcccggcaaggcccccaagccccugaucuacgcccccagcaaccuggccagcggcgugcccagcagauucagcggcagcggcagcggcaccgacuucacccugaccaucagcagccugcagcccgaggacuucgccaccuacuacugccagcaguggagcuucaacccccccaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31192 - RNA, 1356 nt, Artificial Sequence
  derived and/or modified sequence opt4 from Ofatumumab_HeavyChain1
gaggugcagcugguggagagcggcggcggccuggugcagcccggcagaagccugagacugagcugcgccgccagcggcuucaccuucaacgacuacgccaugcacugggugagacaggcccccggcaagggccuggagugggugagcaccaucagcuggaacagcggcagcaucggcuacgccgacagcgugaagggcagauucaccaucagcagagacaacgccaagaagagccuguaccugcagaugaacagccugagagccgaggacaccgcccuguacuacugcgccaaggacauccaguacggcaacuacuacuacggcauggacguguggggccagggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31193 - RNA, 642 nt, Artificial Sequence
  derived and/or modified sequence opt4 from Ofatumumab_LightChain1
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggcccaucaccuucggccagggcaccagacuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 31194 - RNA, 1371 nt, Artificial Sequence
  derived and/or modified sequence opt4 from Olaratumab_HeavyChain1
cagcugcagcugcaggagagcggccccggccuggugaagcccagcgagacccugagccugaccugcaccgugagcggcggcagcaucaacagcagcagcuacuacuggggcuggcugagacagagccccggcaagggccuggaguggaucggcagcuucuucuacaccggcagcaccuacuacaaccccagccugagaagcagacugaccaucagcguggacaccagcaagaaccaguucagccugaugcugagcagcgugaccgccgccgacaccgccguguacuacugcgccagacagagcaccuacuacuacggcagcggcaacuacuacggcugguucgacagaugggaccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 31195 - RNA, 642 nt, Artificial Sequence
  derived and/or modified sequence opt4 from Olaratumab_LightChain1
gagaucgugcugacccagagccccgccacccugagccugagccccggcgagagagccacccugagcugcagagccagccagagcgugagcagcuaccuggccugguaccagcagaagcccggccaggcccccagacugcugaucuacgacgccagcaacagagccaccggcauccccgccagauucagcggcagcggcagcggcaccgacuucacccugaccaucagcagccuggagcccgaggacuucgccguguacuacugccagcagagaagcaacuggccccccgccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc
